(12) United States Patent
Barany et al.

(10) Patent No.: US 7,455,965 B2
(45) Date of Patent: Nov. 25, 2008

(54) METHOD OF DESIGNING ADDRESSABLE ARRAY FOR DETECTION OF NUCLEIC ACID SEQUENCE DIFFERENCES USING LIGASE DETECTION REACTION

(75) Inventors: Francis Barany, New York, NY (US); Monib Zirvi, Willingboro, NJ (US); Norman P. Gerry, Boston, MA (US); Reyna Favis, Iselin, NJ (US); Richard Kliman, Iselin, NJ (US)

(73) Assignee: Cornell Research Foundation, Inc., Ithaca, NY (US)

( * ) Notice: Subject to any disclaimer, the term of this patent is extended or adjusted under 35 U.S.C. 154(b) by 375 days.

(21) Appl. No.: 10/257,158

(22) PCT Filed: Apr. 4, 2001

(86) PCT No.: PCT/US01/10958

§ 371 (c)(1),
(2), (4) Date: Apr. 1, 2004

(87) PCT Pub. No.: WO01/79548

PCT Pub. Date: Oct. 25, 2001

(65) Prior Publication Data

US 2005/0142543 A1    Jun. 30, 2005

Related U.S. Application Data

(60) Provisional application No. 60/197,271, filed on Apr. 14, 2000.

(51) Int. Cl.
*C12Q 1/68* (2006.01)
*C12P 19/34* (2006.01)

(52) U.S. Cl. .................... 435/6; 435/91.1; 435/91.2

(58) Field of Classification Search ............ 435/6, 435/91.1, 91.2
See application file for complete search history.

(56) References Cited

U.S. PATENT DOCUMENTS 4,683,202 A    7/1987    Mullis (Continued)

FOREIGN PATENT DOCUMENTS

EP    0 357 011    8/1989

(Continued)

OTHER PUBLICATIONS

"Nucleic Acid Hybridization—General Aspects," in *Nonradioactive In Situ Hybridization Application Manual*, Indianapolis, Indiana: Boehringer Mannheim Corporation, Chapter III (1992).

(Continued)

*Primary Examiner*—Diana B. Johannsen
*Assistant Examiner*—Robert T Crow
(74) *Attorney, Agent, or Firm*—Nixon Peabody LLP

(57) ABSTRACT

The present invention is directed to a method of designing a plurality of capture oligonucleotide probes for use on a support to which complementary oligonucleotide probes will hybridize with little mismatch, where the plural capture oligonucleotide probes have melting temperatures within a narrow range. The first step of the method involves providing a first set of a plurality of tetramers of four nucleotides linked together, where (1) each tetramer within the first set differs from all other tetramers in the first set by at least two nucleotide bases, (2) no two tetramers within the first set are complementary to one another, (3) no tetramers within the first set are palindromic or dinucleotide repeats, and (4) no tetramer within the first set has one or less or three or more G or C nucleotides. Groups of 2 to 4 of the tetramers from the first set are linked together to form a collection of multimer units. From the collection of multimer units, all multimer units formed from the same tetramer and all multimer units having a melting temperature in ° C. of less than 4 times the number of tetramers forming a multimer unit are removed to form a modified collection of multimer units. The modified collection of multimer units is arranged in a list in order of melting temperature. The order of the modified collection of multimer units is randomized in 2° C. increments of melting temperature.

8 Claims, 253 Drawing Sheets

U.S. PATENT DOCUMENTS

| | | | |
|---|---|---|---|
| 4,883,750 | A | 11/1989 | Whiteley et al. |
| 4,988,617 | A | 1/1991 | Landegren et al. |
| 5,035,996 | A | 7/1991 | Hartley |
| 5,104,792 | A | 4/1992 | Silver et al. |
| 5,143,854 | A | 9/1992 | Pirrung et al. |
| 5,202,231 | A | 4/1993 | Drmanac et al. |
| 5,258,506 | A | 11/1993 | Urdea et al. |
| 5,278,298 | A | 1/1994 | Chakraborty |
| 5,288,468 | A | 2/1994 | Church et al. |
| 5,290,925 | A | 3/1994 | Fino |
| 5,314,809 | A | 5/1994 | Erlich et al. |
| 5,324,633 | A | 6/1994 | Fodor et al. |
| 5,352,582 | A | 10/1994 | Lichtenwalter et al. |
| 5,371,241 | A | 12/1994 | Brush |
| 5,391,480 | A | 2/1995 | Davis et al. |
| 5,405,783 | A | 4/1995 | Pirrung et al. |
| 5,407,798 | A | 4/1995 | Martinelli et al. |
| 5,412,087 | A | 5/1995 | McGall et al. |
| 5,415,839 | A | 5/1995 | Zaun et al. |
| 5,418,149 | A | 5/1995 | Gelfand et al. |
| 5,424,186 | A | 6/1995 | Fodor et al. |
| 5,429,807 | A | 7/1995 | Matson et al. |
| 5,445,934 | A | 8/1995 | Fodor et al. |
| 5,470,705 | A | 11/1995 | Grossman et al. |
| 5,494,810 | A | 2/1996 | Barany et al. |
| 5,496,699 | A | 3/1996 | Sorenson |
| 5,506,137 | A | 4/1996 | Mathur et al. |
| 5,510,270 | A | 4/1996 | Fodor et al. |
| 5,512,441 | A | 4/1996 | Ronai |
| 5,516,635 | A | 5/1996 | Ekins et al. |
| 5,516,663 | A | 5/1996 | Backman et al. |
| 5,525,464 | A | 6/1996 | Drmanac et al. |
| 5,527,681 | A | 6/1996 | Holmes |
| 5,536,649 | A | 7/1996 | Fraiser et al. |
| 5,593,840 | A | 1/1997 | Bhatnagar et al. |
| 5,594,121 | A | 1/1997 | Froehler et al. |
| 5,648,213 | A | 7/1997 | Reddy et al. |
| 5,667,974 | A | 9/1997 | Birkenmeyer et al. |
| 5,695,934 | A | 12/1997 | Brenner |
| 5,700,637 | A | 12/1997 | Southern |
| 5,723,320 | A | 3/1998 | Dehlinger |
| 5,728,526 | A | 3/1998 | George, Jr. et al. |
| 5,731,171 | A | 3/1998 | Bohlander |
| 5,744,305 | A | 4/1998 | Fodor et al. |
| 5,800,984 | A | 9/1998 | Vary |
| 5,834,181 | A | 11/1998 | Shuber |
| 5,837,832 | A | 11/1998 | Chee et al. |
| 5,858,659 | A | 1/1999 | Sapolsky et al. |
| 5,868,136 | A | 2/1999 | Fox et al. |
| 5,876,924 | A | 3/1999 | Zhang et al. |
| 5,912,148 | A | 6/1999 | Eggerding |
| 5,932,711 | A | 8/1999 | Boles et al. |
| 5,942,391 | A | 8/1999 | Zhang et al. |
| 5,981,176 | A | 11/1999 | Wallace |
| 6,027,889 | A | 2/2000 | Barany et al. |
| 6,054,564 | A | 4/2000 | Barany et al. |
| 6,143,495 | A | 11/2000 | Lizardi et al. |
| 6,156,501 | A | 12/2000 | McGall et al. |
| 6,506,594 | B1 | 1/2003 | Barany et al. |
| 6,569,647 | B1 | 5/2003 | Zhang et al. |
| 6,852,487 | B1 | 2/2005 | Barany et al. |
| 2003/0175750 | A1 | 9/2003 | Barany et al. |

FOREIGN PATENT DOCUMENTS

| | | | |
|---|---|---|---|
| EP | | 0 387 696 | 3/1990 |
| EP | | 0 487 104 A1 | 5/1992 |
| EP | | 0 601 714 A1 | 6/1994 |
| EP | | 0 624 643 A | 11/1994 |
| EP | | 0 628 640 A1 | 12/1994 |
| EP | | 0 630 973 A | 12/1994 |
| EP | | 0 799 897 A | 10/1997 |
| WO | | WO 89/10977 | 11/1989 |
| WO | | WO 90/11372 | 10/1990 |
| WO | | WO 90/15070 | 12/1990 |
| WO | | WO 91/17239 | 11/1991 |
| WO | | WO 92/10558 | 6/1992 |
| WO | | WO 92/10566 | 6/1992 |
| WO | | WO 92/10588 | 6/1992 |
| WO | | WO 92/16655 | 10/1992 |
| WO | | WO 93/04199 | 3/1993 |
| WO | | WO 93/09250 | 5/1993 |
| WO | | WO 93/17126 | 9/1993 |
| WO | | WO 93/20227 | 10/1993 |
| WO | | WO 93/20236 | 10/1993 |
| WO | | WO 93/22680 | 11/1993 |
| WO | | WO 93/25563 | 12/1993 |
| WO | | WO 94/01446 | 1/1994 |
| WO | | WO 94/09022 | 4/1994 |
| WO | | WO 94/11530 | 5/1994 |
| WO | | WO 94/17206 | 8/1994 |
| WO | | WO 94/17210 | 8/1994 |
| WO | | WO 95/00533 | 1/1995 |
| WO | | WO 95/35390 | 12/1995 |
| WO | | WO 96/06190 | 2/1996 |
| WO | | WO 96/15271 | 5/1996 |
| WO | | WO 97/31256 | 8/1997 |
| WO | | WO 97/45559 | 12/1997 |
| WO | | WO 98/03673 | 1/1998 |
| WO | | WO 00/47767 | 8/2000 |
| WO | | WO 00/56927 | 9/2000 |
| WO | | WO 01/79548 A2 * | 10/2001 |

OTHER PUBLICATIONS

Abravaya et al., "Detection of Point Mutations with a Modified Ligase Chain Reaction (Gap-LCR)," *Nucleic Acids Research* 23(4):675-682 (1995).

Ahrendt et al., "Rapid p53 Sequence Analysis in Primary Lung Cancer Using an Oligonucleotide Probe Array," *Proc. Natl. Acad. Sci. USA* 96:7382-7387 (1999).

Bains, "Mixed Hybridization and Conventional Strategies for DNA Sequencing," *GATA* 10(3-4):84-94 (1993).

Balles et al., "Facilitated Isolation of Rare Recombinants by Ligase Chain Reaction: Selection for Intragenic Crossover Events in the *Drosophila* Optomotor-Blind Gene," *Mol. Gen. Genet.* 245:734-740 (1994).

Barany, "Genetic Disease Detection And DNA Amplification Using Cloned Thermostable Ligase," *Proc. Natl. Acad. Sci. USA* 88:189-193 (1991).

Barany, "Ligase Chain Reaction (LCR)—Overview and Applications," *PCR Methods and Applications* 3(4):S51-S64 (1994).

Barany, "Cloning, Overexpression, And Nucleotide Sequence Of A Thermostable DNA Ligase Gene," *Gene* 109:1-11 (1991).

Barany, "The Ligase Chain Reaction in a PCR World," *PCR Methods and Applications* 1:5-16 (1991).

Beattie et al., "Advances in Genosensor Research," *Clin. Chem.* 41(5):700-706 (1995).

Belgrader et al., "A Multiplex PCR-Ligase Detection Reaction Assay for Human Identity Testing," *Genome Science & Tech.* 1:77-87 (1996).

Berthèlemy et al., "Identification of K-*ras* Mutations in Pancreatic Juice in the Early Diagnosis of Pancreatic Cancer," *Annals of Internal Medicine* 123(3):188-191 (1995).

Biancalana et al., "Moderate Instability of the Trinucleotide Repeat in Spine Bulbar Muscular Atrophy," *Hum. Mol. Genet.* 1(4):255-258 (1992).

Brennan et al., "Molecular Assessment of Histopathological Staging in Squamous-Cell Carcinoma of the Head and Neck," *The New England Journal of Medicine*, 332(7):429-435 (1995).

Bronner et al., "Mutation in the DNA Mismatch Repair Gene Homologue hMLH1 is Associated with Hereditary Non-Polyposis Colon Cancer," *Nature* (London) 368:258-261 (1994).

Buyse et al., "Rapid DNA Typing of Class II HLA Antigens Using the Polymerase Chain Reaction and Reverse Dot Blot Hybridization," *Tissue Antigens* 41:1-14 (1993).

Cairns et al., "Homozygous Deletions of 9p21 in Primary Human Bladder Tumors Detected by Comparative Multiple Polymerase Chain Reaction." *Cancer Res.* 54:1422-1424 (1994).

Cawkwell et al., "Frequency of Allele Loss of DCC, p. 53, RBI, WT1, NF1, NM23 and PC/MCC in Colorectal Cancer Assayed by Fluorescent Multiplex Polymerase Chain Reaction," *Br. J. Cancer* 70(5):813-818 (1994).

Celi et al., "A Rapid and Versatile Method to Synthesize Internal Standards for Competitive PCR," *Nucleic Acids Research* 21(4):1047 (1993).

Chamberlain et al., "Deletion Screening of the Duchenne Muscular Dystrophy Locus Via Multiplex DNA Amplification," *Nucleic Acids Research* 16(23):11141-11156 (1988).

Chan et al., "Polymeric Self-Assembled Monolayers. 3. Pattern Transfer by Use of Photolithography, Electrochemical, Methods and an Ultrathin, Self-Assembled Diacetylenic Resist," *J. Am. Chem. Soc.* 117:5875-5976 (1995).

Chee et al., "Accessing Genetic Information with High-Density DNA Arrays," *Science* 274:610-614 (1996).

Chehab et al., "Detection of Specific DNA Sequences by Fluorescence Amplification: A Color Complementation Assay," *Proc. Natl. Acad. Sci. USA* 86:9178-9182 (1989).

Cheng et al., "In Situ Attenuated Total Reflectance Fourier Transform Infrared Spectroscopy of Carboxylate-Bearing, Siloxane-Anchored, Self-Assembled Monolayers: A Study of Carboxylate Reactivity and Acid-Base Properties," *Langmuir* 11:1190-1195 (1995).

Chetverin et al., "Sequencing of Pools of Nucleic Acids on Oligonucleotide Arrays," *BioSystems* 30:215-231 (1993).

Chung et al., "Evidence for a Mechanism Predisposing to Intergenerational CAG Repeat Instability in Spinocerebeller Ataxia Type I," *Nat. Genet.* 5:254-258 (1993).

Cronin et al., "Cystic Fibrosis Mutation Detection by Hybridization to Light-Generated DNA Probe Arrays," *Human Mutation* 7:244-255 (19960.

Davis et al., "Quantitative Detection of Hepatitis C Virus RNA With a solid-Phase Signal Amplification Method: Definition of Optimal Conditions for Specimen Collection and Clinical Application in Interferon-Treated Patients," *Hepatology* 19(6):1337-1341.

Day et al., "Detection Of Steroid 21-Hydroxylase Alleles Using Gene-Specific PCR and a Multiplexed Ligation Detection Reaction," *Genomics* 29:152-162 (1995).

Day et al., "Identification of Non-Amplifying CYP21 Genes When Using PCR-Based Diagnosis of 21-Hydroxylase Deficiency in Congenital Adrenal Hyperplasia (CAH) Affected Pedigrees," *Hum. Mol. Genet.* 5(12):2039-2048 (1996).

Deng et al., "An Improved Method of competitive PCR for Quantitation of Gene Copy Number," *Nucleic Acids Research* 21 (20):4848-4849 (1993).

Drobyshev et al., "Sequence Analysis by Hybridization with Oligonucleotide Microchip: Identification of β-Thalassemia Mutations," *Gene* 188:45-52 (1997).

Eggerding, "A One-Step Coupled Amplification and Oligonucleotide Ligation Procedure for Multiplex Genetic Typing," *PCR Methods and Applications* 4:337-345 (1995).

Favis et al., "Mutation Detection in K-ras, BRCA1, BRCA2, and p53 Using PCR/LDR and a Universal DNA Microarray," *Ann. NY Acad. Sci.* 906:39-43 (2000).

Favis et al., "Universal DNA Array Detection of Small Insertions and Deletions in BRCA1 and BRCA2," *Nat. Biotechnol.* 18(5):561-564 (2000).

Fishel et al., "The Human Mutator Gene Homolog MSH2 and its Associate with Hereditary Nonpolyposis Colon Cancer," *Cell* 75:1027-1038 (1993).

Fodor et al., "Multiplexed Biochemical Assays with Biological Chips," *Nature* 364:555-556 (1993).

Frenkel et al., "Specific, Sensitive and Rapid Assay for Human Immunodeficiency Virus Type 1 pol Mutations Associated with Resistance to Zidovudine and Didanosine," *J. Clin. Microbiol.* 33(2):342-347 (1995).

Friedhoff et al., "Quantitative Polymerase Chain Reaction with Oligodeoxynucleotide Ligation Assay/Enzyme-Linked Immunosorbent Assay Detection," *Anal. Biochem.* 215:9-16 (1993).

Gerry et al., "Universal DNA Microarray Method for Multiplex Detection of Low Abundance Point Mutations," *J. Mol. Biol.* 292:251-262 (1999).

Gibbs et al., "Detection of Single DNA Base Differences by Competitive Oligonucleotide Priming," *Nucleic Acids Research* 17(7):2437-2448 (1989).

Gonzalez-Zulueta et al., "Microsatellite Instability in Bladder Cancer," *Cancer Res.* 53:5620-5623 (1993).

Graham et al., "Gene Probe Assays on a Fibre-Optic Evanescent Wave Biosensor," *Biosensors & Bioelectronics* 7:487-493 (1992).

Grossman et. al., "High-Density Multiplex Detection of Nucleic Acid Sequences: Oligonucleotide Ligation Assay and Sequence-Coded Separation," *Nucleic Acids Research* 22(21):4527-4534 (1994).

Guo et al., "Direct Fluorescence Analysis of Genetic Polymorphisms by Hybridization with Oligonucleotide Arrays on Glass Supports," *Nucleic Acids Research* 22:5456-5465 (1994).

Gyllensten et al., "PCR-Based HLA Class II Typing," *PCR Methods and Applications* 1:91-98 (1991).

Hacia et al., "Detection of Heterozygous Mutations in BRCA1 Using High Density Oligonucleotide Arrays and Two-Colour Fluorescence Analysis," *Nature Genetics* 14:441-447 (1996).

Hacia, "Resequencing and Mutational Analysis Using Oligonucleotide Microarrays," *Nat. Genetics* (Suppl.) 2:42-47 (1999).

Hames et al., eds., Nucleic Acid Hybridisation. A Practical Approach, Oxford, England: IRL Press, pp. 5-7 (1985).

Han et al., "Genetic Instability in Pancreatic Cancer and Poorly Differentiated Type of Gastric Cancer," *Cancer Res.* 53:5087-5089 (1993).

Hayashi et al., "Genetic Diagnosis Identifies Occult Lymph Node Metastases Undetectable by the Histopathological Method," *Cancer Res.* 54:3853-3856 (1994).

Heller et al., "Discovery and Analysis of Inflammatory Disease-Related Genes Using cDNA Microarrays," *Proc. Nat'l Acad. Sci.* 94:2150-2155 (1997).

Hollstein et al., "p53 Mutations in Human Cancers," *Science* 253:49-53 (1991).

Hsuih et al., "Novel, Ligation-Dependent PCR Assay for Detection of Hepatitis C Virus in Serum," *J. Clin. Microbiol.* 34(3):501-507 (1996).

Imbert et al., "Origin of the Expansion Mutation in Myotonic Dystrophy," *Nat. Genet.* 4:72-76 (1993).

Ionov et al., "Ubiquitous Somatic Mutations in Simple Repeated Sequences Reveal a New Mechanism for Colonic Carcinogenesis," *Nature* (London) 363:558-561 (1993).

Iovannisci et al., "Ligation Amplification and Fluorescence Detection of Mycobacterium Tuberculosis DNA," *Mol. Cell. Probes* 7(1):35-43 (1993).

Janssen et al., "Evaluation of the DNA Fingerprinting Method AFLP as a New Tool in Bacterial Taxonomy," *Microbiology* 142:1881-1893 (1996).

Jen et al., "Molecular Determinants of Dysplasia in Colorector Lesions," *Cancer Res.* 54:5523-5526 (1994).

Jin et al., "Alternating Current Impedance Characterization of the Structure of Alkylsiloxane Self-Assembled Monolayers on Silicon," *Langmuir* 10:2662-2671 (1994).

Jou et al., "Deletion Detection in the Dystrophin Gene by Multiplex Gap Ligase Chain Reaction and Immunochromatographic Strip Technology," *Human Mutation* 5:86-93 (1995).

Khanna et al., "Ligase Detection Reaction for Identification of Low Abundance Mutations," *Clin. Biochem.* 32(4):287-290 (1999).

Khanna et al., "Multiplex PCR/LDR for Detection of K-*ras* Mutations in Primary Colon Tumors," *Oncogene* 18:27-38 (1999).

Khrapko et al., "A Method for DNA Sequencing by Hybridization with Oligonucleotide Matrix," *J. DNA Seq. Map* 1:375-388 (1991).

Kim et al., "Polymeric Self-Assembled Monolayers. 2. Synthesis and Characterization of Self-Assembled Polydiacetylene Mono- and Multilayers," *J. Am. Chem. Soc.* 117:3963-3967 (1995).

Koide et al., "Unstable Expansion of CAG Repeat in Hereditary Dentatorubral-Pallidoluysian Atrophy (DRPLA)," *Nat. Genet.* 6:9-13 (1994).

Kovach et al., "Mutation Detection by Highly Sensitive Methods Indicates that p53 Gene Mutations in Breast Cancer Can Have Important Prognostic Value," *Proc. Natl. Acad. Sci. USA* 93:1093-1096 (1996).

Kozal et al., "Extensive Polymorphisms Observed in HIV-1 Clade B Protease Gene Using High-Density Oligonucleotide Arrays," *Nature Medicine* 2:753-759 (1996).

Kreiner, "Rapid Genetic Sequence Analysis Using a DNA Probe Array System," *American Laboratory*, pp. 39-43 (1996).

Kremer et al., "Mapping of DNA Instability at the Fragile X to a Trinucleotide Repeat Sequence p(CCG)n," *Science* 252:1711-1714 (1994).

Kuppuswamy et al., "Single Nucleotide Primer Extension to Detect Genetic Diseases: Experimental Application to Hemophilia B (factor IX) and Cystic Fibrosis Genes," *Proc. Natl. Acad. Sci. USA* 88:1143-1147 (1991).

Kuznetsova et al., "DNA Sequencing by Hybridization with Oligonucleotides Immobilized in a Gel," *Mol. Biol.* (Mosk) (Russia) 28(2):290-299 (1994).

Landegren et al., "A Ligase-Mediated Gene Detection Technique," *Science* 241:1077-1080 (1988).

Lauer et al., "Cloning, Nucleotide Sequence, and Engineered Expression of *Thermus thermophilus* DNA Ligase, a Homolog of *Escherichia coli* DNA Ligase," *Journal of Bacteriology* 173(16):5047-5053 (1991).

Leach et al., "Mutations of a mutS Homolog in Hereditary Nonpolyposis Colorectal Cancer," *Cell* 75:1215-1225 (1993).

Lin et al., "Multiplex Genotype Determination at a Large Number of Gene Loci," *Proc. Natl. Acad. Sci USA* 93:2582-2587 (1996).

Lipshutz et al., "Using Oligonucleotide Probe Arrays To Assess Genetic Diversity," *Biotechniques* 19:442-447 (1995).

Livak et al., "Detection of Single Base Differences Using Biotinylated Nucleotides With Very Long Linker Arms," *Nucleic Acids Research* 20:4831-4837 (1989).

Livshits et al., "Dissociation of Duplexes Formed by Hybridization of DNA with Gel-Immobilized Oligonucleotides," *Journal of Biomolecular Structure & Dynamics* 11(4):783-795 (1994).

Lu et al., "Quantitative Aspects of the Mutant Analysis by PCR anc Restriction Enzyme Cleavage (MAPREC)," *PCR Methods and Applications* 3:176-180 (1993).

Lysov et al., "DNA Sequencing by Hybridization to Oligonucleotide Matrix. Calculation of Continuous Stacking Hybridization Efficiency," *Journal of Biomolecular Structure & Dynamics* 11(4):797-812 (1994).

Lysov et al., "Measurement of Distances Between DNA Segments Increases Efficiency of Sequencing by Hybridization with Oligonucleotide Matrix," *Molecular Biology* 28(3):433-436 (1994).

Mao et al., "Microsatellite Alteration as Clonal Markers for the Detection of Human Cancer," *Proc. Natl. Acad. Sci. USA* 91:9871-9875 (1994).

Mao et al., "Molecular Detection of Primary Bladder Cancer," *Science* 271:659-662 (1996).

Maskos et al., "A Novel Method for the Analysis of Multiple Sequence Variants by Hybridization to Oligonucleotides," *Nucleic Acids Research* 21:2267-2268 (1993).

Maskos et al., "A Study of Oligonucleotide Reassociation Using Large Arrays of Oligonucleotides Synthesized on a Glass Support," *Nucleic Acids Research* 21:4663-4669 (1993).

Merlo et al., "Frequent Microsatellite Instability in Primary Small Cell Lung Cancer," *Cancer Res.* 54:2098-2101 (1994).

Milner et al., "Selecting Effective Antisense Reagents on Combinatorial Oligonucleotide Arrays," *Nature Biotechnology* 15:537-541 (1997).

Mitsudomi et al., "Mutations of ras Genes Distinguish a Subset of Non-Small-Cell Lung Cancer Cell Lines from Small-Cell Lung Cancer Cell Lines," *Oncogene* 6:1353-1362 (1991).

Munkholm et al., "Polymer Modification of Fiber Optic Chemical Sensors as a Method of Enhancing Fluorescence Signal for pH Measurement," *Anal. Chem.* 58:1427-1430 (1986).

Nawroz et al., "Allelotype of Head and Neck Squamous Cell Carcinoma," *Cancer Res.* 54:1152-1155 (1994).

Newton et al., "The Production of PCR Products with 5' Single-Stranded Tails Using Primers that Incorporate Novel Phosphoram Phosphoramidite Intermediates," *Nucleic Acids Research* 21(5):115-162 (1993).

Nickerson et al., "Automated DNA Diagnostics Using an ELISA-Based Oligonucleotide Ligation Assay," *Proc. Natl. Acad. Sci. USA* 87:8923-8927 (1990).

Nikiforov et al., "Genetic Bit Analysis: A Solid Phase Method for Typing Single Nucleotide Polymorphisms," *Nucleic Acids Research* 22(20):4167-4175 (1994).

Nilsson et al., "Padlock Probes: Circularizing Oligonucleotides for Localized DNA Detection," *Science* 265:2085-2088 (1994).

Orr et al., "Expansion of an Unstable Trinucleotide CAG Repeat in Spinocerebeller Ataxia Type 1," *Nat. Genet.* 4:221-226 (1993).

Papadopoulos et al., "Mutation of mutl. Homolog in Hereditary Colon Cancer," *Science* 263:1625-1629 (1994).

Parinov et al., "DNA Sequencing by Hybridization to Microchip Octa- and Decanuyleotides Extended by Stacked Pentanucleotides," *Nucleic Acids Research* 24:2998-3004 (1996).

Park et al., "Detection of HCV RNA Using Ligation-Dependent Polymerase Chain Reaction in Formalin-Fixed Paraffin-Embedded Liver Tissue," *American Journal of Pathology* 149(5):1485-1491 (1996).

Pease et al., "Light-Generated Oligonucleotide Arrays for Rapid DNA Sequence Analysis," *Proc. Natl. Acad. Sci. USA* 91:5022-5026 (1994).

Peinado et al., "Isolation and Characterization of Allelic Losses and Gains in Colorectal Tumors by Arbitrarily Primed Polymerase Chain Reaction," *Proc. Natl. Acad. Sci. USA* 89:10065-10069 (1992).

Peltomäki et al., "Microsatellite Instability is Associated with Tumors that Characterize the Hereditary Non-Polyposis Colorectal Carcinoma Syndrome," *Cancer Res.* 53:5853-5855 (1993).

Powell et al., "Molecular Diagnosis of Familial Adenomatous Polyposis," *The New England Journal of Medicine* 329(27):1982-1987 (1993).

Radford et al., "Allelotyping of Ductal Carcinoma in Situ of the Breast: Deletion of Loci on 8p, 13q, 16q, 17p and 17l[1]," *Cancer Research* 55:3399-3405 (1995).

Redston et al., "Common Occurrence of APC and K-ras Gene Mutations in the Spectrum of Colitis-Associated Neoplasias," *Gastroenterology* 108:383-392 (1995).

Reed et al., "Chromosome-Specific Microsatellite Sets for Fluorescence-Based, Semi-Automated Genome Mapping," *Nature Genetics* 7:390-395 (1994).

Reyes et al., "Ligase Chain Reaction Assay for Human Mutations: The Sickle Cell by LCR Assay," *Clinical Chemistry* 43(1):40-44 (1997).

Reynolds et al., "Analysis of Genetic Markers in Forensic DNA Samples Using the Polymerase Chain Reaction," *Anal. Chem.* 63:2-15 (1991).

Risinger et al., "Genetic Instability of Microsatellites in Endometrial Carcinoma," *Cancer Res.* 53:5100-5103 (1993).

Ruppert et al., "Evidence for Two Bladder Cancer Suppressor Loci on Human Chromosome 9[1]," *Cancer Res.* 53:5093-5094 (1993).

Rust et al., "Mutagenically Separated PCR (MS-PCR): A Highly Specific One Step Procedure for Easy Mutation Detection," *Nucleic Acids Research* 21(16):3623-3629 (1993).

Saiki et al., "Enzymatic Amplification of β-Globin Genomic Sequences and Restriction Site Analysis for Diagnosis of Sickle Cell Anemia," *Science* 230:1350-1354 (1985).

Sambrook et al., *Molecular Cloning A Laboratory Manual*, 2nd Ed., Cold Spring Laboratory Press (1989) (Index Only).

Schena et al., "Parallel Human Genome Analysis: Microarray-Based Expression Monitoring of 1000 Genes," *Proc. Natl. Acad. Sci. USA* 93:10614-10619 (1996).

Schena et al., "Quantitative Monitoring of Gene Expression Patterns with a Complementary DNA Microarray," *Science* 270:467-470 (1995).

Shalon et al., "A DNA Microarray System for Analyzing Complex DNA Samples Using Two-Color Fluorescent Probe Hybridization," *Genome Research* 6:639-645 (1996).

Sidransky et al., "Identification of ras Oncogene Mutations in the Stool of Patients with Curable Colorector Tumors," *Science* 256:102-105 (1992).

Southern et al., "Analyzing and Comparing Nucleic Acid Sequences by Hybridization to Arrays of Oligonucleotides: Evaluation Using Experimental Models," *Genomics* 13: 1008-1017 (1992).

Southern, "DNA Chips: Analyzing Sequence by Hybridization to Oligonucleotides on a Large Scale," *Trends in Genet.* 12(3):110-115 (1996).

Suzuki et al., "Detection of ras Gene Mutations in Human Lung Cancers by Single-Strand Conformation Polymorphism Analysis of Polymerase Chain Reaction Products," *Oncogene* 5:1037-1043 (1990).

Syvänen et al., "Identification of Individuals by Analysis of Biallelic DNA Markers, Using PCR and Solid-Phase Minisequencing," *Am. J. Hum. Genet.* 52:46-59 (1993).

Tada et al., "Clinical Application of ras Gene Mutation for Diagnosis of Pancreatic Adenocarcinoma," *Gastroenterology* 100:233-238 (1991).

Tada et al., "Detection of ras Gene Mutations in Pancreatic Juice and Peripheral Blood of Patients with Pancreatic Adenocarcinoma," *Cancer Res.* 53:2472-2474 (1993).

Tavormina et al., "Thanatophoric Dysplasia (Types I and II) Caused by Distinct Mutations in Fibroblast Growth Factor Receptor 3," *Nature Genetics* 9:32128 (1995).

Telenti et al., "Competitive Polymerase Chain Reaction Using an Internal Standard: Application to the Quantitation of Viral DNA," *Journal of Virological Methods* 39:259-268 (1992).

The Huntington's Disease Collaborative Research Group, "A Novel Gene Containing a Trinucleotide Repeat that is Expanded and Unstable on Huntington's Disease Chromosomes," *Cell* 72:971-983 (1993).

Thibodeau et al., "Microsatellite Instability in Cancer of the Proximal Colon," *Science* 260:816-819 (1993).

Timofeev et al., "Regioselective Immobilization of Short Oligonucleotides to Acrylic Copolymer Gels," *Nucleic Acids Research* 24:3142-3148 (1996).

Tong et al., "Biochemical Properties of High Fidelity DNA Ligase from *Thermus* species AK16D," *Nucleic Acids Research* 27(3):788-794 (1999).

Tsui, "Mutations and Sequence Variations Detected in the Cystic Fibrosis Transmembrane Conductance Regulator (CFTR) Gene: a Report from the Cystic Fibrosis Genetic Analysis Consortium," *Human Mutation* 1:197-203 (1992).

Urdea, "Synthesis and Characterization of Branched DNA (bDNA) for the Direct and Quantitative Detection of CMV, HBV, HCV, and HIV," *Clinical Chemistry* 39(4):725-726 (1993).

Van Der Riet et al., "Frequent Loss of Chromosome 9p21-22 Early in Head and Neck Cancer Progression," *Cancer Res.* 54:1156-1158 (1994).

Van Ness et al., "A Versatile Solid Support System for Oligodeoxynucleotide Probe-based Hybridization Assays," *Nucleic Acids Research* 19:3345-3350 (1991).

Wallace et al., "Ligase Chain Reaction for the Detection of Specific DNA Sequences and Point Mutations," in Pfeifer, ed., *Technologies for Detection of DNA Damage and Mutations*, New York, NY: Plenum, Press, pp. 307-322 (1996).

Wang et al., "Large-Scale Identification, Mapping, and Genotyping of Single-Nucleotide Polymorphisms in the Human Genome," *Science* 280: 1077-1082 (1998).

Weber et al., "Abundant Class of Human DNA Polymorphisms Which Can Be Typed Using the Polymerase Chain Reaction," *Amer. J. Hum. Genet.* 44:388-396 (1989).

Weissenbach et al., "A Second-Generation Linkage Map of the Human Genome," *Nature* (London) 359:794-800 (1992).

Winn-Deen, et al., "Sensitive Fluorescence Method for Detecting DNA Ligation Amplification Products," *Clinical Chemistry* 37(9):1522-1523 (1991).

Wu et al., "The Ligation Amplification Reaction (LAR)-Amplification of Specific DNA Sequences Using Sequential Rounds of Template-Dependent Ligation," *Genomics* 4:560-569 (1989).

Yershov et al., "DNA Analysis and Diagnostics on Oligonucleotide Microchips," *Proc. Natl. Acad. Sci. USA* 93:4913-4918 (1996).

Zebala et al., "Characterization of Steady State, Single Turnover, and Binding Kinetics of the *Taq*I Restriction Endonuclease," *J. Biol. Chem.* 267(12):8097-8105 (1992).

Zebala et al., "Implications for the Ligase Chain Reaction in Gastroenterology," *Clin. Gastroenterol.* 17(2):171-175 (1993).

Zhang et al., "Single-base Mutational Analysis of Cancer and Genetic Disease Using Membrane Modified Oligonucleotides," *Nucleic Acids Research* 19:3929-3933 (1991).

Zirvi et al., "Improved Fidelity of Thermostable Ligases for Detection of Microsatellite Repeat Sequences Using Nucleoside Analogs," *Nucleic Acids Research* 27(24):e41 (1999).

Zirvi et al., "Ligase-based Detection of Mononucleotide Repeat Sequences," *Nucleic Acids Research* 27(24):e40 (1999).

"Acrylamide" *Wikipedia Encyclopedia*, Retrieved from the internet at http://en.wikipedia.org/wiki/Acrylamide on Sep. 15, 2005.

\* cited by examiner

PCR/LDR

1. PCR AMPLIFY REGION(S) CONTAINING MUTATIONS USING PRIMERS, dNTPS AND Taq POLYMERASE. ◆

2. PERFORM LDR USING ALLELE-SPECIFIC LDR PRIMERS AND THERMOSTABLE LIGASE. ●
   ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

3. CAPTURE FLUORESCENT PRODUCTS ON ADDRESSABLE ARRAY AND QUANTIFY EACH ALLELE.

*FIG. 3*

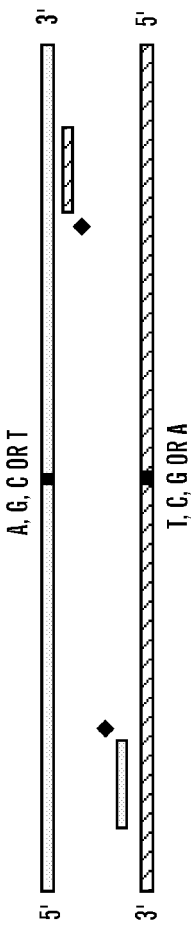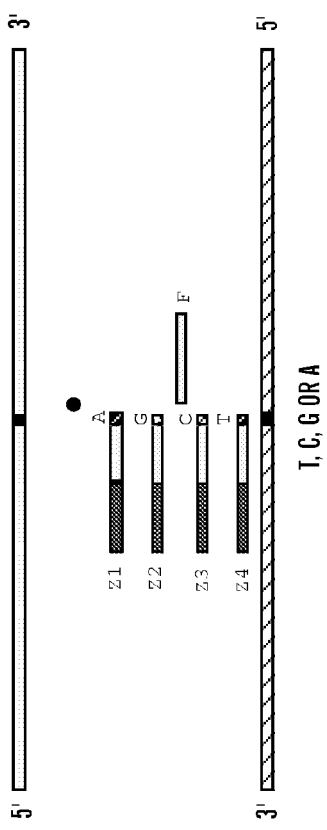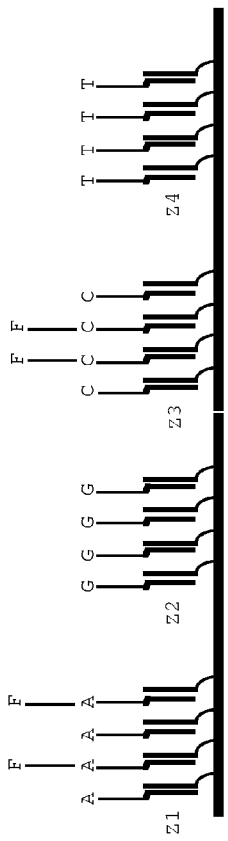

PCR/LDR, SCHEME 3

1. PCR AMPLIFY REGION(S) CONTAINING MUTATIONS USING PRIMERS, dNTPS AND Taq POLYMERASE. ◆

2. PERFORM LDR USING ALLELE-SPECIFIC LDR PRIMERS AND THERMOSTABLE LIGASE. ●
ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

3. CAPTURE FLUORESCENT PRODUCTS ON ADDRESSABLE ARRAY AND QUANTIFY EACH ALLELE.

FIG. 5

PCR/ LDR : NEARBY ALLELES, SCHEME 5

1. PCR AMPLIFY REGION(S) CONTAINING MUTATIONS USING PRIMERS, dNTPs AND Taq POLYMERASE. ◆

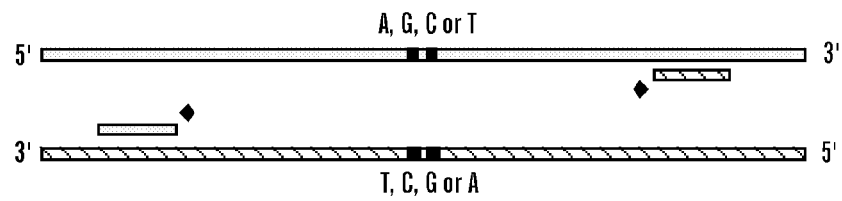

2. PERFORM LDR USING ALLELE-SPECIFIC LDR PRIMERS AND THERMOSTABLE LIGASE. ● ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

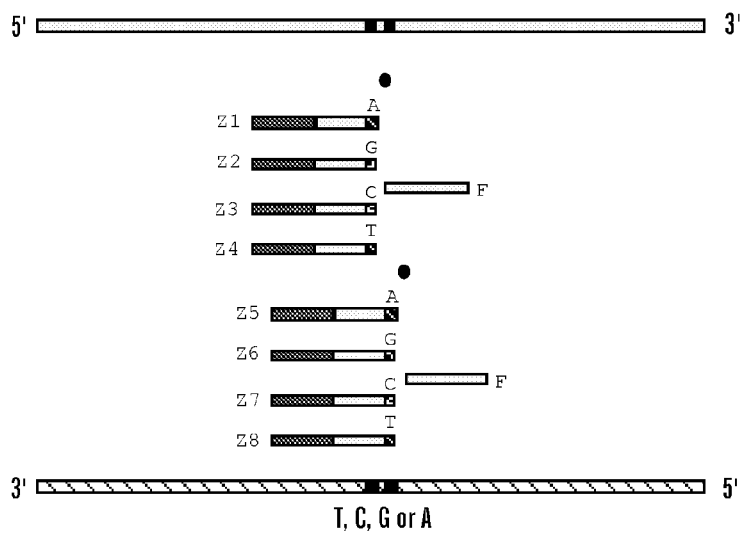

3. CAPTURE FLUORESCENT PRODUCTS ON ADDRESSABLE ARRAY AND QUANTIFY EACH ALLELE.

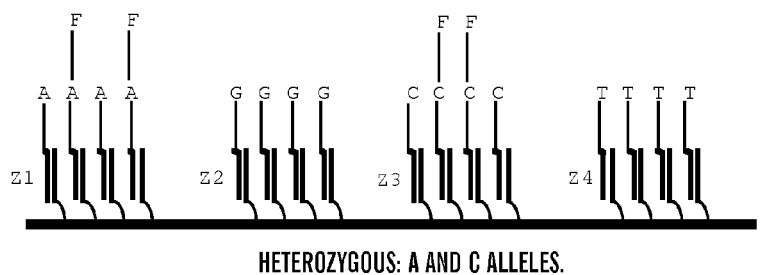

HETEROZYGOUS: A AND C ALLELES.

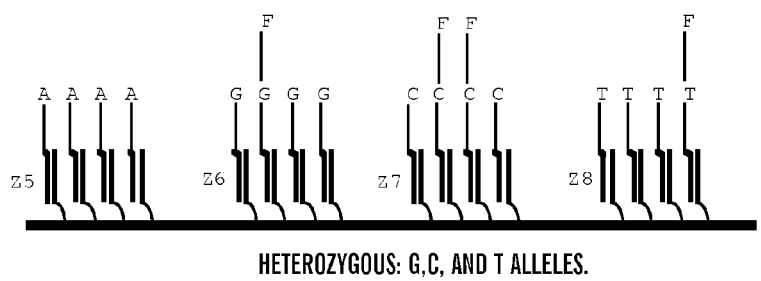

HETEROZYGOUS: G, C, AND T ALLELES.

*FIG. 7*

PCR/LDR: INSERTIONS AND DELETIONS, SCHEME 7

1. PCR AMPLIFY REGION(S) CONTAINING MUTATIONS USING PRIMERS, dNTPS AND Taq POLYMERASE. ◆

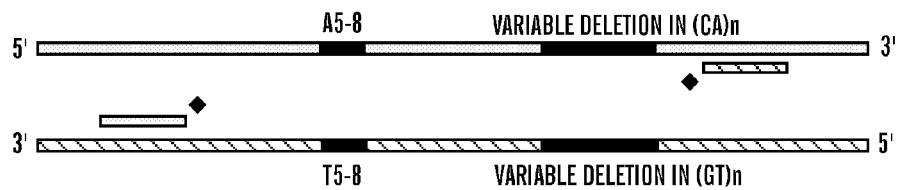

2. PERFORM LDR USING ALLELE-SPECIFIC LDR PRIMERS AND THERMOSTABLE LIGASE. ● ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

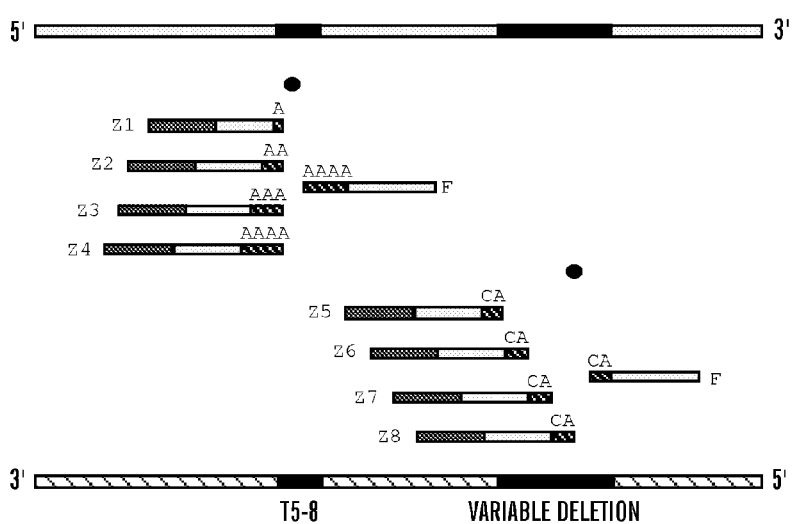

3. CAPTURE FLUORESCENT PRODUCTS ON ADDRESSABLE ARRAY AND QUANTIFY EACH ALLELE.

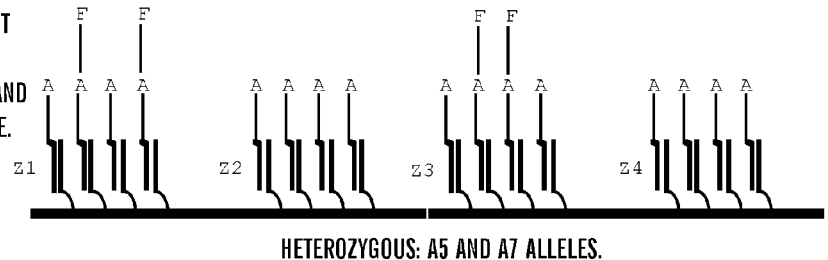

HETEROZYGOUS: A5 AND A7 ALLELES.

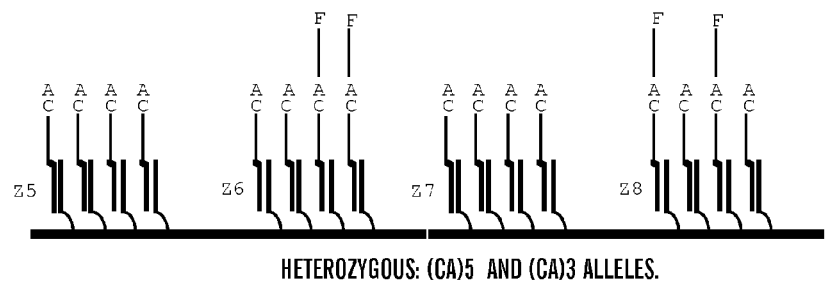

HETEROZYGOUS: (CA)5 AND (CA)3 ALLELES.

*FIG. 9*

PCR/ LDR : INSERTIONS AND DELETIONS, SCHEME 7

1. PCR AMPLIFY REGION(S) CONTAINING MUTATIONS USING PRIMERS, dNTPS AND Taq POLYMERASE. ◆

A5-8   VARIABLE DELETION IN (CA)n
   T5-8   VARIABLE DELETION IN (GT)n

2. PERFORM LDR USING ALLELE-SPECIFIC LDR PRIMERS AND THERMOSTABLE LIGASE. ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

F1 — A
   F2 — AA
   F3 — AAA     AAAA — Z1
   F4 — AAAA

F1 — CA
   F2 — CA
   F3 — CA      CA — Z2
   F4 — CA

T5-8   VARIABLE DELETION

3. CAPTURE FLUORESCENT PRODUCTS ON ADDRESSABLE ARRAY AND QUANTIFY EACH ALLELE.

Z1: HETEROZYGOUS: A5 AND A7 ALLELES.

Z2: HETEROZYGOUS: (CA)5 AND (CA)3 ALLELES.

*FIG. 10*

PCR/LDR: ADJACENT ALLELES, CANCER DETECTION, SCHEME 9

1.
PCR AMPLIFY
REGION(S) CONTAINING
MUTATIONS USING
PRIMERS, dNTPS AND
Taq POLYMERASE. ◆

2.
PERFORM LDR USING
ALLELE-SPECIFIC LDR
PRIMERS AND
THERMOSTABLE LIGASE. ●
ALLELE SPECIFIC
OLIGONUCLEOTIDES LIGATE
TO COMMON
OLIGONUCLEOTIDES ONLY
WHEN THERE IS PERFECT
COMPLEMENTARITY AT THE
JUNCTION.

3.
CAPTURE FLUORESCENT
PRODUCTS ON
ADDRESSABLE ARRAY
AND QUANTIFY EACH
ALLELE.

Gly TO Asp MUTATION

FIG. 11

PCR/LDR : ADJACENT ALLELES, CANCER DETECTION, SCHEME 10

1.
PCR AMPLIFY REGION(S) CONTAINING MUTATIONS USING PRIMERS, dNTPS AND Taq POLYMERASE. ◆

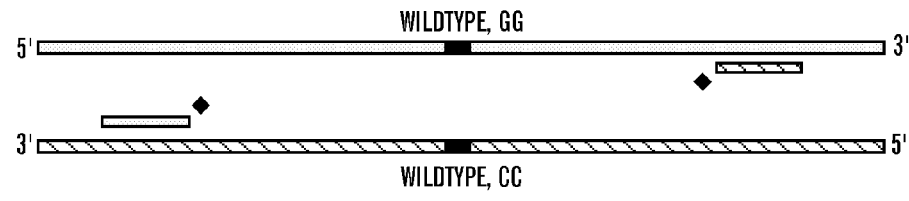

2.
PERFORM LDR USING ALLELE-SPECIFIC LDR PRIMERS AND THERMOSTABLE LIGASE. ●
ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

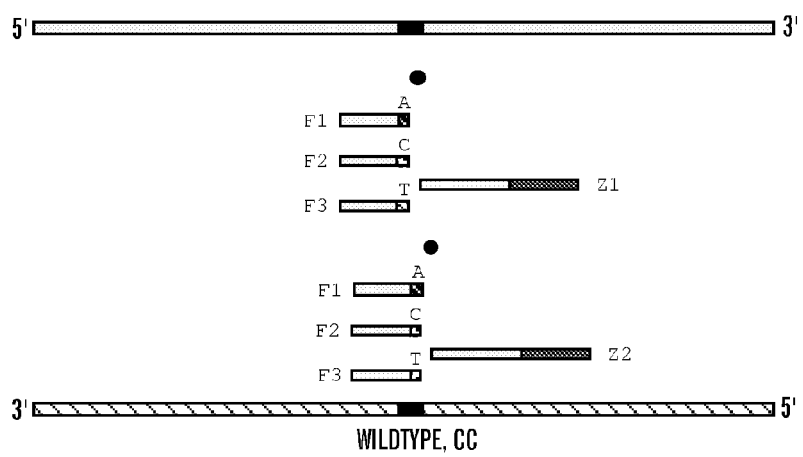

3.
CAPTURE FLUORESCENT PRODUCTS ON ADDRESSABLE ARRAY AND QUANTIFY EACH ALLELE.

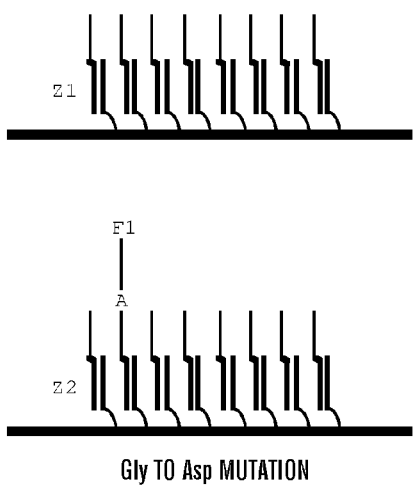

Gly TO Asp MUTATION

*FIG. 12*

PCR/LDR : NEARBY ALLELES, SCHEME 11

1.
PCR AMPLIFY REGION(S) CONTAINING MUTATIONS USING PRIMERS, dNTPS AND Taq POLYMERASE.◆

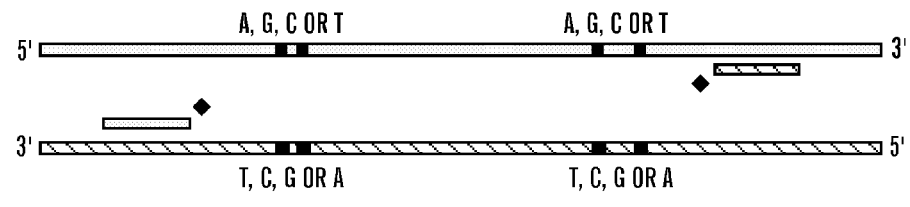

2.
PERFORM LDR USING ALLELE-SPECIFIC LDR PRIMERS AND THERMOSTABLE LIGASE.● ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

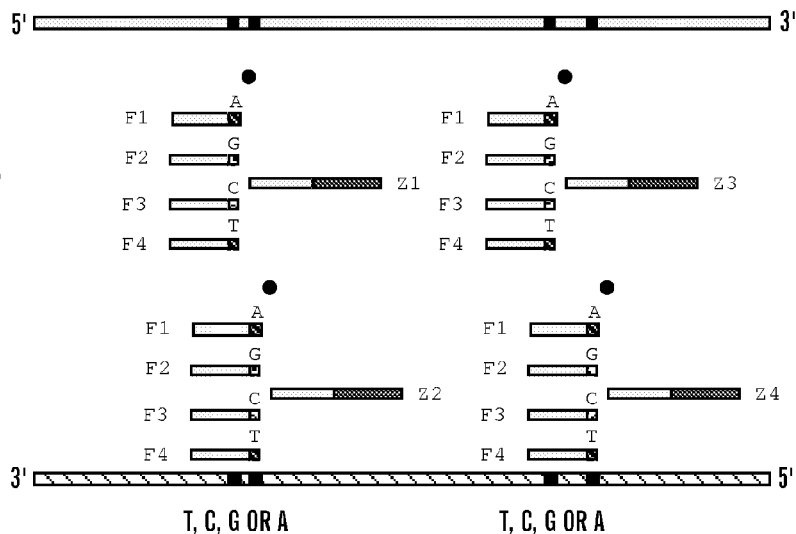

3.
CAPTURE FLUORESCENT PRODUCTS ON ADDRESSABLE ARRAY AND QUANTIFY EACH ALLELE.

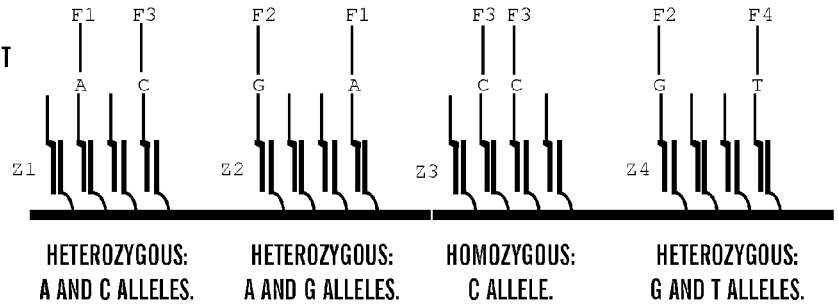

*FIG. 13*

PCR/LDR: ADJACENT AND NEARBY ALLELES, SCHEME 12

1. PCR AMPLIFY REGION(S) CONTAINING MUTATIONS USING PRIMERS, dNTPS AND Taq POLYMERASE. ◆

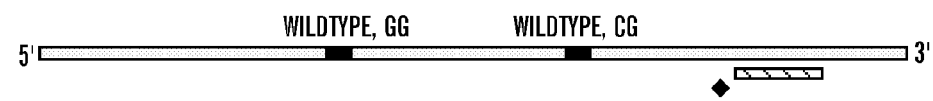

2. PERFORM LDR USING ALLELE-SPECIFIC LDR PRIMERS AND THERMOSTABLE LIGASE. ● ALLELE SPECIFIC OLIGONUCLEOTIDES LIGATE TO COMMON OLIGONUCLEOTIDES ONLY WHEN THERE IS PERFECT COMPLEMENTARITY AT THE JUNCTION.

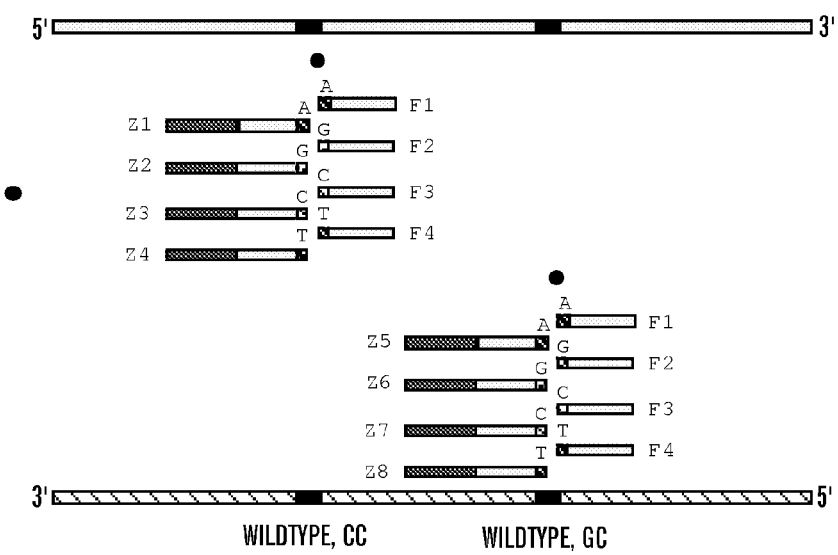

3. CAPTURE FLUORESCENT PRODUCTS ON ADDRESSABLE ARRAY AND QUANTIFY EACH ALLELE.

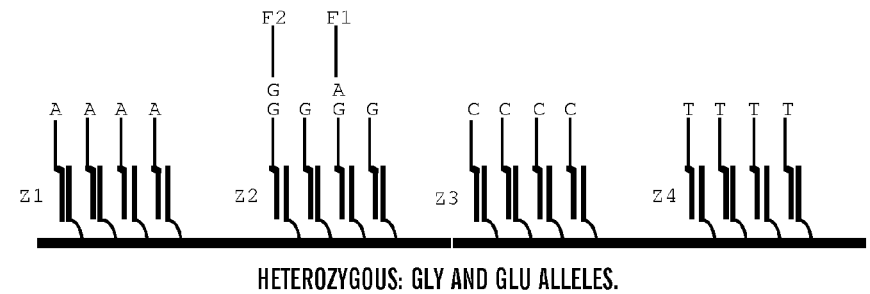

HETEROZYGOUS: GLY AND GLU ALLELES.

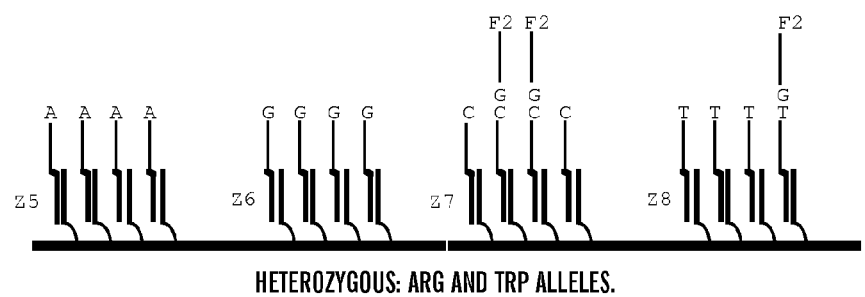

HETEROZYGOUS: ARG AND TRP ALLELES.

*FIG. 14*

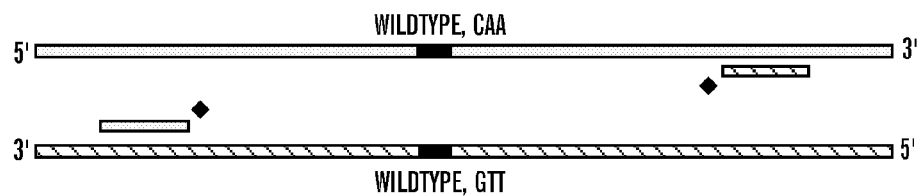
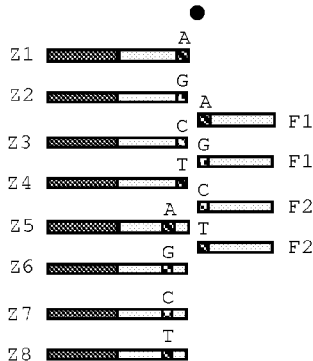
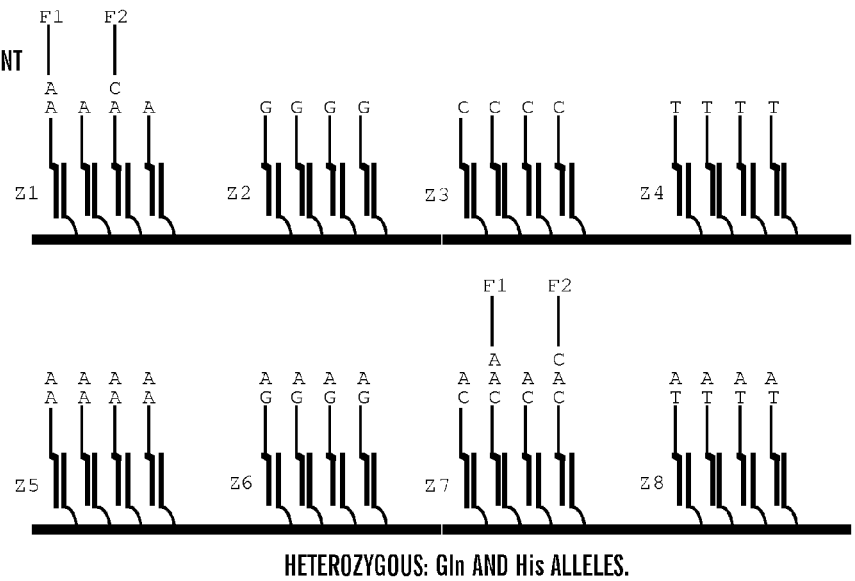
FIG. 15

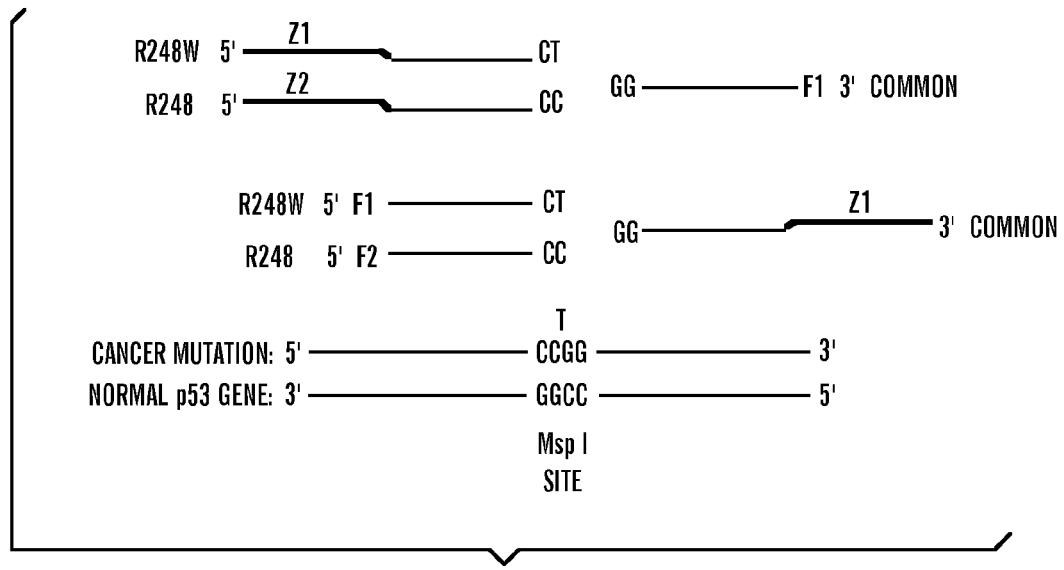
*FIG. 17A*
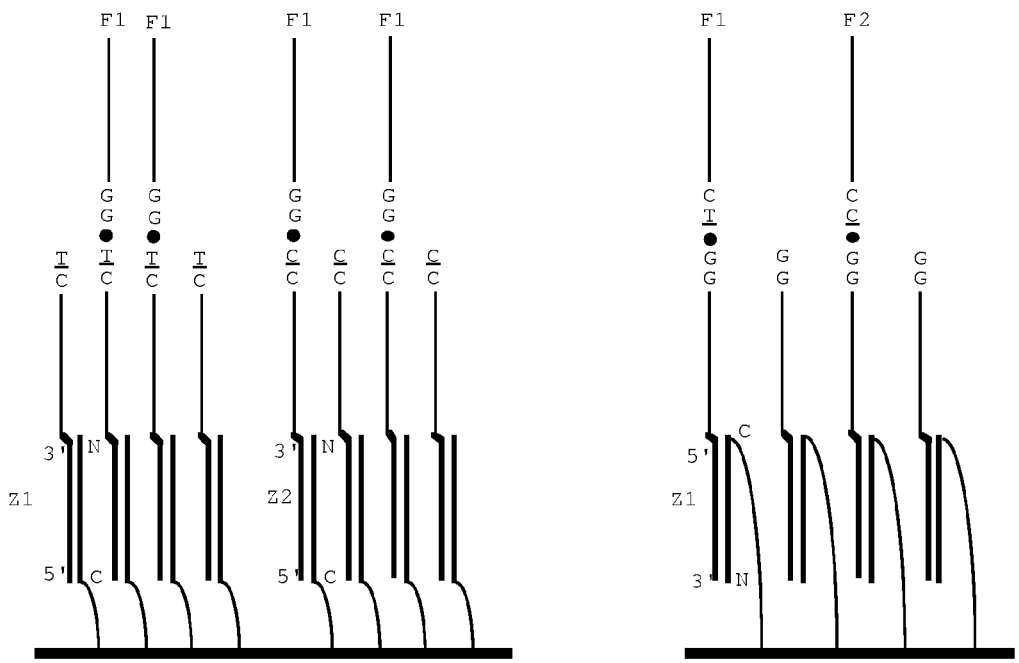
*FIG. 17B*  *FIG. 17C*

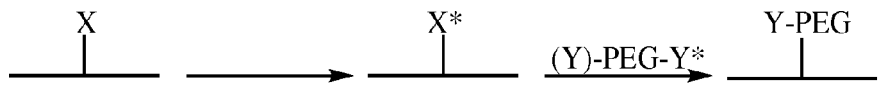

X, Y = –OH
       –CO$_2$H
       –NH$_2$
(Y)   = W–NH–

X*, Y* = –O(C=O)Z
         –O(C=S)Z
         –CO$_2$H
         –(C=O)Z
         –NH$_2$
         –N=C=O

W = protecting group, e.g. Boc, Fmoc
Z = activating group, e.g. imidazole (Im), *p*-nitrophenol (OPnp),
    hydroxysuccinimide (OSu), pentafluorophenol (OPfp)
PEG = oligo or poly(ethylene glycol), backbone (CH$_2$CH$_2$O)$_n$  n = 6 to 200
    (can also be grown by anionic polymerization with 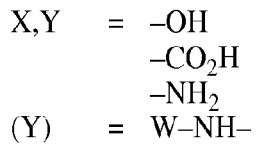 )
WSC = water soluble carbodiimide

**Functional group transformations/activation (as needed), X → X*, Y → Y***

–OH  →  –O(CH$_2$)$_n$CO$_2$H   n = 1, 2
–OH  →  –O(C=O)NHCH$_2$CO$_2$H
–OH  →  –O(C=O)CH$_2$NH$_2$
–OH  →  –O(C=O)Im
–OH  →  –O(C=S)SCH$_2$(C=O)NH$_2$
–CO$_2$H  →  –(C=O)NH(CH$_2$)$_n$NH$_2$   n = 2, 6
–CO$_2$H  →  –(C=O)Z
–NH$_2$  →  –NH(C=O)(CH$_2$)$_n$CO$_2$H   n = 2, 3

**Covalent linkage, X* + Y***

–CO$_2$H + H$_2$N– + WSC + HOSu  →  –(C=O)NH–
–OH + Im(C=O)Im + H$_2$N–  →  –O(C=O)NH–

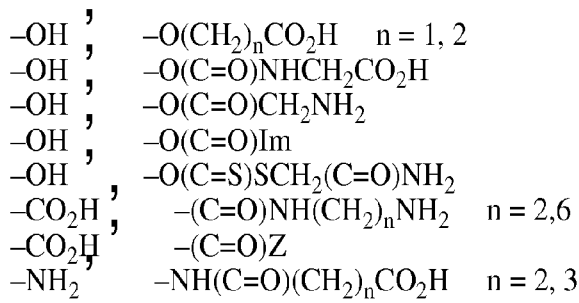

–OH + O=C=N–  →  –O(C=O)NH–
–O(C=S)SCH$_2$(C=O)NH$_2$ + H$_2$N–  →  –O(C=S)NH–
–OH + ClCH$_2$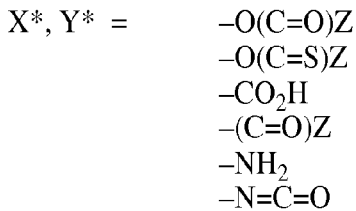 + HO–  →  –OCH$_2$CH(OH)CH$_2$O–
                            (+ H$_2$NH–)                    (NH–)
–OH  →  –OCH$_2$(C=O)H + H$_2$N– + NaCNBH$_3$  →  –OCH$_2$CH$_2$NH–

PCR/ PCR/ LDR

1.
PCR AMPLIFY
REGIONS CONTAINING
ALLELIC VARIATIONS
USING GENE-
SPECIFIC/UNIVERSAL
PRIMERS, dNTPS AND
Taq POLYMERASE.◆

GENE-SPECIFIC =
UNIVERSAL =

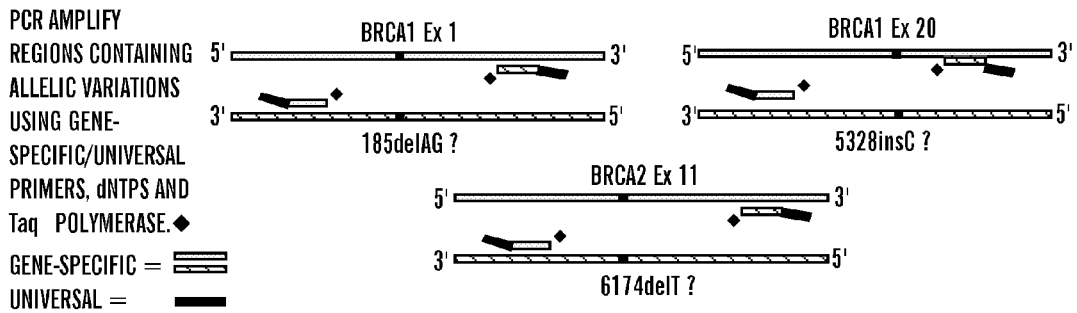

2.
PCR AMPLIFY ALL
PRIMARY PRODUCTS
USING UNIVERSAL
PRIMERS, dNTPS AND
Taq POLYMERASE.

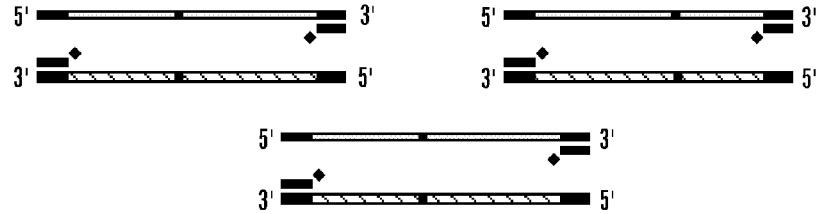

3.
PERFORM LDR USING
ALLELE-SPECIFIC LDR
PRIMERS AND
THERMOSTABLE LIGASE.●
ALLELE-SPECIFIC
OLIGONUCLEOTIDES
LIGATE TO COMMON
OLIGONUCLEOTIDES
ONLY WHEN THERE IS
PERFECT
COMPLEMENTARITY AT
THE JUNCTION.

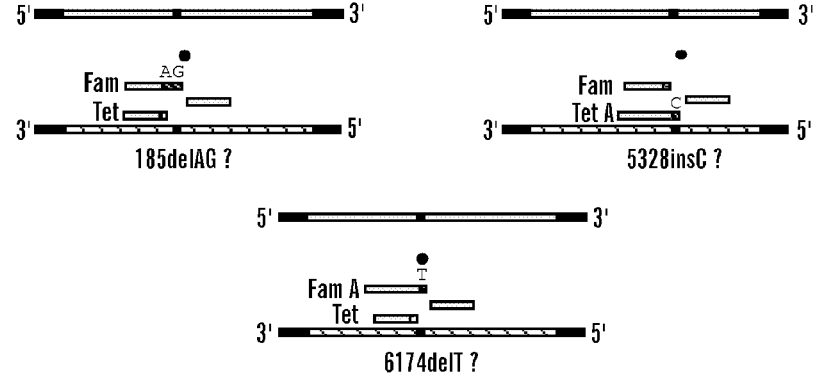

4.
SEPARATE FLUORESCENT
PRODUCTS ON A DNA
SEQUENCER AND
QUANTIFY EACH ALLELE.

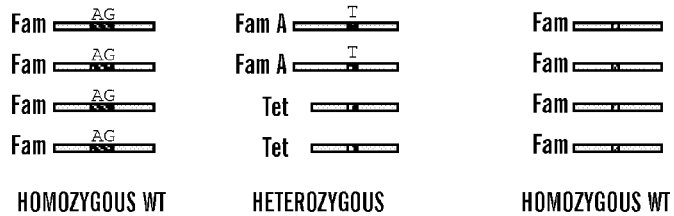

*FIG. 20*

PCR/PCR/ LDR/Array of BRCA1 Ex 20: 5382insC Mutant and Wild-type control

1. PCR amplify regions containing allelic variations using gene-specific/universal primers, dNTPs and polymerase.◆
   Gene-specific = 
   Universal =

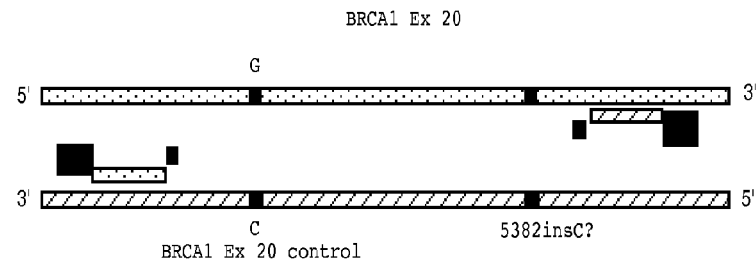

2. Perform LDR using allele-specific LDR primers and thermostable ligase.●
   Since mutant LDR products can be either Cy3 or Cy5 labeled, control product is labeled with both Cy3 and Cy5 so it is visible in both channels during array analysis.

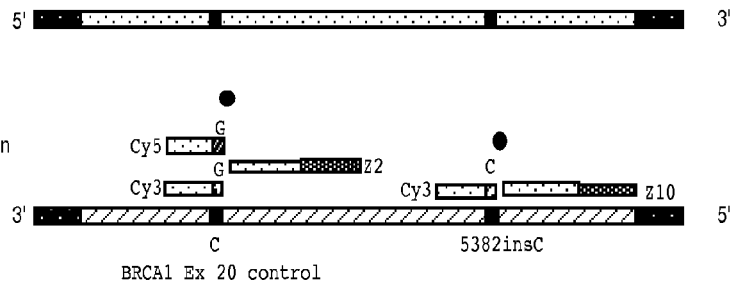

3. Capture fluorescent products on addressable array and quantify each allele.

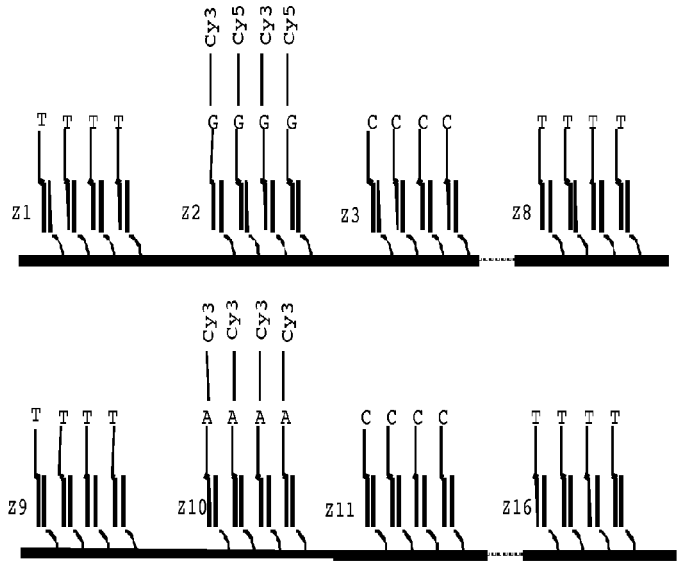

*FIG. 22*

|  BRCA1<br>Ex 2 Ctrl | BRCA1<br>Ex 20 Ctrl | BRCA2<br>Ex 11 Ctrl |
|---|---|---|
| ○ ○<br>○ ○<br>○ ○<br>○ ○ | ○ ○<br>○ ○<br>○ ○<br>○ ○ | ○ ○<br>○ ○<br>○ ○<br>○ ○ |
| Ex 2<br>delAG | Ex 20<br>insC | Ex 11<br>delT |
*FIG. 23A*
Wild-type
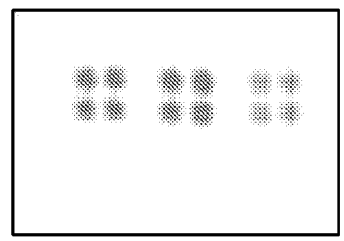
*FIG. 23B*
Individual samples
BRCA1 185delAG
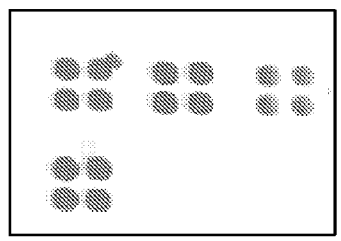
*FIG. 23C*
Pooled samples
BRCA1 185delAG
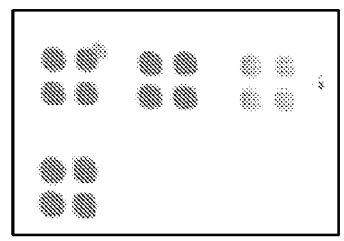
*FIG. 23D*
Individual samples
BRCA1 5382insC
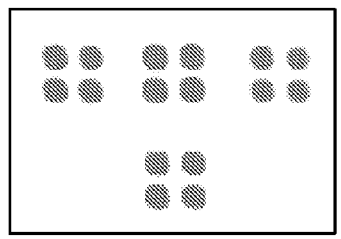
*FIG. 23E*
Pooled samples
BRCA1 5382insC
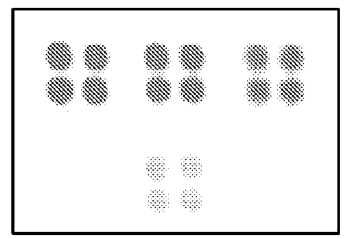
*FIG. 23F*
Individual samples
BRCA2 6174delT
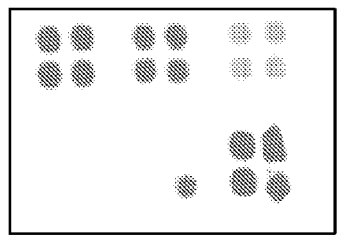
*FIG. 23G*
Pooled samples
BRCA2 6174delT
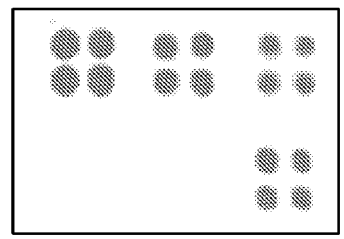
*FIG. 23H*

WT

ZIP 1
ZIP 2
ZIP 3
ZIP 4

Y220 A-G
ZIP 31

R175 G2-A
ZIP 21

R282 C-T
ZIP 50

R196 C-T
ZIP 26

R273 G-A
ZIP 47

R273 C-T
ZIP 46

Cy3
CHANNEL
BACKGROUND

FIG. 25A

| SEQ ID NO: | 4,633 ID# | HEX ID# | Tm | ZIPCODE (5'-3') | TETRAMER NUMBERS | | | | |
|---|---|---|---|---|---|---|---|---|---|
| 1 | 3 | 8 | 77.6 | TTGAAATCCAGCGCAAAATCTGCG | 1 | 4 | 31 | 21 | 4 | 29 |
| 2 | 5 | 15 | 77.2 | TTGAAAAGCCTACACGACGGCGAA | 1 | 6 | 26 | 30 | 35 | 16 |
| 3 | 7 | 22 | 76.5 | TTGATCTGCCATACGGGCTTACGG | 1 | 8 | 15 | 35 | 17 | 35 |
| 4 | 15 | 45 | 80.6 | TTGACTTGTCCCCAGCACGGCCAT | 1 | 11 | 28 | 31 | 35 | 15 |
| 5 | 17 | 56 | 80.4 | TTGACGTTGACCAGCCCGTTGCAA | 1 | 12 | 32 | 36 | 12 | 21 |
| 6 | 20 | 72 | 76.4 | TTGACGAAGCTTTCCCCCATGATG | 1 | 16 | 17 | 28 | 15 | 27 |
| 7 | 24 | 90 | 81.2 | TTGAGCAAGGACGACCGCAAACGG | 1 | 21 | 34 | 32 | 21 | 35 |
| 8 | 30 | 126 | 82.4 | TTGAGATGACGGACGGTGCGGCAA | 1 | 27 | 35 | 35 | 29 | 21 |
| 9 | 33 | 140 | 76.3 | TTGATCCCATCGAAAGGGACGATG | 1 | 28 | 24 | 6 | 34 | 27 |
| 10 | 36 | 150 | 80.1 | TTGATGCGTCTGGGACGTGCCTTG | 1 | 29 | 8 | 34 | 33 | 11 |
| 11 | 44 | 166 | 80.3 | TTGACACGTCGTCAGCTCCCGTGC | 1 | 30 | 10 | 31 | 28 | 33 |
| 12 | 48 | 180 | 80 | TTGACAGCCTGTTGCGGTGCGTCT | 1 | 31 | 14 | 29 | 33 | 19 |
| 13 | 52 | 202 | 76.5 | TTGAGTGCGGTACTTGCAGCGATG | 1 | 33 | 18 | 11 | 31 | 27 |
| 14 | 55 | 222 | 81.2 | TTGAACGGTCTGCACGTCCCAGCC | 1 | 35 | 8 | 30 | 28 | 36 |
| 15 | 67 | 269 | 82.2 | TGATTCTGGTGCGTGCCAGCCAGC | 2 | 8 | 33 | 33 | 31 | 31 |
| 16 | 69 | 274 | 76.8 | TGATTGTCGCTTTCTGACGGAGCC | 2 | 9 | 17 | 8 | 35 | 36 |
| 17 | 73 | 294 | 77.9 | TGATCGTTTGCGGGTATCCCTCGT | 2 | 12 | 29 | 18 | 28 | 10 |
| 18 | 75 | 310 | 77.9 | TGATCGAAAGGACAGCAGCCTCCC | 2 | 16 | 25 | 31 | 36 | 28 |
| 19 | 79 | 328 | 76.9 | TGATGCAAGCAACGAACACGCTGT | 2 | 21 | 21 | 16 | 30 | 14 |
| 20 | 92 | 372 | 79.5 | TGATTGCGAGTGGACCATCGCCAT | 2 | 29 | 22 | 32 | 24 | 15 |
| 21 | 94 | 379 | 80 | TGATCACGCTTGCCATGGACGGAC | 2 | 30 | 11 | 15 | 34 | 34 |
| 22 | 104 | 418 | 82 | TGATGTGCCTCAACGGGTGCAGCC | 2 | 33 | 13 | 35 | 33 | 36 |
| 23 | 111 | 431 | 75.6 | TGATGGACCGTTAGCCGATGTTGA | 2 | 34 | 12 | 36 | 27 | 1 |
| 24 | 118 | 444 | 79.5 | TGATACGGAGGAGGACTGCGTGCG | 2 | 35 | 25 | 34 | 29 | 29 |
| 25 | 129 | 555 | 79.9 | TTAGGATGAGCCAGCCTGCGAGCC | 3 | 27 | 36 | 36 | 29 | 36 |
| 26 | 151 | 690 | 77.7 | AATCTCGTCGTTTCCCCTCATGCG | 4 | 10 | 12 | 28 | 13 | 29 |
| 27 | 166 | 805 | 77.4 | AATCGCAACTGTCGTTCACGGTGC | 4 | 21 | 14 | 12 | 30 | 33 |
| 28 | 167 | 842 | 81.4 | AATCAGGACACGCAGCGACCTGCG | 4 | 25 | 30 | 31 | 32 | 29 |
| 29 | 183 | 926 | 76.7 | AATCGACCCTGTGTCTGCTTTGCG | 4 | 32 | 14 | 19 | 17 | 29 |
| 30 | 197 | 983 | 76.9 | AATCAGCCAAAGCGAAGTGCGATG | 4 | 36 | 6 | 16 | 33 | 27 |
| 31 | 216 | 1111 | 76.2 | ATACGACCTCGTGAGTTCCCGCAA | 5 | 32 | 10 | 20 | 28 | 21 |
| 32 | 226 | 1207 | 75.4 | AAAGCTTGACCTATCGAGCCGTGC | 6 | 11 | 23 | 24 | 36 | 33 |
| 33 | 268 | 1503 | 75.5 | AAAGAGCCGCTTGAGTCGAAATCG | 6 | 36 | 17 | 20 | 16 | 24 |
| 34 | 297 | 1649 | 75.7 | TCTGCTTGCTCACCTACCATTGCG | 8 | 11 | 13 | 26 | 15 | 29 |
| 35 | 332 | 1771 | 75 | TCTGATCGCCTAGGTAACGGGGAC | 8 | 24 | 26 | 18 | 35 | 34 |
| 36 | 358 | 1847 | 76.9 | TCTGCAGCGGTACTGTGGACCCAT | 8 | 31 | 18 | 14 | 34 | 15 |
| 37 | 375 | 1912 | 75.8 | TCTGAGCCACCTAATCTCCCACGG | 8 | 36 | 23 | 4 | 28 | 35 |
| 38 | 385 | 1941 | 77.4 | TGTCTCGTTCCCACCTCCATTCCC | 9 | 10 | 28 | 23 | 15 | 28 |
| 39 | 442 | 2093 | 81.4 | TGTCATCGCAGCGAGTCAGCCACG | 9 | 24 | 31 | 20 | 31 | 30 |
| 40 | 445 | 2103 | 77.7 | TGTCCCTAACCTGATGGTGCGCAA | 9 | 26 | 23 | 27 | 33 | 21 |
| 41 | 461 | 2143 | 77.3 | TGTCTGCGGTCTCCATATCGGTGC | 9 | 29 | 19 | 15 | 24 | 33 |
| 42 | 469 | 2154 | 76.2 | TGTCCACGCGTTACCTTGTCGATG | 9 | 30 | 12 | 23 | 9 | 27 |
| 43 | 487 | 2196 | 79.1 | TGTCGTGCTCTGACCTTGCGCTCA | 9 | 33 | 8 | 23 | 29 | 13 |
| 44 | 508 | 2231 | 81.7 | TGTCACGGAATCGTGCTGCGGCTT | 9 | 35 | 4 | 33 | 29 | 17 |
| 45 | 527 | 2307 | 77.4 | TCGTTCTGGCTTGGACGCTTCTCA | 10 | 8 | 17 | 34 | 17 | 13 |
| 46 | 602 | 2543 | 80 | TCGTTGCGTGTCGGACCTTGGATG | 10 | 29 | 9 | 34 | 11 | 27 |
| 47 | 686 | 2755 | 78.3 | CTTGCGTTGATGCGAATCGTCGAA | 11 | 12 | 27 | 16 | 10 | 16 |
| 48 | 973 | 3831 | 77.7 | CTGTCACGCTCAACCTTCCCCGTT | 14 | 30 | 13 | 23 | 28 | 12 |
| 49 | 987 | 3866 | 77.6 | CTGTGTGCCGTTTCGTGTGCAGTG | 14 | 33 | 12 | 10 | 33 | 22 |
| 50 | 1053 | 4127 | 77 | CCATGCAATCCCAGGATGTCGGTA | 15 | 21 | 28 | 25 | 9 | 18 |
| 51 | 1093 | 4232 | 78.7 | CCATCAGCTCTGGCAATGCGGAGT | 15 | 31 | 8 | 21 | 29 | 20 |

FIG. 25B

| SEQ ID NO: | 4,633 ID# | HEX ID# | Tm | ZIPCODE (5'-3') | TETRAMER NUMBERS | | | | |
|---|---|---|---|---|---|---|---|---|---|
| 52 | 1142 | 4394 | 75.4 | CGAATCTGGGTAAGGAAGCCATCG | 16 8 | 18 | 25 | 36 | 24 |
| 53 | 1145 | 20638 | 77.7 | CGAATGTCCTGTCCATCGAATGCG | 16 9 | 14 | 15 | 16 | 29 |
| 54 | 1159 | 4453 | 75.2 | CGAACGTTTACATGCGTCGTAGCC | 16 12 | 7 | 29 | 10 | 36 |
| 55 | 1193 | 4568 | 78.3 | CGAAAGTGAGCCGCAACTTGGGAC | 16 22 | 36 | 21 | 11 | 34 |
| 56 | 1246 | 4751 | 78.9 | CGAAGGACAGTGAGTGTGCGCACG | 16 34 | 22 | 22 | 29 | 30 |
| 57 | 1560 | 6171 | 75.4 | GCAAAGCCATACCTTGGCTTGCTT | 21 36 | 5 | 11 | 17 | 17 |
| 58 | 1641 | 6531 | 75.7 | ACCTCTTGCCTACGAACAGCCGAA | 23 11 | 26 | 16 | 31 | 16 |
| 59 | 1655 | 6599 | 78.8 | ACCTGCAAGTGCCCATGTGCCCTA | 23 21 | 33 | 15 | 33 | 26 |
| 60 | 1919 | 7289 | 80.1 | AGGATCTGGACCGGACTCCCCGAA | 25 8 | 32 | 34 | 28 | 16 |
| 61 | 1982 | 7538 | 78 | AGGAACGGCAGCTACACACGAGCC | 25 35 | 31 | 7 | 30 | 36 |
| 62 | 2081 | 8056 | 78.1 | GATGGACCACCTCAGCGCTTGACC | 27 32 | 23 | 31 | 17 | 32 |
| 63 | 2105 | 8145 | 77.8 | TCCCTTAGGACCCAGCGTCTGTGC | 28 3 | 32 | 31 | 19 | 33 |
| 64 | 2623 | 8944 | 75.5 | TGCGCCATAAAGGACCTTAGCCAT | 29 15 | 6 | 32 | 3 | 15 |
| 65 | 2755 | 9114 | 75.8 | TGCGAGGACCATGGTAGGTAAGCC | 29 25 | 15 | 18 | 18 | 36 |
| 66 | 12 | 42 | 81.5 | TTGATCGTGGACACGGCACGCTCA | 1 10 | 34 | 35 | 30 | 13 |
| 67 | 26 | 94 | 78.2 | TTGAAGTGCAGCCACGAAAGCGAA | 1 22 | 31 | 30 | 6 | 16 |
| 68 | 29 | 112 | 79.3 | TTGAATCGGAGTTGCGCGTTGGAC | 1 24 | 20 | 29 | 12 | 34 |
| 69 | 82 | 346 | 80.9 | TGATGATGGCTTCAGCTGCGCGAA | 2 27 | 17 | 31 | 29 | 16 |
| 70 | 86 | 351 | 79.2 | TGATTCCCTTGAACGGTCCCGGAC | 2 28 | 1 | 35 | 28 | 34 |
| 71 | 124 | 521 | 78.3 | TTAGGCAATTGATCCCGACCGTGC | 3 21 | 1 | 28 | 32 | 33 |
| 72 | 132 | 567 | 78.2 | TTAGTCCCACGGGATGCGTTGACC | 3 28 | 35 | 27 | 12 | 32 |
| 73 | 191 | 962 | 77.5 | AATCGGACATCGAGTGTCCCCAGC | 4 34 | 24 | 22 | 28 | 31 |
| 74 | 210 | 1078 | 75.8 | ATACTGCGCGTTCTGTGAGTTGCG | 5 29 | 12 | 14 | 20 | 29 |
| 75 | 325 | 1744 | 78.5 | TCTGGTCTGCAATCGTCACGCAGC | 8 19 | 21 | 10 | 30 | 31 |
| 76 | 436 | 2073 | 79.4 | TGTCAGTGCACGGCTTCTGTTGCG | 9 22 | 30 | 17 | 14 | 29 |
| 77 | 551 | 2365 | 77.2 | TCGTCTCAGCTTGACCGCTTCAGC | 10 13 | 17 | 32 | 17 | 31 |
| 78 | 629 | 2593 | 76.7 | TCGTCAGCCCTAATCGACCTGTGC | 10 31 | 26 | 24 | 23 | 33 |
| 79 | 644 | 2624 | 75.5 | TCGTGTGCGCTTAATCACGGAATC | 10 33 | 17 | 4 | 35 | 4 |
| 80 | 804 | 3213 | 76.4 | CGTTCGAAGTCTCTTGACGGACGG | 12 16 | 19 | 11 | 35 | 35 |
| 81 | 836 | 3345 | 75.7 | CGTTTCCCAATCATCGGCAAGTCT | 12 28 | 4 | 24 | 21 | 19 |
| 82 | 872 | 3431 | 77.5 | CGTTGTGCTGATGCAAATCGGCTT | 12 33 | 2 | 21 | 24 | 17 |
| 83 | 949 | 3748 | 79.9 | CTGTCTTGGTGCGCAAAGGATGCG | 14 11 | 33 | 21 | 25 | 29 |
| 84 | 1148 | 4415 | 77.1 | CGAATCGTTTGAGCAAGACCCACG | 16 10 | 1 | 21 | 32 | 30 |
| 85 | 1235 | 4695 | 76.7 | CGAACAGCTGCGAATCGTCTAGCC | 16 31 | 29 | 4 | 19 | 36 |
| 86 | 1406 | 5575 | 75.8 | GAGTTCGTGCTTACGGCTTGAGCC | 20 10 | 17 | 35 | 11 | 36 |
| 87 | 1603 | 6332 | 75.6 | AGTGTCCCGAGTACCTGGACACGG | 22 28 | 20 | 23 | 34 | 35 |
| 88 | 2216 | 8362 | 76.3 | TCCCGCTTTGATTCTGTCGTTCGT | 28 17 | 2 | 8 | 10 | 10 |
| 89 | 2286 | 8468 | 75 | TCCCACCTGTCTACCTAGCCGACC | 28 23 | 19 | 23 | 36 | 32 |
| 90 | 2364 | 8591 | 77.1 | TCCCCACGATACACCTTTGATGCG | 28 30 | 5 | 23 | 1 | 29 |
| 91 | 2556 | 30603 | 76.3 | TGCGCTTGATACTGTCGCTTCGAA | 29 11 | 5 | 9 | 17 | 16 |
| 92 | 2587 | 8909 | 75.8 | TGCGCTCAATACAGCCTCGTATCG | 29 13 | 5 | 36 | 10 | 24 |
| 93 | 2741 | 9095 | 79.8 | TGCGATCGCGAAGCAATGATCGTT | 29 24 | 16 | 21 | 2 | 12 |
| 94 | 2793 | 9168 | 77.9 | TGCGTCCCTCTGTGATCACGAGGA | 29 28 | 8 | 2 | 30 | 25 |
| 95 | 2821 | 9200 | 80.5 | TGCGCACGAGGAATCGCTTGAGTG | 29 30 | 25 | 24 | 11 | 22 |
| 96 | 3120 | 9759 | 76.9 | CACGGTGCTACAGTGCAAAGCACG | 30 33 | 7 | 33 | 6 | 30 |
| 97 | 6 | 18 | 79.1 | TTGAAAAGGGACGTGCGCTTCGAA | 1 6 | 34 | 33 | 17 | 16 |
| 98 | 8 | 25 | 79.5 | TTGATCTGCACGCGTTGTGCGGTA | 1 8 | 30 | 12 | 33 | 18 |
| 99 | 9 | 29 | 80.3 | TTGATGTCCCATTCCCCACGCGTT | 1 9 | 15 | 28 | 30 | 12 |
| 100 | 13 | 43 | 79.2 | TTGATCGTAGCCGGTATGCGACGG | 1 10 | 36 | 18 | 29 | 35 |
| 101 | 18 | 64 | 79.7 | TTGACCATGCTTCGAAACGGCGAA | 1 15 | 17 | 16 | 35 | 16 |
| 102 | 21 | 75 | 77.4 | TTGACGAAATCGGCAACCTATGCG | 1 16 | 24 | 21 | 26 | 29 |

FIG. 25C

| SEQ ID NO: | 4,633 HEX ID# | HEX Tm | ZIPCODE (5'-3') | T3TRAMER NUMBERS | | | | | |
|---|---|---|---|---|---|---|---|---|---|
| 103 | 32 | 12925 | 75.7 | TTGATCCCGGTATTAGAGCCCACG | 1 | 28 | 18 | 3 | 36 | 30 |
| 104 | 42 | 161 | 80.7 | TTGATGCGTGCGCTCAATCGAGGA | 1 | 29 | 29 | 13 | 24 | 25 |
| 105 | 43 | 165 | 80.1 | TTGATGCGAGCCGATGCCATCTTG | 1 | 29 | 36 | 27 | 15 | 11 |
| 106 | 49 | 186 | 79.1 | TTGACAGCACGGGACCCCTACACG | 1 | 31 | 35 | 32 | 26 | 30 |
| 107 | 53 | 208 | 80.3 | TTGAGTGCTCCCGCAACGTTGTGC | 1 | 33 | 28 | 21 | 12 | 33 |
| 108 | 58 | 230 | 76.8 | TTGAACGGGCAAACCTCTTGCTTG | 1 | 35 | 21 | 23 | 11 | 11 |
| 109 | 59 | 232 | 78.7 | TTGAACGGGATGGCAAGGACCTCA | 1 | 35 | 27 | 21 | 34 | 13 |
| 110 | 60 | 238 | 81.2 | TTGAAGCCTGTCCGTTTGCGACGG | 1 | 36 | 9 | 12 | 29 | 35 |
| 111 | 62 | 12961 | 75.5 | TTGAAGCCAGGATCCCAAAGCCTA | 1 | 36 | 25 | 28 | 6 | 26 |
| 112 | 68 | 270 | 78.4 | TGATTCTGACGGTCCCGCTTACGG | 2 | 8 | 35 | 28 | 17 | 35 |
| 113 | 70 | 275 | 82.6 | TGATTGTCCACGTGCGGGACACGG | 2 | 9 | 30 | 29 | 34 | 35 |
| 114 | 76 | 311 | 82.5 | TGATCGAAGTGCCACGCACGCGTT | 2 | 16 | 33 | 30 | 30 | 12 |
| 115 | 78 | 322 | 78.2 | TGATGGTAACGGCTCAAGCCGCTT | 2 | 18 | 35 | 13 | 36 | 17 |
| 116 | 81 | 335 | 80.5 | TGATGCAAAGCCGTGCAGCCTCTG | 2 | 21 | 36 | 33 | 36 | 8 |
| 117 | 84 | 349 | 80.6 | TGATGATGGTGCGCTTAGCCGCAA | 2 | 27 | 33 | 17 | 36 | 21 |
| 118 | 88 | 361 | 77.3 | TGATTCCCTCCCGGTATCGTACGG | 2 | 28 | 28 | 18 | 10 | 35 |
| 119 | 89 | 362 | 80.2 | TGATTCCCCACGGAGTGGACCAGC | 2 | 28 | 30 | 20 | 34 | 31 |
| 120 | 95 | 386 | 80.8 | TGATCACGATCGGGACGAACACG | 2 | 30 | 24 | 34 | 21 | 30 |
| 121 | 96 | 388 | 77.8 | TGATCACGTCCCTTGAGACCGCAA | 2 | 30 | 28 | 1 | 32 | 21 |
| 122 | 98 | 404 | 80.2 | TGATCAGCCACGGGACAGCCAGTG | 2 | 31 | 30 | 34 | 36 | 22 |
| 123 | 99 | 405 | 76.7 | TGATCAGCGGACTTAGTCCCGTGC | 2 | 31 | 34 | 3 | 28 | 33 |
| 124 | 100 | 409 | 76.4 | TGATGACCCGAATGATTGTCGCAA | 2 | 32 | 16 | 2 | 9 | 21 |
| 125 | 101 | 411 | 79.7 | TGATGACCATCGAGCCCACGAGGA | 2 | 32 | 24 | 36 | 30 | 25 |
| 126 | 105 | 420 | 77.3 | TGATGTGCCGAAGAGTCACGGGAC | 2 | 33 | 16 | 20 | 30 | 34 |
| 127 | 106 | 421 | 80.4 | TGATGTGCGTCTACGGAGCCTGCG | 2 | 33 | 19 | 35 | 36 | 29 |
| 128 | 107 | 422 | 79.7 | TGATGTGCGAGTACGGACGGCGTT | 2 | 33 | 20 | 35 | 35 | 12 |
| 129 | 109 | 426 | 76.6 | TGATGTGCTGCGAAAGAGGATCCC | 2 | 33 | 29 | 6 | 25 | 28 |
| 130 | 112 | 435 | 78.3 | TGATGGACGACCCGAAGGACCTTG | 2 | 34 | 32 | 16 | 34 | 11 |
| 131 | 114 | 437 | 80.1 | TGATGGACAGCCGCTTGACCGATG | 2 | 34 | 36 | 17 | 32 | 27 |
| 132 | 125 | 532 | 76.8 | TTAGGCAATGCGCTGTCCTAACGG | 3 | 21 | 29 | 14 | 26 | 35 |
| 133 | 126 | 539 | 75.3 | TTAGATCGCACGTCTGCTTGCCAT | 3 | 24 | 30 | 8 | 11 | 15 |
| 134 | 135 | 599 | 75.7 | TTAGCAGCGCAATACAGGACCACG | 3 | 31 | 21 | 7 | 34 | 30 |
| 135 | 140 | 627 | 76.2 | TTAGGGACCTGTGTGCCTTGCGTT | 3 | 34 | 14 | 33 | 11 | 12 |
| 136 | 145 | 636 | 77.2 | TTAGGGACGGACAATCGATGCACG | 3 | 34 | 34 | 4 | 27 | 30 |
| 137 | 150 | 683 | 76.5 | AATCTCTGCGTTCCTATGCGCAA | 4 | 8 | 12 | 26 | 29 | 16 |
| 138 | 153 | 714 | 76 | AATCCGTTTCCCATACGATGCGAA | 4 | 12 | 28 | 5 | 27 | 16 |
| 139 | 157 | 743 | 77.7 | AATCCGAATCTGTCCCTCCCGGAC | 4 | 16 | 8 | 28 | 28 | 34 |
| 140 | 159 | 748 | 76.5 | AATCCGAAGCAAACGGTGTCGATG | 4 | 16 | 21 | 35 | 9 | 27 |
| 141 | 161 | 756 | 78.2 | AATCCGAACACGGACCGGACAGTG | 4 | 16 | 30 | 32 | 34 | 22 |
| 142 | 162 | 762 | 76 | AATCGCTTTTAGGATGCAGCACGG | 4 | 17 | 3 | 27 | 31 | 35 |
| 143 | 163 | 768 | 75.4 | AATCGCTTCCATCGAAGACCGGTA | 4 | 17 | 15 | 16 | 32 | 18 |
| 144 | 165 | 793 | 79.6 | AATCGAGTCGAATGCGTCCCAGCC | 4 | 20 | 16 | 29 | 28 | 36 |
| 145 | 168 | 843 | 76.7 | AATCAGGAACGGCGTTCTTGGCTT | 4 | 25 | 35 | 12 | 11 | 17 |
| 146 | 171 | 877 | 76.6 | AATCTGCGTCGTTCTGTCCCGATG | 4 | 29 | 10 | 8 | 28 | 27 |
| 147 | 179 | 919 | 77.2 | AATCCAGCGATGGGACGAGTCGTT | 4 | 31 | 27 | 34 | 20 | 12 |
| 148 | 189 | 949 | 76.8 | AATCGTGCAGGACTCAGGACTGCG | 4 | 33 | 25 | 13 | 34 | 29 |
| 149 | 192 | 966 | 78.9 | AATCGGACTGCGCCATACCTGCAA | 4 | 34 | 29 | 15 | 23 | 21 |
| 150 | 201 | 993 | 78 | AATCAGCCATCGCTGTGCTTGCAA | 4 | 36 | 24 | 14 | 17 | 21 |
| 151 | 203 | 999 | 79.5 | AATCAGCCGTGCGGTAGACCGGAC | 4 | 36 | 33 | 18 | 32 | 34 |
| 152 | 205 | 1040 | 79 | ATACGCTTGGACGAGTTGCGGCAA | 5 | 17 | 34 | 20 | 29 | 21 |
| 153 | 206 | 1047 | 79.6 | ATACGCAAGACCATCGCACGGCAA | 5 | 21 | 32 | 24 | 30 | 21 |

FIG. 25D

| SEQ ID NO: | 4,633 ID# | H3X ID# | Tm | ZIPCODE (5'-3') | TETRAMER NUMBERS | | | | | |
|---|---|---|---|---|---|---|---|---|---|---|
| 154 | 214 | 1104 | 77.1 | ATACCAGCCTCAAGCCCGAAGTGC | 5 | 31 | 13 | 36 | 16 | 33 |
| 155 | 218 | 1122 | 80.3 | ATACGTGCTCGTGCTTTGCGTGCG | 5 | 33 | 10 | 17 | 29 | 29 |
| 156 | 228 | 1217 | 76.3 | AAAGCGTTTGTCCTTGGATGCGAA | 6 | 12 | 9 | 11 | 27 | 16 |
| 157 | 231 | 1229 | 77.1 | AAAGCTCATCGTGGACCGAAAGCC | 6 | 13 | 10 | 34 | 16 | 36 |
| 158 | 234 | 1271 | 75.1 | AAAGCGAACTGTAGTGCAGCACGG | 6 | 16 | 14 | 22 | 31 | 35 |
| 159 | 242 | 1333 | 76.6 | AAAGATCGCTTGCTGTACGGCGAA | 6 | 24 | 11 | 14 | 35 | 16 |
| 160 | 243 | 1337 | 76.5 | AAAGATCGGGTATGCGCACGTGTC | 6 | 24 | 18 | 29 | 30 | 9 |
| 161 | 248 | 1393 | 76 | AAAGTGCGATCGAGGACTCAACGG | 6 | 29 | 24 | 25 | 13 | 35 |
| 162 | 255 | 1441 | 75.6 | AAAGGACCGCAACTGTTCGTGCTT | 6 | 32 | 21 | 14 | 10 | 17 |
| 163 | 264 | 1474 | 76.7 | AAAGGGACCGAAAGTGCCATGGAC | 6 | 34 | 16 | 22 | 15 | 34 |
| 164 | 271 | 1519 | 80.5 | TACACCATTCCCTCCCCAGCGCAA | 7 | 15 | 28 | 28 | 31 | 21 |
| 165 | 272 | 1533 | 81.8 | TACATCCCCTTGCGAATGCGTGCG | 7 | 28 | 11 | 16 | 29 | 29 |
| 166 | 281 | 1587 | 76.8 | TACAACGGCTGTTCGTTGTCGCAA | 7 | 35 | 14 | 10 | 9 | 21 |
| 167 | 282 | 1590 | 76.1 | TACAACGGGCTTTGTCCACGGAGT | 7 | 35 | 17 | 9 | 30 | 20 |
| 168 | 286 | 1602 | 78.6 | TACAACGGACGGCCATCCATGCTT | 7 | 35 | 35 | 15 | 15 | 17 |
| 169 | 289 | 1620 | 78.5 | TCTGTTGAAGCCCGTTCGAAACGG | 8 | 1 | 36 | 12 | 16 | 35 |
| 170 | 290 | 1621 | 78.2 | TCTGTGATTGCGCTTGGGACGATG | 8 | 2 | 29 | 11 | 34 | 27 |
| 171 | 291 | 1624 | 78.6 | TCTGAATCTGCGCGAATGTCTGCG | 8 | 4 | 29 | 16 | 9 | 29 |
| 172 | 292 | 1625 | 76.4 | TCTGAATCCACGTTAGTGCGCACG | 8 | 4 | 30 | 3 | 29 | 30 |
| 173 | 298 | 1650 | 76.5 | TCTGCTTGCTGTGCTTTCCCCCTA | 8 | 11 | 14 | 17 | 28 | 26 |
| 174 | 299 | 1651 | 75.1 | TCTGCTTGGCTTAGTGGCTTCACG | 8 | 11 | 17 | 22 | 17 | 30 |
| 175 | 300 | 1653 | 80.1 | TCTGCTTGGATGCCATACGGTGCG | 8 | 11 | 27 | 15 | 35 | 29 |
| 176 | 301 | 1656 | 79.8 | TCTGCTTGGACCCTGTCACGGCAA | 8 | 11 | 32 | 14 | 30 | 21 |
| 177 | 304 | 1670 | 78.8 | TCTGCGTTATCGCACGGAGTGCAA | 8 | 12 | 24 | 30 | 20 | 21 |
| 178 | 306 | 1678 | 79.5 | TCTGCGTTAGCCGGACCTGTCACG | 8 | 12 | 36 | 34 | 14 | 30 |
| 179 | 313 | 1698 | 80.3 | TCTGCCATGACCGACCTCCCCTTG | 8 | 15 | 32 | 32 | 28 | 11 |
| 180 | 317 | 1722 | 80.4 | TCTGGCTTTGTCCAGCGCAATCCC | 8 | 17 | 9 | 31 | 21 | 28 |
| 181 | 321 | 1733 | 80 | TCTGGCTTGTGCGTCTGTGCCGTT | 8 | 17 | 33 | 19 | 33 | 12 |
| 182 | 322 | 1735 | 76.9 | TCTGGGTACGTTCGAATCCCCCAT | 8 | 18 | 12 | 16 | 28 | 15 |
| 183 | 324 | 1740 | 76.5 | TCTGGGTAGTGCATCGCGAAGCTT | 8 | 18 | 33 | 24 | 16 | 17 |
| 184 | 331 | 1765 | 79.3 | TCTGACCTACGGGTGCCGTTGTGC | 8 | 23 | 35 | 33 | 12 | 33 |
| 185 | 333 | 1772 | 79.4 | TCTGATCGTGCGGTCTACGGGTGC | 8 | 24 | 29 | 19 | 35 | 33 |
| 186 | 335 | 1776 | 80.3 | TCTGATCGGGACCAGCATCGGACC | 8 | 24 | 34 | 31 | 24 | 32 |
| 187 | 340 | 1800 | 79.3 | TCTGTCCCCTGTGACCAGCCGATG | 8 | 28 | 14 | 32 | 36 | 27 |
| 188 | 346 | 1811 | 79.1 | TCTGTGCGAAAGGGACCAGCAGGA | 8 | 29 | 6 | 34 | 31 | 25 |
| 189 | 353 | 1833 | 77.3 | TCTGCACGACCTTTGATCCCGATG | 8 | 30 | 23 | 1 | 28 | 27 |
| 190 | 363 | 1865 | 82.1 | TCTGGTGCAATCGACCCACGCAGC | 8 | 33 | 4 | 32 | 30 | 31 |
| 191 | 376 | 1917 | 77.7 | TCTGAGCCGACCTCGTGATGCTTG | 8 | 36 | 32 | 10 | 27 | 11 |
| 192 | 387 | 1945 | 79.7 | TGTCTCGTGTGCTCGTGACCGCAA | 9 | 10 | 33 | 10 | 32 | 21 |
| 193 | 392 | 1960 | 77.2 | TGTCCGTTTTGAGGACGACCATCG | 9 | 12 | 1 | 34 | 32 | 24 |
| 194 | 393 | 1961 | 78.6 | TGTCCGTTTGATTCCCCTTGGCAA | 9 | 12 | 2 | 28 | 11 | 21 |
| 195 | 395 | 1974 | 79.8 | TGTCCGTTGTGCCGTTCAGCCTGT | 9 | 12 | 33 | 12 | 31 | 14 |
| 196 | 399 | 1983 | 77.6 | TGTCCCATTTGAAAAGCAGCTGCG | 9 | 15 | 1 | 6 | 31 | 29 |
| 197 | 418 | 2028 | 75.5 | TGTCGCTTACGGATACAGCCGATG | 9 | 17 | 35 | 5 | 36 | 27 |
| 198 | 422 | 2035 | 79 | TGTCGGTAGGACATCGGGACCACG | 9 | 18 | 34 | 24 | 34 | 30 |
| 199 | 425 | 2049 | 81.3 | TGTCGAGTGCTTGTGCGTGCGACC | 9 | 20 | 17 | 33 | 33 | 32 |
| 200 | 430 | 2057 | 79.5 | TGTCGCAACTTGCTTGGTGCTCCC | 9 | 21 | 11 | 11 | 33 | 28 |
| 201 | 431 | 2058 | 77.8 | TGTCGCAACCATCACGGTCTGCTT | 9 | 21 | 15 | 30 | 19 | 17 |
| 202 | 432 | 2061 | 76.6 | TGTCGCAAGGTAAATCTGCGTCCC | 9 | 21 | 18 | 4 | 29 | 28 |
| 203 | 443 | 2094 | 78.4 | TGTCATCGGACCAATCATCGCGAA | 9 | 24 | 32 | 4 | 24 | 16 |
| 204 | 444 | 2097 | 79.5 | TGTCAGGACGAATCCCATCGGCAA | 9 | 25 | 16 | 28 | 24 | 21 |

FIG. 25E

| SEQ ID NO: | 4,633 ID# | HEX ID# | Tm | ZIPCODE (5'-3') | TETRAMER NUMBERS | | | | |
|---|---|---|---|---|---|---|---|---|---|
| 205 | 448 | 2109 | 76.6 | TGTCGATGCTTGTACATCCCGCAA | 9 | 27 | 11 | 7 | 28 21 |
| 206 | 449 | 2114 | 81.9 | TGTCGATGGATGGACCTGCGACGG | 9 | 27 | 27 | 32 | 29 35 |
| 207 | 450 | 2115 | 78.3 | TGTCGATGTCCCTCGTGCTTGTGC | 9 | 27 | 28 | 10 | 17 33 |
| 208 | 451 | 2116 | 79.2 | TGTCGATGTGCGCCTACAGCATCG | 9 | 27 | 29 | 26 | 31 24 |
| 209 | 452 | 2117 | 76.1 | TGTCGATGCACGACCTTTAGCGAA | 9 | 27 | 30 | 23 | 3 16 |
| 210 | 464 | 2147 | 75.8 | TGTCTGCGCCTATGATCTTGCAGC | 9 | 29 | 26 | 2 | 11 31 |
| 211 | 472 | 2158 | 75.9 | TGTCCACGGCAAAAAGCCTAGACC | 9 | 30 | 21 | 6 | 26 32 |
| 212 | 473 | 2163 | 78.8 | TGTCCACGCAGCAATCAGCCTTGA | 9 | 30 | 31 | 4 | 36 1 |
| 213 | 476 | 2174 | 79.6 | TGTCCAGCATCGCCATGATGGCTT | 9 | 31 | 24 | 15 | 27 17 |
| 214 | 477 | 2176 | 79.2 | TGTCCAGCCAGCCTTGCGAACTGT | 9 | 31 | 31 | 11 | 16 14 |
| 215 | 480 | 2181 | 80.9 | TGTCGACCAAAGAGCCAGCCCGAA | 9 | 32 | 6 | 36 | 36 16 |
| 216 | 481 | 2185 | 76.4 | TGTCGACCGGTAAGCCGACCATAC | 9 | 32 | 18 | 36 | 32 5 |
| 217 | 482 | 2186 | 81.6 | TGTCGACCAGTGCAGCGATGGCAA | 9 | 32 | 22 | 31 | 27 21 |
| 218 | 484 | 2189 | 80.6 | TGTCGACCTCCCGACCTCGTCAGC | 9 | 32 | 28 | 32 | 10 31 |
| 219 | 485 | 2191 | 79 | TGTCGACCGTGCTGTCAATCCACG | 9 | 32 | 33 | 9 | 4 30 |
| 220 | 488 | 2197 | 78.1 | TGTCGTGCTGTCTCGTAGCCCGAA | 9 | 33 | 9 | 10 | 36 16 |
| 221 | 495 | 2208 | 77.1 | TGTCGTGCCCTATCTGTGCGGTCT | 9 | 33 | 26 | 8 | 29 19 |
| 222 | 497 | 2212 | 79.2 | TGTCGTGCCAGCCCATAGGAATCG | 9 | 33 | 31 | 15 | 25 24 |
| 223 | 498 | 2215 | 80.1 | TGTCGGACAAAGTGCGACGGATCG | 9 | 34 | 6 | 29 | 35 24 |
| 224 | 499 | 2217 | 77.4 | TGTCGGACCTCAATACGTGCCAGC | 9 | 34 | 13 | 5 | 33 31 |
| 225 | 501 | 2219 | 78.4 | TGTCGGACCCATGACCCTCACCAT | 9 | 34 | 15 | 32 | 13 15 |
| 226 | 510 | 2234 | 75.9 | TGTCACGGCGTTAAAGTGTCCGAA | 9 | 35 | 12 | 6 | 9 16 |
| 227 | 515 | 2247 | 77.9 | TGTCAGCCCTTGCAGCAAAGCTTG | 9 | 36 | 11 | 31 | 6 11 |
| 228 | 525 | 2301 | 76.3 | TCGTAAAGACGGTGTCGCAACACG | 10 | 6 | 35 | 9 | 21 30 |
| 229 | 537 | 2336 | 77.2 | TCGTCTTGCTTGCGTTATCGCCAT | 10 | 11 | 11 | 12 | 24 15 |
| 230 | 545 | 2353 | 76.4 | TCGTCGTTGCAACTCAGGTATGCG | 10 | 12 | 21 | 13 | 18 29 |
| 231 | 547 | 2355 | 76.3 | TCGTCGTTAGGAACCTACGGCGAA | 10 | 12 | 25 | 23 | 35 16 |
| 232 | 548 | 2359 | 77.1 | TCGTCGTTCACGTACATCGTTGCG | 10 | 12 | 30 | 7 | 10 29 |
| 233 | 554 | 2371 | 81 | TCGTCTGTTCGTGACCACGGTGCG | 10 | 14 | 10 | 32 | 35 29 |
| 234 | 557 | 2382 | 79.3 | TCGTCCATATCGCAGCCCATCAGC | 10 | 15 | 24 | 31 | 15 31 |
| 235 | 560 | 2390 | 78.4 | TCGTCCATGGACCGAAGCAAGACC | 10 | 15 | 34 | 16 | 21 32 |
| 236 | 581 | 2470 | 82 | TCGTACCTGTGCCAGCCACGGTGC | 10 | 23 | 33 | 31 | 30 33 |
| 237 | 582 | 2475 | 75.7 | TCGTATCGCTGTACCTCGTTTGCG | 10 | 24 | 14 | 23 | 12 29 |
| 238 | 588 | 2502 | 75.9 | TCGTCCTAACGGATCGTTGAAGCC | 10 | 26 | 35 | 24 | 1 36 |
| 239 | 589 | 2509 | 81.8 | TCGTGATGATCGGTGCACGGTCCC | 10 | 27 | 24 | 33 | 35 28 |
| 240 | 591 | 2523 | 77.1 | TCGTTCCCCTCAAGTGGACCACCT | 10 | 28 | 13 | 22 | 32 23 |
| 241 | 596 | 2531 | 79.5 | TCGTTCCCAGTGGATGGGACCCAT | 10 | 28 | 22 | 27 | 34 15 |
| 242 | 597 | 2534 | 77.9 | TCGTTCCCGATGAGGAACGGTGAT | 10 | 28 | 27 | 25 | 35 2 |
| 243 | 599 | 2536 | 80.5 | TCGTTCCCCAGCCGTTGTCTCAGC | 10 | 28 | 31 | 12 | 19 31 |
| 244 | 606 | 2549 | 80.7 | TCGTTGCGGCAATGATCCATCACG | 10 | 29 | 21 | 2 | 15 30 |
| 245 | 609 | 2555 | 81.8 | TCGTTGCGTCCCCTCAGTGCCTCA | 10 | 29 | 28 | 13 | 33 13 |
| 246 | 610 | 2557 | 80.5 | TCGTTGCGCACGTGATCGTTCCAT | 10 | 29 | 30 | 2 | 12 15 |
| 247 | 613 | 2560 | 80.9 | TCGTTGCGGTGCTGATGGACATCG | 10 | 29 | 33 | 2 | 34 24 |
| 248 | 638 | 2611 | 81.5 | TCGTGACCGACCGATGTCCCAGGA | 10 | 32 | 32 | 27 | 28 25 |
| 249 | 649 | 2631 | 80.4 | TCGTGTGCGATGGAGTGTGCCCAT | 10 | 33 | 27 | 20 | 33 15 |
| 250 | 650 | 2633 | 78.1 | TCGTGTGCGACCTGATATCGGTGC | 10 | 33 | 32 | 2 | 24 33 |
| 251 | 657 | 2649 | 77.5 | TCGTGGACAGGAGATGGCTTGTGC | 10 | 34 | 25 | 27 | 17 33 |
| 252 | 663 | 2659 | 81 | TCGTACGGTGATCACGCAGCACGG | 10 | 35 | 2 | 30 | 31 35 |
| 253 | 667 | 2674 | 76.2 | TCGTACGGGACAAAGCGTTGTCT | 10 | 35 | 34 | 6 | 12 19 |
| 254 | 678 | 2722 | 81.6 | CTTGTGTCGTGCACGGCTGTTGCG | 11 | 9 | 33 | 35 | 14 29 |
| 255 | 679 | 2725 | 75.8 | CTTGTCGTCCATAGCCTCCCGGTA | 11 | 10 | 15 | 36 | 28 18 |

FIG. 25F

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 256 | 692 | 2779 | 79 | CTTGCCATGTCTTGCGGCTTACGG | 11 | 15 | 19 | 29 | 17 | 35 |
| 257 | 695 | 2808 | 76.3 | CTTGGCTTTCGTCCATCTTGGTGC | 11 | 17 | 10 | 15 | 11 | 33 |
| 258 | 711 | 2878 | 79.6 | CTTGAGGAGCTTTGCGCCATGCAA | 11 | 25 | 17 | 29 | 15 | 21 |
| 259 | 721 | 2907 | 77.2 | CTTGTCCCAAAGGCTTGCAATCCC | 11 | 28 | 6 | 17 | 21 | 28 |
| 260 | 726 | 2928 | 75.6 | CTTGTGCGCTTGAAAGCGAATCTG | 11 | 29 | 11 | 6 | 16 | 8 |
| 261 | 727 | 2931 | 77.5 | CTTGTGCGGAGTTGTCAGCCGGTA | 11 | 29 | 20 | 9 | 36 | 18 |
| 262 | 731 | 2945 | 80.3 | CTTGCACGTGTCTCCCAGCCCCAT | 11 | 30 | 9 | 28 | 36 | 15 |
| 263 | 733 | 2948 | 75.6 | CTTGCACGCTGTCGAATTAGCAGC | 11 | 30 | 14 | 16 | 3 | 31 |
| 264 | 749 | 3014 | 78.3 | CTTGGGACACCTCTGTGTGCGCAA | 11 | 34 | 23 | 14 | 33 | 21 |
| 265 | 753 | 3027 | 79.5 | CTTGACGGAGTGACGGCGAACGAA | 11 | 35 | 22 | 35 | 16 | 16 |
| 266 | 759 | 3038 | 78.5 | CTTGAGCCAATCTGCGGCAACCAT | 11 | 36 | 4 | 29 | 21 | 15 |
| 267 | 760 | 3045 | 75 | CTTGAGCCGTCTCCTAATCGAGCC | 11 | 36 | 19 | 26 | 24 | 36 |
| 268 | 762 | 3048 | 78.2 | CTTGAGCCAGTGAAAGTGCGCACG | 11 | 36 | 22 | 6 | 29 | 30 |
| 269 | 773 | 3108 | 80.7 | CGTTTCTGTCGTTCCCGTGCGGAC | 12 | 8 | 10 | 28 | 33 | 34 |
| 270 | 784 | 3142 | 78.7 | CGTTTCGTGTCTGGACCACGTCCC | 12 | 10 | 19 | 34 | 30 | 28 |
| 271 | 809 | 3232 | 79.6 | CGTTGCTTTGCGGATGTCGTACGG | 12 | 17 | 29 | 27 | 10 | 35 |
| 272 | 810 | 3238 | 75.4 | CGTTGGTAAAAGTCGTTCCCAGCC | 12 | 18 | 6 | 10 | 28 | 36 |
| 273 | 811 | 3245 | 80.4 | CGTTGGTACACGCCATCAGCCACG | 12 | 18 | 30 | 15 | 31 | 30 |
| 274 | 832 | 3321 | 78.9 | CGTTCCTACACGCTTGTGCGGACC | 12 | 26 | 30 | 11 | 29 | 32 |
| 275 | 837 | 3349 | 76.4 | CGTTTCCCCGTTGGTAAATCCCAT | 12 | 28 | 12 | 18 | 4 | 15 |
| 276 | 838 | 3351 | 77.5 | CGTTTCCCCCATTGTCGAGTCGTT | 12 | 28 | 15 | 9 | 20 | 12 |
| 277 | 843 | 3364 | 79.4 | CGTTTCCCGTGCTGCGAGTGTGAT | 12 | 28 | 33 | 29 | 22 | 2 |
| 278 | 844 | 3366 | 76.1 | CGTTTGCGTTAGAGTGCACGATCG | 12 | 29 | 3 | 22 | 30 | 24 |
| 279 | 857 | 3398 | 77.8 | CGTTCACGCACGTGTCAAAGTCCC | 12 | 30 | 30 | 9 | 6 | 28 |
| 280 | 867 | 3420 | 76.8 | CGTTGACCCTTGGCAATACAACGG | 12 | 32 | 11 | 21 | 7 | 35 |
| 281 | 878 | 3451 | 80.1 | CGTTGTGCACGGCTTGTGTCCGTT | 12 | 33 | 35 | 11 | 9 | 12 |
| 282 | 898 | 3516 | 76.1 | CTCAAAAGTGCGTCGTTGATTGCG | 13 | 6 | 29 | 10 | 2 | 29 |
| 283 | 899 | 3518 | 75.4 | CTCAAAAGGACCTCTGCAGCCGTT | 13 | 6 | 32 | 8 | 31 | 12 |
| 284 | 901 | 3530 | 78.5 | CTCATCGTGCAACGTTGACCACGG | 13 | 10 | 21 | 12 | 32 | 35 |
| 285 | 923 | 3620 | 77.7 | CTCATCCCGGACAGGAGTGCACCT | 13 | 28 | 34 | 25 | 33 | 23 |
| 286 | 961 | 3798 | 80 | CTGTGATGCAGCCGAAATCGCAGC | 14 | 27 | 31 | 16 | 24 | 31 |
| 287 | 965 | 3809 | 77.1 | CTGTTCCCTGCGTTGAGGTATGCG | 14 | 28 | 29 | 1 | 18 | 29 |
| 288 | 972 | 3829 | 79.1 | CTGTTGCGACGGGCAACCATTGAT | 14 | 29 | 35 | 21 | 15 | 2 |
| 289 | 982 | 3856 | 77.2 | CTGTGACCCCATCTTGATCGGCAA | 14 | 32 | 15 | 11 | 24 | 21 |
| 290 | 989 | 3872 | 80.5 | CTGTGTGCATCGGACCACCTTGCG | 14 | 33 | 24 | 32 | 23 | 29 |
| 291 | 991 | 3873 | 77.2 | CTGTGTGCCACGATACGGACCGTT | 14 | 33 | 30 | 5 | 34 | 12 |
| 292 | 993 | 3878 | 77 | CTGTGGACCCTACCATTCCCAGCC | 14 | 34 | 26 | 15 | 28 | 36 |
| 293 | 994 | 3882 | 81 | CTGTGGACCACGGTGCGATGCTCA | 14 | 34 | 30 | 33 | 27 | 13 |
| 294 | 1016 | 3987 | 76.6 | CCATTGTCCAGCTTGAACGGCTGT | 15 | 9 | 31 | 1 | 35 | 14 |
| 295 | 1018 | 3993 | 75.1 | CCATTCGTTCGTCGTTGCTTATCG | 15 | 10 | 10 | 12 | 17 | 24 |
| 296 | 1020 | 3999 | 80.8 | CCATTCGTGAGTCACGTGCGCAGC | 15 | 10 | 20 | 30 | 29 | 31 |
| 297 | 1074 | 4202 | 79.8 | CCATTGCGATACGGACATCGGCAA | 15 | 29 | 5 | 34 | 24 | 21 |
| 298 | 1077 | 4209 | 80 | CCATTGCGCGAAGATGCTCACAGC | 15 | 29 | 16 | 27 | 13 | 31 |
| 299 | 1085 | 4220 | 79.4 | CCATCACGAATCGCTTGTGCGCTT | 15 | 30 | 4 | 17 | 33 | 17 |
| 300 | 1099 | 4243 | 77.3 | CCATCAGCAGCCAAAGGTCTTCCC | 15 | 31 | 36 | 6 | 19 | 28 |
| 301 | 1126 | 14325 | 76.8 | CGAATTGATCCCAATCCGAATCCC | 16 | 1 | 28 | 4 | 16 | 28 |
| 302 | 1129 | 4341 | 77 | CGAATTAGCACGGGTACAGCACGG | 16 | 3 | 30 | 18 | 31 | 35 |
| 303 | 1147 | 30238 | 79.8 | CGAATGTCTCCCGTGCCCATAGCC | 16 | 9 | 28 | 33 | 15 | 36 |
| 304 | 1151 | 4428 | 75.9 | CGAATCGTACCTTGCGGTCTCGTT | 16 | 10 | 23 | 29 | 19 | 12 |
| 305 | 1152 | 14366 | 76.5 | CGAATCGTCCTAAGGATCCCAGCC | 16 | 10 | 26 | 25 | 28 | 36 |
| 306 | 1162 | 4467 | 80.7 | CGAACTCACGTTCACGCGTTTGCG | 16 | 13 | 12 | 30 | 12 | 29 |

FIG. 25G

| SEQ ID NO: | 4,633 ID# | HEX ID# | Tm | ZIPCODE (5'-3') | TETRAMER NUMBERS | | | | |
|---|---|---|---|---|---|---|---|---|---|
| 307 | 1167 | 4480 | 77.4 | CGAACCATTGATCTTGCACGCGTT | 16 | 15 | 2 | 11 | 30 | 12 |
| 308 | 1172 | 4490 | 78.2 | CGAACCATCAGCGACCGTCTAGCC | 16 | 15 | 31 | 32 | 19 | 36 |
| 309 | 1179 | 4518 | 78.4 | CGAAGCTTCTGTTCCCGTTTCCC | 16 | 17 | 14 | 28 | 12 | 28 |
| 310 | 1200 | 4598 | 76.4 | CGAAATCGACCTTCTGGATGCAGC | 16 | 24 | 23 | 8 | 27 | 31 |
| 311 | 1201 | 4604 | 79 | CGAAATCGACGGGAGTTGTCTGCG | 16 | 24 | 35 | 20 | 9 | 29 |
| 312 | 1221 | 4659 | 76.6 | CGAATGCGGCTTCGTTAAAGCTTG | 16 | 29 | 17 | 12 | 6 | 11 |
| 313 | 1222 | 4660 | 76.6 | CGAATGCGGGTAATACTGCGTCGT | 16 | 29 | 18 | 5 | 29 | 10 |
| 314 | 1249 | 4759 | 76.7 | CGAAGGACGTGCACCTCCTACGAA | 16 | 34 | 33 | 23 | 26 | 16 |
| 315 | 1251 | 4761 | 77.2 | CGAAACGGTTAGCTGTCAGCACGG | 16 | 35 | 3 | 14 | 31 | 35 |
| 316 | 1259 | 4782 | 79.8 | CGAAACGGAGCCGTCTCGTTGCTT | 16 | 35 | 36 | 19 | 12 | 17 |
| 317 | 1263 | 4793 | 79.1 | CGAAAGCCGCAAAGTGAATCGTGC | 16 | 36 | 21 | 22 | 4 | 33 |
| 318 | 1284 | 4872 | 76.1 | GCTTTCGTCGAAGTCTCACGCCAT | 17 | 10 | 16 | 19 | 30 | 15 |
| 319 | 1290 | 4896 | 76.5 | GCTTCTTGACGGAGCCTTGACACG | 17 | 11 | 35 | 36 | 1 | 30 |
| 320 | 1375 | 5432 | 77.1 | GTCTCTTGCGTTTGCGCCTAGCAA | 19 | 11 | 12 | 29 | 26 | 21 |
| 321 | 1398 | 5534 | 78.6 | GTCTGTGCGGACCCTAACGGCTCA | 19 | 33 | 34 | 26 | 35 | 13 |
| 322 | 1424 | 5680 | 79 | GAGTGACCCAGCTGTCGGACCACG | 20 | 32 | 31 | 9 | 34 | 30 |
| 323 | 1427 | 5684 | 79.5 | GAGTGTGCCTTGTGCGCGAACGTT | 20 | 33 | 11 | 29 | 16 | 12 |
| 324 | 1439 | 5787 | 80.7 | GCAATACATCCCGGACACGGGCAA | 21 | 7 | 28 | 34 | 35 | 21 |
| 325 | 1454 | 5821 | 78.8 | GCAATCGTGATGGTCTTGCGTCCC | 21 | 10 | 27 | 19 | 29 | 28 |
| 326 | 1462 | 5855 | 78 | GCAACGTTGGACCTTGCTGTTCCC | 21 | 12 | 34 | 11 | 14 | 28 |
| 327 | 1463 | 5859 | 75.3 | GCAACTCAACCTCCATTCGTTCCC | 21 | 13 | 23 | 15 | 10 | 28 |
| 328 | 1465 | 5862 | 80.8 | GCAACTCATGCGCACGTCTGGTGC | 21 | 13 | 29 | 30 | 8 | 33 |
| 329 | 1479 | 5941 | 77.6 | GCAAGCAATTAGCACGCCATCGAA | 21 | 21 | 3 | 30 | 15 | 16 |
| 330 | 1485 | 5962 | 76.9 | GCAAAGTGTCGTTTGATGCGGGAC | 21 | 22 | 10 | 1 | 29 | 34 |
| 331 | 1489 | 5980 | 77.9 | GCAAACCTCTCATGCGTGATTGCG | 21 | 23 | 13 | 29 | 2 | 29 |
| 332 | 1496 | 14968 | 78.2 | GCAAATCGATCGCGAACGAAGGAC | 21 | 24 | 24 | 16 | 16 | 34 |
| 333 | 1499 | 6008 | 75.1 | GCAAATCGAGCCAATCGGTAACCT | 21 | 24 | 36 | 4 | 18 | 23 |
| 334 | 1550 | 6148 | 77.1 | GCAAGGACGTCTTGTCCGTTCACG | 21 | 34 | 19 | 9 | 12 | 30 |
| 335 | 1561 | 6173 | 78.4 | GCAAAGCCCGTTCAGCACCTTCTG | 21 | 36 | 12 | 31 | 23 | 8 |
| 336 | 1580 | 6250 | 76.9 | AGTGCGAACTTGTCTGGGACTGCG | 22 | 16 | 11 | 8 | 34 | 29 |
| 337 | 1632 | 6471 | 75.2 | ACCTTTAGCGTTTGTCTGCGTCCC | 23 | 3 | 12 | 9 | 29 | 28 |
| 338 | 1647 | 6557 | 75.4 | ACCTCGAACCATTACATGCGGCTT | 23 | 16 | 15 | 7 | 29 | 17 |
| 339 | 1650 | 6572 | 76.2 | ACCTGCTTCGAAGTGCCTGTCAGC | 23 | 17 | 16 | 33 | 14 | 31 |
| 340 | 1675 | 6706 | 78.3 | ACCTGTGCTTGACACGATCGCACG | 23 | 33 | 1 | 30 | 24 | 30 |
| 341 | 1700 | 6802 | 76.1 | ATCGAAAGCTCAGTGCGCAAGCTT | 24 | 6 | 13 | 33 | 21 | 17 |
| 342 | 1710 | 6845 | 77.1 | ATCGCTTGTGTCTGCGAGCCTCTG | 24 | 11 | 9 | 29 | 36 | 8 |
| 343 | 1712 | 6850 | 75.7 | ATCGCTTGCGAAAAAGCTGTCCAT | 24 | 11 | 16 | 6 | 14 | 15 |
| 344 | 1724 | 6870 | 75.1 | ATCGCGTTGAGTAGGAGGACGGAC | 24 | 12 | 20 | 25 | 34 | 34 |
| 345 | 1730 | 6882 | 81.7 | ATCGCTCATCTGGTGCGGACGCAA | 24 | 13 | 8 | 33 | 34 | 21 |
| 346 | 1737 | 6903 | 80.1 | ATCGCTGTGATGCGTTACGGCACG | 24 | 14 | 27 | 12 | 35 | 30 |
| 347 | 1743 | 6911 | 77.2 | ATCGCCATAATCCAGCCAGCACCT | 24 | 15 | 4 | 31 | 31 | 23 |
| 348 | 1766 | 6956 | 75.7 | ATCGGCTTCAGCAAAGTCTGCCAT | 24 | 17 | 31 | 6 | 8 | 15 |
| 349 | 1781 | 6994 | 79.4 | ATCGGAGTGGACCACGCTTGGGAC | 24 | 20 | 34 | 30 | 11 | 34 |
| 350 | 1794 | 7018 | 76.4 | ATCGAGTGCTCAAGGAATCGGCAA | 24 | 22 | 13 | 25 | 24 | 21 |
| 351 | 1813 | 7068 | 76.9 | ATCGCCTAGATGTGCGAGGATCCC | 24 | 26 | 27 | 29 | 25 | 28 |
| 352 | 1831 | 7104 | 80.2 | ATCGTCCCAGCCCTGTGATGGTGC | 24 | 28 | 36 | 14 | 27 | 33 |
| 353 | 1877 | 7191 | 76.6 | ATCGGGACTACAATCGCAGCGATG | 24 | 34 | 7 | 24 | 31 | 27 |
| 354 | 1889 | 7213 | 79.4 | ATCGACGGTGTCCGAACCATGCAA | 24 | 35 | 9 | 16 | 15 | 21 |
| 355 | 1904 | 7235 | 76.7 | ATCGAGCCGAGTTTGACGAACACG | 24 | 36 | 20 | 1 | 16 | 30 |
| 356 | 1923 | 7302 | 78.5 | AGGATCGTGACCAGGACAGCACGG | 25 | 10 | 32 | 25 | 31 | 35 |
| 357 | 1940 | 7357 | 78.7 | AGGAGCTTGATGTCCCGCAATCCC | 25 | 17 | 27 | 28 | 21 | 28 |

FIG. 25H

| SEQ ID NO: | 4,633 ID# | HEX ID# | Tm | ZIPCODE (5'-3') | TETRAMER NUMBERS | | | | |
|---|---|---|---|---|---|---|---|---|---|
| 358 | 1944 | 7388 | 76.7 | AGGAAGTGGGTAGCAATCCCCACG | 25 | 22 | 18 | 21 | 28 30 |
| 359 | 1975 | 7510 | 79.3 | AGGAGTGCGTGCCTTGGACCACCT | 25 | 33 | 33 | 11 | 32 23 |
| 360 | 2007 | 7750 | 78.7 | CCTACAGCAGGAGACCGACCGCAA | 26 | 31 | 25 | 32 | 32 21 |
| 361 | 2029 | 7882 | 77.9 | GATGCCATGCAACAGCAGGACAGC | 27 | 15 | 21 | 31 | 25 31 |
| 362 | 2083 | 8075 | 79.2 | GATGGGACCTTGCACGTCGTCGAA | 27 | 34 | 11 | 30 | 10 16 |
| 363 | 2098 | 8128 | 78.2 | TCCCTGATTCCCCGAACGTTGATG | 28 | 2 | 28 | 16 | 12 27 |
| 364 | 2128 | 15756 | 76.4 | TCCCTACATGCGTTAGGACCCACG | 28 | 7 | 29 | 3 | 32 30 |
| 365 | 2134 | 8207 | 79.3 | TCCCTCTGGATGCACGAATCGTGC | 28 | 8 | 27 | 30 | 4 33 |
| 366 | 2158 | 8259 | 79.9 | TCCCCTTGTGCGATCGCTGTCTCA | 28 | 11 | 29 | 24 | 14 13 |
| 367 | 2174 | 8284 | 78.8 | TCCCCGTTACGGAGTGGTCTGCAA | 28 | 12 | 35 | 22 | 19 21 |
| 368 | 2177 | 8289 | 79.4 | TCCCCTCATACAACGGCCATGCAA | 28 | 13 | 7 | 35 | 15 21 |
| 369 | 2179 | 8294 | 76.8 | TCCCCTCACTGTCCTATCCCAGCC | 28 | 13 | 14 | 26 | 28 36 |
| 370 | 2183 | 8299 | 75.3 | TCCCCTCACCTAATACACGGCGTT | 28 | 13 | 26 | 5 | 35 12 |
| 371 | 2197 | 8327 | 78.3 | TCCCCATATACGCAACAGCAGCC | 28 | 15 | 5 | 21 | 31 36 |
| 372 | 2207 | 8344 | 76.9 | TCCCCGAATGATGCTTCGTTTTGA | 28 | 16 | 2 | 17 | 12 1 |
| 373 | 2237 | 8396 | 78.7 | TCCCGGTAGACCCCATGACCACCT | 28 | 18 | 32 | 15 | 32 23 |
| 374 | 2243 | 8403 | 78.1 | TCCCGTCTCTGTGATGAGCCCGTT | 28 | 19 | 14 | 27 | 36 12 |
| 375 | 2254 | 40508 | 82.8 | TCCCGAGTTGTCGACCCCATTGCG | 28 | 20 | 9 | 32 | 15 29 |
| 376 | 2271 | 8440 | 79.1 | TCCCGCAAAGGAGAGTGATGCGAA | 28 | 21 | 25 | 20 | 27 16 |
| 377 | 2293 | 8479 | 76.5 | TCCCATCGTGTCTGATAGCCAGCC | 28 | 24 | 9 | 2 | 36 36 |
| 378 | 2304 | 8502 | 77.7 | TCCCAGGACTGTTTGACACGGCAA | 28 | 25 | 14 | 1 | 30 21 |
| 379 | 2365 | 8592 | 76.3 | TCCCCACGTACAGGACAATCAGCC | 28 | 30 | 7 | 34 | 4 36 |
| 380 | 2369 | 8597 | 80 | TCCCCACGGCTTCTTGACCTCGAA | 28 | 30 | 17 | 11 | 23 16 |
| 381 | 2403 | 8640 | 80.9 | TCCCGACCGCTTGGTACCATGTGC | 28 | 32 | 17 | 18 | 15 33 |
| 382 | 2421 | 8665 | 77.3 | TCCCGGACTGATCGTTGATGCTTG | 28 | 34 | 2 | 12 | 27 11 |
| 383 | 2422 | 8666 | 76.9 | TCCCGGACTTAGCGAACTTGTCCC | 28 | 34 | 3 | 16 | 11 28 |
| 384 | 2440 | 8695 | 79.7 | TCCCACGGCGAATGTCCCTACGTT | 28 | 35 | 16 | 9 | 26 12 |
| 385 | 2444 | 8703 | 81.8 | TCCCACGGTCCCGAGTGGTAACGG | 28 | 35 | 28 | 20 | 18 35 |
| 386 | 2452 | 8710 | 77.1 | TCCCAGCCTACATGTCACGGGATG | 28 | 36 | 7 | 9 | 35 27 |
| 387 | 2461 | 8720 | 80.4 | TCCCAGCCGATGGATGATCGGGTA | 28 | 36 | 27 | 27 | 24 18 |
| 388 | 2468 | 8728 | 79.2 | TGCGTTGACTTGAGTGACGGCACG | 29 | 1 | 11 | 22 | 35 30 |
| 389 | 2471 | 15876 | 76.1 | TGCGTTGAACCTACGGGGACTGAT | 29 | 1 | 23 | 35 | 34 2 |
| 390 | 2477 | 40574 | 78.8 | TGCGTGATCGTTCTCACAGCCGAA | 29 | 2 | 12 | 13 | 31 16 |
| 391 | 2479 | 8749 | 79.4 | TGCGTGATGTCTCACGCGAACAGC | 29 | 2 | 19 | 30 | 16 31 |
| 392 | 2482 | 8752 | 77 | TGCGTGATGATGTGTCCGAAGTGC | 29 | 2 | 27 | 9 | 16 33 |
| 393 | 2497 | 8775 | 77.2 | TGCGAATCCTGTTGTCCAGCGTCT | 29 | 4 | 14 | 9 | 31 19 |
| 394 | 2503 | 8788 | 75.3 | TGCGATACGTCTGAGTAGCCCGAA | 29 | 5 | 19 | 20 | 36 16 |
| 395 | 2507 | 8796 | 76.1 | TGCGAAAGTGATAGCCAGTGGCAA | 29 | 6 | 2 | 36 | 22 21 |
| 396 | 2515 | 8808 | 77.9 | TGCGAAAGGTGCAGGAGAGTTCCC | 29 | 6 | 33 | 25 | 20 28 |
| 397 | 2517 | 15901 | 77.1 | TGCGTACATCGTACGGCTCACACG | 29 | 7 | 10 | 35 | 13 30 |
| 398 | 2520 | 8817 | 78.5 | TGCGTACAGGACTGCGAAAGTGCG | 29 | 7 | 34 | 29 | 6 29 |
| 399 | 2546 | 8864 | 75.1 | TGCGTCGTGGTACCTATGTCGCTT | 29 | 10 | 18 | 26 | 9 17 |
| 400 | 2578 | 8901 | 76.5 | TGCGCGTTCCTAAAAGCCATCTGT | 29 | 12 | 26 | 6 | 15 14 |
| 401 | 2592 | 15912 | 78.2 | TGCGCTCACTCAGACCAAAGGCAA | 29 | 13 | 13 | 32 | 6 21 |
| 402 | 2594 | 15913 | 78.7 | TGCGCTCACGAACCATCGTTTTGA | 29 | 13 | 16 | 15 | 12 1 |
| 403 | 2595 | 30609 | 77.9 | TGCGCTCAGAGTTTAGCACGACGG | 29 | 13 | 20 | 3 | 30 35 |
| 404 | 2599 | 8923 | 79.3 | TGCGCTCAAGCCAGGAGCTTGGTA | 29 | 13 | 36 | 25 | 17 18 |
| 405 | 2600 | 8924 | 76.6 | TGCGCTGTTTGAGTGCTCGTATCG | 29 | 14 | 1 | 33 | 10 24 |
| 406 | 2608 | 21521 | 76.7 | TGCGCTGTCGTTAGGATCTGTCCC | 29 | 14 | 12 | 25 | 8 28 |
| 407 | 2614 | 30613 | 77.9 | TGCGCTGTGAGTCTGTCGAAAGCC | 29 | 14 | 20 | 14 | 16 36 |
| 408 | 2624 | 40623 | 77.7 | TGCGCCATCTGTAGCCTGATCAGC | 29 | 15 | 14 | 36 | 2 31 |

FIG. 25I

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 409 | 2641 | 8968 | 79.5 | TGCGCGAAGACCACCTCTGTACGG | 29 | 16 | 32 | 23 | 14 | 35 |
| 410 | 2642 | 8970 | 80.4 | TGCGCGAAGGACGCAATTAGTCCC | 29 | 16 | 34 | 21 | 3 | 28 |
| 411 | 2643 | 8973 | 77.3 | TGCGGCTTAATCCTCAGCAACGAA | 29 | 17 | 4 | 13 | 21 | 16 |
| 412 | 2655 | 8991 | 79.4 | TGCGGGTATCTGCTGTGACCCAGC | 29 | 18 | 8 | 14 | 32 | 31 |
| 413 | 2663 | 9004 | 77.7 | TGCGGGTAGATGCCTAGACCGACC | 29 | 18 | 27 | 26 | 32 | 32 |
| 414 | 2687 | 21565 | 80.5 | TGCGGAGTGAGTGCTTCAGCACGG | 29 | 20 | 20 | 17 | 31 | 35 |
| 415 | 2690 | 9040 | 80.1 | TGCGGAGTTGCGAGTGCGAACTGT | 29 | 20 | 29 | 22 | 16 | 14 |
| 416 | 2691 | 30634 | 78.6 | TGCGGAGTCACGTCCCTACAAGCC | 29 | 20 | 30 | 28 | 7 | 36 |
| 417 | 2708 | 9054 | 82.1 | TGCGAGTGAATCGGACGGACGTGC | 29 | 22 | 4 | 34 | 34 | 33 |
| 418 | 2721 | 9070 | 76.7 | TGCGACCTTCTGTACAGTGCTGCG | 29 | 23 | 8 | 7 | 33 | 29 |
| 419 | 2748 | 9104 | 81.3 | TGCGATCGGTGCGAGTTTGAAGCC | 29 | 24 | 33 | 20 | 1 | 36 |
| 420 | 2762 | 40657 | 78.4 | TGCGCCTATTAGAGCCGTGCCTGT | 29 | 26 | 3 | 36 | 33 | 14 |
| 421 | 2763 | 9128 | 77.3 | TGCGCCTAAATCCTGTCTTGCGAA | 29 | 26 | 4 | 14 | 11 | 16 |
| 422 | 2770 | 9139 | 77.3 | TGCGCCTAAGTGCGAAACCTTTGA | 29 | 26 | 22 | 16 | 23 | 1 |
| 423 | 2784 | 9156 | 76.9 | TGCGGATGAGGATTGATCGTTCGT | 29 | 27 | 25 | 1 | 10 | 10 |
| 424 | 2791 | 30649 | 78.8 | TGCGTCCCATACTGATGTGCCACG | 29 | 28 | 5 | 2 | 33 | 30 |
| 425 | 2802 | 9177 | 78 | TGCGTCCCAGGAGTGCTTAGAGCC | 29 | 28 | 25 | 33 | 3 | 36 |
| 426 | 2843 | 9222 | 77.7 | TGCGGACCTTAGCTCACCATTCCC | 29 | 32 | 3 | 13 | 15 | 28 |
| 427 | 2861 | 9247 | 78.9 | TGCGGTGCAGTGGGTATCTGGCTT | 29 | 33 | 22 | 18 | 8 | 17 |
| 428 | 2876 | 9264 | 78.6 | TGCGGGACGGTAACGGTGATCCTA | 29 | 34 | 18 | 35 | 2 | 26 |
| 429 | 2886 | 9275 | 79.1 | TGCGACGGAAAGGGTATGTCACGG | 29 | 35 | 6 | 18 | 9 | 35 |
| 430 | 2904 | 9292 | 77.7 | TGCGAGCCCTGTTTAGGATGTCCC | 29 | 36 | 14 | 3 | 27 | 28 |
| 431 | 3018 | 9551 | 79.4 | CACGGAGTGATGAGCCCTTGCGAA | 30 | 20 | 27 | 36 | 11 | 16 |
| 432 | 3021 | 9556 | 75.2 | CACGGCAAATACTCTGGAGTTGCG | 30 | 21 | 5 | 8 | 20 | 29 |
| 433 | 3045 | 9608 | 77.8 | CACGATCGGCAAATCGTCGTCTTG | 30 | 24 | 21 | 24 | 10 | 11 |
| 434 | 3053 | 9626 | 80 | CACGAGGAAGTGGCAACACGCAGC | 30 | 25 | 22 | 21 | 30 | 31 |
| 435 | 3057 | 9633 | 79 | CACGAGGAGACCCTCACGAATGCG | 30 | 25 | 32 | 13 | 16 | 29 |
| 436 | 3103 | 9728 | 79.9 | CACGCAGCGCTTGCTTTCTGAGGA | 30 | 31 | 17 | 17 | 8 | 25 |
| 437 | 3153 | 9818 | 76.1 | CACGAGCCGGTACGTTGGTAGGAC | 30 | 36 | 18 | 12 | 18 | 34 |
| 438 | 3171 | 9864 | 77.6 | CAGCATACGTGCTCCCAGGAGCAA | 31 | 5 | 33 | 28 | 25 | 21 |
| 439 | 3256 | 10059 | 78.4 | CAGCGAGTCCATGGACAGTGCGAA | 31 | 20 | 15 | 34 | 22 | 16 |
| 440 | 3258 | 10060 | 76.6 | CAGCGAGTGGTAATCGTCCCCTCA | 31 | 20 | 18 | 24 | 28 | 13 |
| 441 | 3273 | 10091 | 80.3 | CAGCAGTGATCGCTTGAGCCTGCG | 31 | 22 | 24 | 11 | 36 | 29 |
| 442 | 3342 | 10220 | 76.4 | CAGCCAGCAAAGCCTAAGGAGCAA | 31 | 31 | 6 | 26 | 25 | 21 |
| 443 | 3343 | 10221 | 77 | CAGCCAGCTACAAGCCAGGACGAA | 31 | 31 | 7 | 36 | 25 | 16 |
| 444 | 3473 | 10530 | 76.7 | GACCGCAAACCTGTCTATCGCGAA | 32 | 21 | 23 | 19 | 24 | 16 |
| 445 | 3492 | 16297 | 76.5 | GACCGATGCGAATACAGACCCGAA | 32 | 27 | 16 | 7 | 32 | 16 |
| 446 | 3493 | 10589 | 78.5 | GACCGATGGAGTGATGGACCACGG | 32 | 27 | 20 | 27 | 32 | 35 |
| 447 | 3501 | 30792 | 79.6 | GACCTCCCGCAAGTCTGGACCGAA | 32 | 28 | 21 | 19 | 34 | 16 |
| 448 | 3653 | 10942 | 75.6 | GTGCGCTTCCTAACGGGATGAAAG | 33 | 17 | 26 | 35 | 27 | 6 |
| 449 | 3678 | 30832 | 77 | GTGCGCAACGTTGCTTTTAGCGTT | 33 | 21 | 12 | 17 | 3 | 12 |
| 450 | 3711 | 11060 | 78.1 | GTGCAGGACCTAAGCCATCGACGG | 33 | 25 | 26 | 36 | 24 | 35 |
| 451 | 3822 | 11330 | 76.4 | GGACCTTGAGGATGTCGATGGCAA | 34 | 11 | 25 | 9 | 27 | 21 |
| 452 | 3920 | 11597 | 77.6 | GGACCAGCCGTTTGAGATGCCAT | 34 | 31 | 12 | 1 | 27 | 15 |
| 453 | 3967 | 11693 | 79.2 | ACGGTTGATTGAATCGCGTTTGCG | 35 | 1 | 1 | 24 | 12 | 29 |
| 454 | 4057 | 41152 | 78.3 | ACGGCTCAGGACATACCCATTGCG | 35 | 13 | 34 | 5 | 15 | 29 |
| 455 | 4062 | 11897 | 75.6 | ACGGCTGTGGTACTCATCGTTCCC | 35 | 14 | 18 | 13 | 10 | 28 |
| 456 | 4145 | 12041 | 77.8 | ACGGAGTGGCTTGTCTGACCAGCC | 35 | 22 | 17 | 19 | 32 | 36 |
| 457 | 4162 | 30941 | 78 | ACGGATCGTCTGTCTGGACCCGAA | 35 | 24 | 8 | 8 | 32 | 16 |
| 458 | 4174 | 12091 | 75.6 | ACGGAGGATGATACCTCACGTGC | 35 | 25 | 2 | 23 | 30 | 33 |
| 459 | 4317 | 16775 | 75.8 | AGCCTTAGCCATTCTGCGAACGAA | 36 | 3 | 15 | 8 | 16 | 16 |

FIG. 25J

| SEQ ID NO: | 4,633 ID# | HEX ID# | Tm | ZIPCODE (5'-3') | TETRAMER NUMBERS | | | | |
|---|---|---|---|---|---|---|---|---|---|
| 460 | 4348 | 12389 | 75.5 | AGCCTGTCGCAAATACCGTTCGTT | 36 | 9 | 21 | 5 | 12 12 |
| 461 | 4352 | 12396 | 75 | AGCCTCGTTTAGTCGTTGCGGTCT | 36 | 10 | 3 | 10 | 29 19 |
| 462 | 4446 | 12578 | 76.8 | AGCCGTCTGGACTGATTCTGCACG | 36 | 19 | 34 | 2 | 8 30 |
| 463 | 4448 | 12580 | 76.2 | AGCCGAGTTTAGCCTACACGTGCG | 36 | 20 | 3 | 26 | 30 29 |
| 464 | 4545 | 12741 | 75.7 | AGCCTGCGTACACTGTCCATTCCC | 36 | 29 | 7 | 14 | 15 28 |
| 465 | 4586 | 12811 | 77.8 | AGCCGACCAGCCTTAGGGACGAGT | 36 | 32 | 36 | 3 | 34 20 |
| 466 | 1 | 20001 | 77.6 | TTGATTGAAGCCATCGGCTTTCCC | 1 | 1 | 36 | 24 | 17 28 |
| 467 | 2 | 12884 | 79.9 | TTGAAATCCACGTCCCCGAAACGG | 1 | 4 | 30 | 28 | 16 35 |
| 468 | 4 | 30001 | 77.3 | TTGAAAAGCGTTCTCATGCGCGTT | 1 | 6 | 12 | 13 | 29 12 |
| 469 | 10 | 39 | 82 | TTGATCGTCAGCCACGACGGACGG | 1 | 10 | 31 | 30 | 35 35 |
| 470 | 11 | 12889 | 81.8 | TTGATCGTGTGCACGGTGCGATCG | 1 | 10 | 33 | 35 | 29 24 |
| 471 | 14 | 40001 | 79.9 | TTGACTTGCGAAGTGCGTGCCGTT | 1 | 11 | 16 | 33 | 33 12 |
| 472 | 16 | 30002 | 78.8 | TTGACGTTTCCCCACGAGTGCGTT | 1 | 12 | 28 | 30 | 22 12 |
| 473 | 19 | 68 | 83 | TTGACCATGTGCACGGCACGCCAT | 1 | 15 | 33 | 35 | 30 15 |
| 474 | 22 | 40002 | 80.3 | TTGACGAAACGGCTCACAGCCACG | 1 | 16 | 35 | 13 | 31 30 |
| 475 | 23 | 40003 | 78.6 | TTGAGCTTTCCCGGTATCCCGGAC | 1 | 17 | 28 | 18 | 28 34 |
| 476 | 25 | 30003 | 77.1 | TTGAAGTGCGAAATCGGTGCACCT | 1 | 22 | 16 | 24 | 33 23 |
| 477 | 27 | 100 | 79.1 | TTGAACCTCAGCCACGAGCCAGGA | 1 | 23 | 31 | 30 | 36 25 |
| 478 | 28 | 12908 | 79.6 | TTGAACCTAGCCTGCGTCCCGACC | 1 | 23 | 36 | 29 | 28 32 |
| 479 | 31 | 12921 | 78.4 | TTGATCCCAAAGGCAAAGCCATCG | 1 | 28 | 6 | 21 | 36 24 |
| 480 | 34 | 40004 | 78.9 | TTGATCCCTCCCCCTACACGCGTT | 1 | 28 | 28 | 26 | 30 12 |
| 481 | 35 | 40005 | 81.4 | TTGATGCGTTGACAGCGGACGCAA | 1 | 29 | 1 | 31 | 34 21 |
| 482 | 37 | 12931 | 78.4 | TTGATGCGCGAACCTAGATGCACG | 1 | 29 | 16 | 26 | 27 30 |
| 483 | 38 | 30005 | 76.4 | TTGATGCGGGTATTAGCACGGACC | 1 | 29 | 18 | 3 | 30 32 |
| 484 | 39 | 12933 | 81.2 | TTGATGCGAGTGACGGGTGCTCCC | 1 | 29 | 22 | 35 | 33 28 |
| 485 | 40 | 30006 | 77.6 | TTGATGCGCCTATCTGACGGCTTG | 1 | 29 | 26 | 8 | 35 11 |
| 486 | 41 | 12934 | 79.1 | TTGATGCGGATGCAGCTACATGCG | 1 | 29 | 27 | 31 | 7 29 |
| 487 | 45 | 12936 | 81.1 | TTGACACGCTTGCACGATCGGTGC | 1 | 30 | 11 | 30 | 24 33 |
| 488 | 46 | 12939 | 80.8 | TTGACACGGTGCCCATCTGTTGCG | 1 | 30 | 33 | 15 | 14 29 |
| 489 | 47 | 30007 | 77.4 | TTGACACGACGGAAAGGCAAATCG | 1 | 30 | 35 | 6 | 21 24 |
| 490 | 50 | 40008 | 79.5 | TTGACAGCAGCCAGTGGTGCTCCC | 1 | 31 | 36 | 22 | 33 28 |
| 491 | 51 | 12944 | 79.2 | TTGAGACCTGCGCAGCCGAAGGTA | 1 | 32 | 29 | 31 | 16 18 |
| 492 | 54 | 40009 | 79.4 | TTGAGGACACGGTCCCTGTCTGCG | 1 | 34 | 35 | 28 | 9 29 |
| 493 | 56 | 12951 | 77.5 | TTGAACGGCTTGCTTGCCATATCG | 1 | 35 | 11 | 11 | 15 24 |
| 494 | 57 | 30014 | 79.3 | TTGAACGGGAGTACGGCACGCTTG | 1 | 35 | 20 | 35 | 30 11 |
| 495 | 61 | 40010 | 77.2 | TTGAAGCCCTTGAGGAACGGGGTA | 1 | 36 | 11 | 25 | 35 18 |
| 496 | 63 | 12968 | 79 | TGATTTGAAGCCCTCAAGCCGCAA | 2 | 1 | 36 | 13 | 36 21 |
| 497 | 64 | 12969 | 79 | TGATTGATTGCGGCAACTTGCACG | 2 | 2 | 29 | 21 | 11 30 |
| 498 | 65 | 264 | 79.9 | TGATTCTGCCATGGACACGGGTGC | 2 | 8 | 15 | 34 | 35 33 |
| 499 | 66 | 12973 | 78.4 | TGATTCTGCAGCAGGACCATTGCG | 2 | 8 | 31 | 25 | 15 29 |
| 500 | 71 | 282 | 81.2 | TGATTCGTCAGCCAGCGTGCGATG | 2 | 10 | 31 | 31 | 33 27 |
| 501 | 72 | 286 | 80.2 | TGATCTTGCCATTCCCGGACCAGC | 2 | 11 | 15 | 28 | 34 31 |
| 502 | 74 | 308 | 76.1 | TGATCGAAGCTTAGCCCCTATGCG | 2 | 16 | 17 | 36 | 26 29 |
| 503 | 77 | 12989 | 77.1 | TGATGGTATGCGTCGTTCGTTCCC | 2 | 18 | 29 | 10 | 10 28 |
| 504 | 80 | 20049 | 77.2 | TGATGCAAGATGGATGTCCCAGCC | 2 | 21 | 27 | 27 | 28 36 |
| 505 | 83 | 12997 | 78.6 | TGATGATGGCAACAGCTCCCCCAT | 2 | 27 | 21 | 31 | 28 15 |
| 506 | 85 | 350 | 82.6 | TGATGATGACGGGACCCACGTGCG | 2 | 27 | 35 | 32 | 30 29 |
| 507 | 87 | 40012 | 78 | TGATTCCCGAGTAGCCCACGTCGT | 2 | 28 | 20 | 36 | 30 10 |
| 508 | 90 | 13002 | 78 | TGATTCCCGTGCAAAGACGGACCT | 2 | 28 | 33 | 6 | 35 23 |
| 509 | 91 | 30016 | 78.4 | TGATTGCGGAGTCTTGACGGGAC | 2 | 29 | 20 | 11 | 35 34 |
| 510 | 93 | 30017 | 78.9 | TGATTGCGGATGAATCATCGTGCG | 2 | 29 | 27 | 4 | 24 29 |

FIG. 25K

| SEQ ID NO: | 4,633 ID# | HEX ID# | Tm | ZIPCODE (5'-3') | T3TRAMER NUMBERS | | | | | |
|---|---|---|---|---|---|---|---|---|---|---|
| 511 | 97 | 13012 | 80 | TGATCAGCATCGTCCCGCAAATCG | 2 | 31 | 24 | 28 | 21 | 24 |
| 512 | 102 | 413 | 83.1 | TGATGACCGATGCACGACGGGCAA | 2 | 32 | 27 | 30 | 35 | 21 |
| 513 | 103 | 13014 | 78.6 | TGATGACCGTGCAGCCGGTACTCA | 2 | 32 | 33 | 36 | 18 | 13 |
| 514 | 108 | 425 | 77.3 | TGATGTGCTCCCTACATCCCTGCG | 2 | 33 | 28 | 7 | 28 | 29 |
| 515 | 110 | 13017 | 80.4 | TGATGTGCGGACGATGAGCCGGTA | 2 | 33 | 34 | 27 | 36 | 18 |
| 516 | 113 | 40013 | 80.6 | TGATGGACGGACATCGGACCGCTT | 2 | 34 | 34 | 24 | 32 | 17 |
| 517 | 115 | 438 | 80.1 | TGATACGGTCGTCAGCCGTTTGCG | 2 | 35 | 10 | 31 | 12 | 29 |
| 518 | 116 | 439 | 79.8 | TGATACGGCTTGCACGACGGAGGA | 2 | 35 | 11 | 30 | 35 | 25 |
| 519 | 117 | 20065 | 78.3 | TGATACGGCGTTTTAGCACGTGCG | 2 | 35 | 12 | 3 | 30 | 29 |
| 520 | 119 | 30021 | 76.2 | TGATACGGCCTAGATGACGGCGTT | 2 | 35 | 26 | 27 | 35 | 12 |
| 521 | 120 | 40015 | 76.3 | TTAGCTTGGCAACTCACAGCGCAA | 3 | 11 | 21 | 13 | 31 | 21 |
| 522 | 121 | 30023 | 77.7 | TTAGCGTTAGCCTCTGCAGCGCAA | 3 | 12 | 36 | 8 | 31 | 21 |
| 523 | 122 | 40016 | 75.3 | TTAGCCATAGCCTTGAAGCCGGAC | 3 | 15 | 36 | 1 | 36 | 34 |
| 524 | 123 | 13046 | 75.1 | TTAGCGAAACCTAGCCAGCCCCTA | 3 | 16 | 23 | 36 | 36 | 26 |
| 525 | 127 | 544 | 77.3 | TTAGAGGATGCGCTCATCCCCGTT | 3 | 25 | 29 | 13 | 28 | 12 |
| 526 | 128 | 30025 | 78.1 | TTAGGATGCGAACACGGATGTGCG | 3 | 27 | 16 | 30 | 27 | 29 |
| 527 | 130 | 40017 | 76.3 | TTAGTCCCCGTTCGAAGATGCGAA | 3 | 28 | 12 | 16 | 27 | 16 |
| 528 | 131 | 13070 | 78.6 | TTAGTCCCATCGACGGTGCGGGTA | 3 | 28 | 24 | 35 | 29 | 18 |
| 529 | 133 | 30026 | 80.6 | TTAGTCCCAGCCCGAAAGCCCAGC | 3 | 28 | 36 | 16 | 36 | 31 |
| 530 | 134 | 40018 | 81.1 | TTAGTGCGCTTGTGCGGTGCATCG | 3 | 29 | 11 | 29 | 33 | 24 |
| 531 | 136 | 30028 | 76.2 | TTAGCAGCCCTATCTGCAGCGACC | 3 | 31 | 26 | 8 | 31 | 32 |
| 532 | 137 | 603 | 75.3 | TTAGCAGCACGGTACACACGGCTT | 3 | 31 | 35 | 7 | 30 | 17 |
| 533 | 138 | 13093 | 79.3 | TTAGGACCGATGGCTTCACGTGCG | 3 | 32 | 27 | 17 | 30 | 29 |
| 534 | 139 | 30030 | 78.8 | TTAGGTGCGACCGTGCCGTTTGAT | 3 | 33 | 32 | 33 | 12 | 2 |
| 535 | 141 | 13103 | 77.3 | TTAGGGACATCGCCTAAGCCCGAA | 3 | 34 | 24 | 26 | 36 | 16 |
| 536 | 142 | 13104 | 76.8 | TTAGGGACCCTATCCCCGAATCCC | 3 | 34 | 26 | 28 | 16 | 28 |
| 537 | 143 | 30031 | 77.1 | TTAGGGACTCCCTCTGACGGCAGC | 3 | 34 | 28 | 8 | 35 | 31 |
| 538 | 144 | 13105 | 75.8 | TTAGGGACCACGTCGTATCGAGCC | 3 | 34 | 30 | 10 | 24 | 36 |
| 539 | 146 | 13110 | 77.7 | TTAGACGGATCGATCGAGCCGGAC | 3 | 35 | 24 | 24 | 36 | 34 |
| 540 | 147 | 646 | 80.7 | TTAGACGGAGGAACGGCACGGCAA | 3 | 35 | 25 | 35 | 30 | 21 |
| 541 | 148 | 20075 | 77.8 | TTAGAGCCGCAAGAGTGTGCCACG | 3 | 36 | 21 | 20 | 33 | 30 |
| 542 | 149 | 13129 | 77 | AATCAAAGCGTTTCCCAGCCCTTG | 4 | 6 | 12 | 28 | 36 | 11 |
| 543 | 152 | 30036 | 76.6 | AATCCGTTGCAACTGTAGCCCACG | 4 | 12 | 21 | 14 | 36 | 30 |
| 544 | 154 | 721 | 75.4 | AATCCTCAACGGTCCCATACACGG | 4 | 13 | 35 | 28 | 5 | 35 |
| 545 | 155 | 741 | 79.2 | AATCCGAAAATCAGCCTGCGCGTT | 4 | 16 | 4 | 36 | 29 | 12 |
| 546 | 156 | 13151 | 77.6 | AATCCGAAAAGGATGCGAATGCG | 4 | 16 | 6 | 27 | 16 | 29 |
| 547 | 158 | 745 | 77.7 | AATCCGAACTCAACGGGCAAGTGC | 4 | 16 | 13 | 35 | 21 | 33 |
| 548 | 160 | 749 | 81.1 | AATCCGAAAGTGCACGCACGGTGC | 4 | 16 | 22 | 30 | 30 | 33 |
| 549 | 164 | 779 | 75.5 | AATCGGTAGCAAAAAGGGACGCAA | 4 | 18 | 21 | 6 | 34 | 21 |
| 550 | 169 | 30039 | 75.3 | AATCCCTATGCGTGTCATCGGCTT | 4 | 26 | 29 | 9 | 24 | 17 |
| 551 | 170 | 867 | 76.6 | AATCTCCCGTCTCGAAGACCCGAA | 4 | 28 | 19 | 16 | 32 | 16 |
| 552 | 172 | 13204 | 75 | AATCTGCGGCTTTACAGGACGCTT | 4 | 29 | 17 | 7 | 34 | 17 |
| 553 | 173 | 40024 | 78.8 | AATCTGCGAGGAGACCTCCCACGG | 4 | 29 | 25 | 32 | 28 | 35 |
| 554 | 174 | 888 | 78.1 | AATCTGCGGACCGGTATCCCACCT | 4 | 29 | 32 | 18 | 28 | 23 |
| 555 | 175 | 40025 | 78.3 | AATCTGCGGTGCTCTGACGGTCGT | 4 | 29 | 33 | 8 | 35 | 10 |
| 556 | 176 | 20090 | 78.4 | AATCCACGTCGTACGGGCAACAGC | 4 | 30 | 10 | 35 | 21 | 31 |
| 557 | 177 | 13215 | 78.7 | AATCCAGCCTTGCTTGGGACGGAC | 4 | 31 | 11 | 11 | 34 | 34 |
| 558 | 178 | 13217 | 75.5 | AATCCAGCCCTAAGGAGGACAGCC | 4 | 31 | 26 | 25 | 34 | 36 |
| 559 | 180 | 20095 | 78.4 | AATCCAGCTGCGCGTTCGAACTGT | 4 | 31 | 29 | 12 | 16 | 14 |
| 560 | 181 | 921 | 77.7 | AATCCAGCACGGGTCTAGCCGATG | 4 | 31 | 35 | 19 | 36 | 27 |
| 561 | 182 | 923 | 78.8 | AATCGACCAATCGCTTGACCGCAA | 4 | 32 | 4 | 17 | 32 | 21 |

FIG. 25L

| SEQ ID NO: | 4,633 ID# | HEX ID# | Tm | ZIPCODE (5'-3') | TETRAMER NUMBERS | | | | |
|---|---|---|---|---|---|---|---|---|---|
| 562 | 184 | 13219 | 76.4 | AATCGACCCCATCGTTAGTGTGCG | 4 | 32 | 15 | 12 | 22 29 |
| 563 | 185 | 30045 | 75.8 | AATCGACCCCTAACGGAAAGCGTT | 4 | 32 | 26 | 35 | 6 12 |
| 564 | 186 | 13223 | 78.7 | AATCGACCGATGCCATTCGTCGAA | 4 | 32 | 27 | 15 | 10 16 |
| 565 | 187 | 30046 | 78.3 | AATCGACCGGACAGGATGATTGCG | 4 | 32 | 34 | 25 | 2 29 |
| 566 | 188 | 13226 | 76.5 | AATCGTGCCTCAATACCAGCACGG | 4 | 33 | 13 | 5 | 31 35 |
| 567 | 190 | 40031 | 80.8 | AATCGTGCGATGCAGCGTCTGCAA | 4 | 33 | 27 | 31 | 19 21 |
| 568 | 193 | 20097 | 77.6 | AATCGGACAGCCAGGAAATCGATCG | 4 | 34 | 36 | 25 | 24 24 |
| 569 | 194 | 973 | 76.1 | AATCACGGCTCACTCATCCCCTCA | 4 | 35 | 13 | 13 | 28 13 |
| 570 | 195 | 977 | 76.9 | AATCACGGACCTCTCAAGCCGACC | 4 | 35 | 23 | 13 | 36 32 |
| 571 | 196 | 978 | 78.4 | AATCACGGGATGCGAACGAAGTGC | 4 | 35 | 27 | 16 | 16 33 |
| 572 | 198 | 40034 | 75.8 | AATCAGCCCGTTAAAGTGCGGATG | 4 | 36 | 12 | 6 | 29 27 |
| 573 | 199 | 40035 | 79.8 | AATCAGCCCTCAATCGCAGCAGCC | 4 | 36 | 13 | 24 | 31 36 |
| 574 | 200 | 20100 | 77.7 | AATCAGCCGGTACCATAGCCTGCG | 4 | 36 | 18 | 15 | 36 29 |
| 575 | 202 | 20101 | 75.7 | AATCAGCCAGGATGTCCCTATGCG | 4 | 36 | 25 | 9 | 26 29 |
| 576 | 204 | 1022 | 77.8 | ATACCCATCGAAGGACTGCGCAGC | 5 | 15 | 16 | 34 | 29 31 |
| 577 | 207 | 40037 | 77.9 | ATACGCAAACGGCTCATCCCGGTA | 5 | 21 | 35 | 13 | 28 18 |
| 578 | 208 | 20103 | 77.6 | ATACCCTAACGGCAGCTGCGCTGT | 5 | 26 | 35 | 31 | 29 14 |
| 579 | 209 | 1063 | 80.7 | ATACGATGACGGCAGCTCCCGCAA | 5 | 27 | 35 | 31 | 28 21 |
| 580 | 211 | 13280 | 79.6 | ATACTGCGCTGTTCCCCACGAGCC | 5 | 29 | 14 | 28 | 30 36 |
| 581 | 212 | 20105 | 75.4 | ATACTGCGCGAATTAGGCAAAGCC | 5 | 29 | 16 | 3 | 21 36 |
| 582 | 213 | 1094 | 77.8 | ATACCACGATCGTCCCCGAACGAA | 5 | 30 | 24 | 28 | 16 16 |
| 583 | 215 | 40038 | 78 | ATACCAGCGGACCCTAAGCCAGCC | 5 | 31 | 34 | 26 | 36 36 |
| 584 | 217 | 1117 | 78.3 | ATACGACCGAGTTGCGTCCCGATG | 5 | 32 | 20 | 29 | 28 27 |
| 585 | 219 | 20108 | 76.3 | ATACGTGCTGCGGGTACCATGGAC | 5 | 33 | 29 | 18 | 15 34 |
| 586 | 220 | 30048 | 78.3 | ATACGTGCCACGATCGCTTGTCCC | 5 | 33 | 30 | 24 | 11 28 |
| 587 | 221 | 40039 | 78.8 | ATACGGACGACCTGTCGGACGCAA | 5 | 34 | 32 | 9 | 34 21 |
| 588 | 222 | 1148 | 75.2 | ATACACGGCCTAACGGTGTCCGTT | 5 | 35 | 26 | 35 | 9 12 |
| 589 | 223 | 30052 | 79.2 | ATACACGGTCCCCGTTGGACCAGC | 5 | 35 | 28 | 12 | 34 31 |
| 590 | 224 | 30053 | 76.7 | ATACAGCCCGAACAGCTCCCTCGT | 5 | 36 | 16 | 31 | 28 10 |
| 591 | 225 | 1200 | 78.8 | AAAGTCGTAGCCATCGCACGCAGC | 6 | 10 | 36 | 24 | 30 31 |
| 592 | 227 | 40040 | 76.2 | AAAGCGTTTTGACGTTAGCCTGCG | 6 | 12 | 1 | 12 | 36 29 |
| 593 | 229 | 13343 | 75.2 | AAAGCGTTATCGTCCCGACCTCTG | 6 | 12 | 24 | 28 | 32 8 |
| 594 | 230 | 40041 | 79.8 | AAAGCGTTGACCGATGACGGCCAT | 6 | 12 | 32 | 27 | 35 15 |
| 595 | 232 | 30054 | 76.2 | AAAGCCATGCTTTCCCTCCCAAAG | 6 | 15 | 17 | 28 | 28 6 |
| 596 | 233 | 40042 | 76.9 | AAAGCGAATCGTTCGTCTTGCACG | 6 | 16 | 10 | 10 | 11 30 |
| 597 | 235 | 30055 | 76.1 | AAAGCGAACGAAGATGCCATCAGC | 6 | 16 | 16 | 27 | 15 31 |
| 598 | 236 | 1277 | 77.2 | AAAGCGAACAGCGACCCCTACAGC | 6 | 16 | 31 | 32 | 26 31 |
| 599 | 237 | 13376 | 75.8 | AAAGGCTTATCGTGCGTCGTGCTT | 6 | 17 | 24 | 29 | 10 17 |
| 600 | 238 | 40043 | 75.2 | AAAGGCAAAAAGTGTCCAGCGGAC | 6 | 21 | 6 | 9 | 31 34 |
| 601 | 239 | 30058 | 76.6 | AAAGGCAATCGTTGTCGGTATGCG | 6 | 21 | 10 | 9 | 18 29 |
| 602 | 240 | 13388 | 79 | AAAGGCAAAGTGCGAACACGGCAA | 6 | 21 | 22 | 16 | 30 21 |
| 603 | 241 | 30059 | 78.1 | AAAGGCAACAGCGCAAGCAAGGAC | 6 | 21 | 31 | 21 | 21 34 |
| 604 | 244 | 40044 | 76.5 | AAAGATCGGCAAAAAGTCCCCGAA | 6 | 24 | 21 | 6 | 28 16 |
| 605 | 245 | 30060 | 79.6 | AAAGATCGCAGCGCTTGATGTGCG | 6 | 24 | 31 | 17 | 27 29 |
| 606 | 246 | 1355 | 79.7 | AAAGGATGCTCAAGCCCAGCACGG | 6 | 27 | 13 | 36 | 31 35 |
| 607 | 247 | 13417 | 76.1 | AAAGTCCCGAGTTGCGTGCGTTAG | 6 | 28 | 20 | 29 | 29 3 |
| 608 | 249 | 30063 | 77.8 | AAAGTGCGAGCCATCGACCTACGG | 6 | 29 | 36 | 24 | 23 35 |
| 609 | 250 | 40048 | 77.9 | AAAGCACGGCTTGGTAGTGCGACC | 6 | 30 | 17 | 18 | 33 32 |
| 610 | 251 | 40049 | 78.3 | AAAGCACGGCAATGATCACGGACC | 6 | 30 | 21 | 2 | 30 32 |
| 611 | 252 | 1413 | 79.4 | AAAGCACGAGTGGGACGTGCATCG | 6 | 30 | 22 | 34 | 33 24 |
| 612 | 253 | 13443 | 75.7 | AAAGCAGCGCTTGGTAATCGGGTA | 6 | 31 | 17 | 18 | 24 18 |

FIG. 25M

| SEQ ID NO: | 4,633 ID# | HEX ID# | Tm | ZIPCODE (5'-3') | TETRAMER NUMBERS | | | | |
|---|---|---|---|---|---|---|---|---|---|
| 613 | 254 | 30067 | 75 | AAAGGACCGGTAAAAGCGAAGCAA | 6 | 32 | 18 | 6 | 16 | 21 |
| 614 | 256 | 13456 | 76.6 | AAAGGTGCTCGTCAGCAGTGCGTT | 6 | 33 | 10 | 31 | 22 | 12 |
| 615 | 257 | 13457 | 78.1 | AAAGGTGCCTTGGTGCGATGCCTA | 6 | 33 | 11 | 33 | 27 | 26 |
| 616 | 258 | 30069 | 78.4 | AAAGGTGCCTCATGTCACGGGTGC | 6 | 33 | 13 | 9 | 35 | 33 |
| 617 | 259 | 30070 | 77.2 | AAAGGTGCCGAAATCGGGACTTGA | 6 | 33 | 16 | 24 | 34 | 1 |
| 618 | 260 | 40052 | 78.9 | AAAGGTGCCAGCGGTAGGACCAGC | 6 | 33 | 31 | 18 | 34 | 31 |
| 619 | 261 | 1467 | 77.4 | AAAGGGACTTGAACGGGCTTGCAA | 6 | 34 | 1 | 35 | 17 | 21 |
| 620 | 262 | 40053 | 77.6 | AAAGGGACCTCAGCAAAGCCCCAT | 6 | 34 | 13 | 21 | 36 | 15 |
| 621 | 263 | 30072 | 76.6 | AAAGGGACCCATGCTTCCATGACC | 6 | 34 | 15 | 17 | 15 | 32 |
| 622 | 265 | 1483 | 77 | AAAGACGGTCTGGCTTACGGGTGC | 6 | 35 | 8 | 17 | 35 | 33 |
| 623 | 266 | 30073 | 77.7 | AAAGACGGCGTTGTGCAAAGTCCC | 6 | 35 | 12 | 33 | 6 | 28 |
| 624 | 267 | 13472 | 78.3 | AAAGACGGATCGCACGCCTAGCAA | 6 | 35 | 24 | 30 | 26 | 21 |
| 625 | 269 | 40054 | 78.7 | AAAGAGCCGAGTGGACATCGTGCG | 6 | 36 | 20 | 34 | 24 | 29 |
| 626 | 270 | 20130 | 78.6 | AAAGAGCCAGTGACGGCCATCACG | 6 | 36 | 22 | 35 | 15 | 30 |
| 627 | 273 | 20134 | 77.6 | TACATCCCCGAAGGTAACGGCAGC | 7 | 28 | 16 | 18 | 35 | 31 |
| 628 | 274 | 1538 | 77.3 | TACATCCCATCGGAGTTCCCGACC | 7 | 28 | 24 | 20 | 28 | 32 |
| 629 | 275 | 1555 | 79.9 | TACATGCGGGACGAGTGACCCACG | 7 | 29 | 34 | 20 | 32 | 30 |
| 630 | 276 | 13501 | 76.8 | TACACAGCTGCGTACATGCGCCAT | 7 | 31 | 29 | 7 | 29 | 15 |
| 631 | 277 | 13503 | 77.8 | TACAGACCGCAACGAAAGCCTCCC | 7 | 32 | 21 | 16 | 36 | 28 |
| 632 | 278 | 13505 | 80.2 | TACAGTGCACGGGCAAGACCGTGC | 7 | 33 | 35 | 21 | 32 | 33 |
| 633 | 279 | 13506 | 75 | TACAACGGTCGTATCGCTTGCCAT | 7 | 35 | 10 | 24 | 11 | 15 |
| 634 | 280 | 1586 | 78.1 | TACAACGGCTTGCTCAGACCGCAA | 7 | 35 | 11 | 13 | 32 | 21 |
| 635 | 283 | 1593 | 79.9 | TACAACGGGAGTTGCGCAGCCTCA | 7 | 35 | 20 | 29 | 31 | 13 |
| 636 | 284 | 1595 | 78.7 | TACAACGGACCTGATGCAGCGCAA | 7 | 35 | 23 | 27 | 31 | 21 |
| 637 | 285 | 30077 | 75.6 | TACAACGGCACGTGCGACCTTTAG | 7 | 35 | 30 | 29 | 23 | 3 |
| 638 | 287 | 13515 | 76.2 | TACAAGCCGCAAGTCTTGCGTTGA | 7 | 36 | 21 | 19 | 29 | 1 |
| 639 | 288 | 13516 | 79.8 | TACAAGCCATCGCAGCCTTGGCAA | 7 | 36 | 24 | 31 | 11 | 21 |
| 640 | 293 | 1633 | 81.4 | TCTGTCTGCGTTTGCGGCAAAGCC | 8 | 8 | 12 | 29 | 21 | 36 |
| 641 | 294 | 13523 | 79.2 | TCTGTCTGCGAATGCGGACCGTCT | 8 | 8 | 16 | 29 | 32 | 19 |
| 642 | 295 | 20141 | 75.6 | TCTGTCGTGCTTGACCAGCCTGTC | 8 | 10 | 17 | 32 | 36 | 9 |
| 643 | 296 | 40058 | 77.3 | TCTGCTTGCGTTGCTTTGTCCGTT | 8 | 11 | 12 | 17 | 9 | 12 |
| 644 | 302 | 40059 | 79.7 | TCTGCGTTTTGAGTGCAGCCCAGC | 8 | 12 | 1 | 33 | 36 | 31 |
| 645 | 303 | 30080 | 76.6 | TCTGCGTTCGTTCTTGCGAAACCT | 8 | 12 | 12 | 11 | 16 | 23 |
| 646 | 305 | 13535 | 78.6 | TCTGCGTTGATGAGGACAGCTGCG | 8 | 12 | 27 | 25 | 31 | 29 |
| 647 | 307 | 1679 | 78.5 | TCTGCTCAGCAAACCTGTGCACGG | 8 | 13 | 21 | 23 | 33 | 35 |
| 648 | 308 | 1680 | 81.3 | TCTGCTCACAGCACGGGTGCGATG | 8 | 13 | 31 | 35 | 33 | 27 |
| 649 | 309 | 1688 | 80.9 | TCTGCTGTCACGGACCCAGCCGTT | 8 | 14 | 30 | 32 | 31 | 12 |
| 650 | 310 | 1693 | 77.5 | TCTGCCATCGAAAGTGGTGCCTTG | 8 | 15 | 16 | 22 | 33 | 11 |
| 651 | 311 | 13539 | 79.1 | TCTGCCATGGTACGTTTGCGGACC | 8 | 15 | 18 | 12 | 29 | 32 |
| 652 | 312 | 30083 | 80.1 | TCTGCCATTCCCATCGTCTGCACG | 8 | 15 | 28 | 24 | 8 | 30 |
| 653 | 314 | 1703 | 78.5 | TCTGCGAATCTGCGTTTGATTGCG | 8 | 16 | 8 | 12 | 2 | 29 |
| 654 | 315 | 13544 | 80.1 | TCTGCGAAAGTGACGGAGCCCGTT | 8 | 16 | 22 | 35 | 36 | 12 |
| 655 | 316 | 1718 | 78.7 | TCTGCGAAGTGCCTTGTCGTTCCC | 8 | 16 | 33 | 11 | 10 | 28 |
| 656 | 318 | 13550 | 75.4 | TCTGGCTTAGGAACGGGCTTCTTG | 8 | 17 | 25 | 35 | 17 | 11 |
| 657 | 319 | 40061 | 77.6 | TCTGGCTTTGCGAATCCTTGGCTT | 8 | 17 | 29 | 4 | 11 | 17 |
| 658 | 320 | 1732 | 78.5 | TCTGGCTTGACCGACCCGAAGATG | 8 | 17 | 32 | 32 | 16 | 27 |
| 659 | 323 | 1739 | 78.1 | TCTGGGTATCCCCGAATGTCCACG | 8 | 18 | 28 | 16 | 9 | 30 |
| 660 | 326 | 1750 | 78.1 | TCTGGCAATGATATCGCACGGTGC | 8 | 21 | 2 | 24 | 30 | 33 |
| 661 | 327 | 1751 | 77.1 | TCTGGCAAAAAGGCTTTCCCCTTG | 8 | 21 | 6 | 17 | 28 | 11 |
| 662 | 328 | 1752 | 78.3 | TCTGGCAACTGTCAGCGCTTCGAA | 8 | 21 | 14 | 31 | 17 | 16 |
| 663 | 329 | 13554 | 76.9 | TCTGGCAAGGTATCTGCAGCCAGC | 8 | 21 | 18 | 8 | 31 | 31 |

FIG. 25N

| SEQ ID NO: | 4,633 ID# | H3X ID# | Tm | ZIPCODE (5'-3') | TETRAMER NUMBERS | | | | | |
|---|---|---|---|---|---|---|---|---|---|---|
| 664 | 330 | 1763 | 80.5 | TCTGAGTGGCAATCCCTCCCTGCG | 8 | 22 | 21 | 28 | 28 | 29 |
| 665 | 334 | 30086 | 80.4 | TCTGATCGGTGCTGCGAATCGTGC | 8 | 24 | 33 | 29 | 4 | 33 |
| 666 | 336 | 1788 | 79.3 | TCTGCCTACAGCCGAATCCCGCTT | 8 | 26 | 31 | 16 | 28 | 17 |
| 667 | 337 | 40062 | 80.1 | TCTGGATGCCATGTGCCGAACAGC | 8 | 27 | 15 | 33 | 16 | 31 |
| 668 | 338 | 30087 | 77.3 | TCTGGATGCGAAAAAGTGCGCCTA | 8 | 27 | 16 | 6 | 29 | 26 |
| 669 | 339 | 1797 | 79.2 | TCTGGATGGGACGGTATGCGCTTG | 8 | 27 | 34 | 18 | 29 | 11 |
| 670 | 341 | 40063 | 79 | TCTGTCCCCATTCGTGATGGTGC | 8 | 28 | 15 | 10 | 27 | 33 |
| 671 | 342 | 40064 | 79.4 | TCTGTCCCGCTTTCTGGATGTGCG | 8 | 28 | 17 | 8 | 27 | 29 |
| 672 | 343 | 40065 | 76.8 | TCTGTCCCGGTACCATATCGCGAA | 8 | 28 | 18 | 15 | 24 | 16 |
| 673 | 344 | 13566 | 78.8 | TCTGTCCCGAGTGGACGCAACCAT | 8 | 28 | 20 | 34 | 21 | 15 |
| 674 | 345 | 13568 | 78.2 | TCTGTCCCAGCCCCTATCCCACCT | 8 | 28 | 36 | 26 | 28 | 23 |
| 675 | 347 | 1812 | 79.9 | TCTGTGCGTCTGTCCCCGAAGCAA | 8 | 29 | 8 | 28 | 16 | 21 |
| 676 | 348 | 1822 | 80.1 | TCTGTGCGTGCGGATGACCTACGG | 8 | 29 | 29 | 27 | 23 | 35 |
| 677 | 349 | 1823 | 78.3 | TCTGTGCGGACCTCGTTGATCACG | 8 | 29 | 32 | 10 | 2 | 30 |
| 678 | 350 | 1828 | 75.6 | TCTGCACGCTTGTTAGCAGCACCT | 8 | 30 | 11 | 3 | 31 | 23 |
| 679 | 351 | 1831 | 79.4 | TCTGCACGCCATGTGCCGTTTACA | 8 | 30 | 15 | 33 | 12 | 7 |
| 680 | 352 | 40067 | 80.3 | TCTGCACGGAGTTGTCGGACGTGC | 8 | 30 | 20 | 9 | 34 | 33 |
| 681 | 354 | 30090 | 78.7 | TCTGCACGCCTAAGCCCTGTGACC | 8 | 30 | 26 | 36 | 14 | 32 |
| 682 | 355 | 40068 | 79.8 | TCTGCACGGATGACGGACCTCGAA | 8 | 30 | 27 | 35 | 23 | 16 |
| 683 | 356 | 1845 | 78 | TCTGCAGCCTGTGGTACACGCGTT | 8 | 31 | 14 | 18 | 30 | 12 |
| 684 | 357 | 20165 | 81.5 | TCTGCAGCCGAAGCTTGCAAACGG | 8 | 31 | 16 | 17 | 21 | 35 |
| 685 | 359 | 13579 | 81 | TCTGCAGCGTGCGCAAAGCCTACA | 8 | 31 | 33 | 21 | 36 | 7 |
| 686 | 360 | 1860 | 80 | TCTGGACCTGCGCCATCTCAGCAA | 8 | 32 | 29 | 15 | 13 | 21 |
| 687 | 361 | 1861 | 80.4 | TCTGGACCCACGGACCTGTCCAGC | 8 | 32 | 30 | 32 | 9 | 31 |
| 688 | 362 | 13581 | 78.8 | TCTGGACCGACCAGTGCGTTCCAT | 8 | 32 | 32 | 22 | 12 | 15 |
| 689 | 364 | 1867 | 79.3 | TCTGGTGCTCGTCTGTGTGCACGG | 8 | 33 | 10 | 14 | 33 | 35 |
| 690 | 365 | 30091 | 77.5 | TCTGGTGCGGTACAGCCTCAATCG | 8 | 33 | 18 | 31 | 13 | 24 |
| 691 | 366 | 40071 | 81.9 | TCTGGTGCATCGGGACATCGGTGC | 8 | 33 | 24 | 34 | 24 | 33 |
| 692 | 367 | 40072 | 77.3 | TCTGGGACCGTTGTCTAGCCCGTT | 8 | 34 | 12 | 19 | 36 | 12 |
| 693 | 368 | 40073 | 79 | TCTGGGACCCTAATCGACGGCGTT | 8 | 34 | 26 | 24 | 35 | 12 |
| 694 | 369 | 1898 | 79.3 | TCTGACGGGAGTGCAACACGGACC | 8 | 35 | 20 | 21 | 30 | 32 |
| 695 | 370 | 13593 | 78 | TCTGACGGGCAACTTGATCGCTCA | 8 | 35 | 21 | 11 | 24 | 13 |
| 696 | 371 | 1902 | 76.5 | TCTGACGGGATGACCTAGCCGATG | 8 | 35 | 27 | 23 | 36 | 27 |
| 697 | 372 | 1904 | 79.5 | TCTGACGGACGGGCTTAGTGTGCG | 8 | 35 | 35 | 17 | 22 | 29 |
| 698 | 373 | 1906 | 78.1 | TCTGAGCCAAAGGTGCCCATCGTT | 8 | 36 | 6 | 33 | 15 | 12 |
| 699 | 374 | 40076 | 77.5 | TCTGAGCCGCAAGGTAACGGACCT | 8 | 36 | 21 | 18 | 35 | 23 |
| 700 | 377 | 1921 | 78.9 | TGTCTTGAAGCCCCATTGCGCCTA | 9 | 1 | 36 | 15 | 29 | 26 |
| 701 | 378 | 1924 | 83.9 | TGTCAATCCAGCGTGCTGCGTGCG | 9 | 4 | 31 | 33 | 29 | 29 |
| 702 | 379 | 1926 | 81 | TGTCAATCACGGAGCCCACGGGAC | 9 | 4 | 35 | 36 | 30 | 34 |
| 703 | 380 | 1927 | 80.5 | TGTCAATCAGCCAGCCCAGCTCCC | 9 | 4 | 36 | 36 | 31 | 28 |
| 704 | 381 | 1928 | 78.2 | TGTCAAAGCCATACGGCAGCGATG | 9 | 6 | 15 | 35 | 31 | 27 |
| 705 | 382 | 1933 | 79.2 | TGTCAAAGCAGCCACGTGATTGCG | 9 | 6 | 31 | 30 | 2 | 29 |
| 706 | 383 | 1936 | 77.8 | TGTCTGTCCGAAGGACCAGCTCCC | 9 | 9 | 16 | 34 | 31 | 28 |
| 707 | 384 | 13599 | 76.7 | TGTCTGTCGCAAAGCCAAAGTCCC | 9 | 9 | 21 | 36 | 6 | 28 |
| 708 | 386 | 1943 | 83.1 | TGTCTCGTCACGTGCGGACCTGCG | 9 | 10 | 30 | 29 | 32 | 29 |
| 709 | 388 | 1946 | 78.3 | TGTCTCGTACGGCGTTTTGATGCG | 9 | 10 | 35 | 12 | 1 | 29 |
| 710 | 389 | 1947 | 80.3 | TGTCCTTGCTCAATCGGTGCGTGC | 9 | 11 | 13 | 24 | 33 | 33 |
| 711 | 390 | 30093 | 76.9 | TGTCCTTGCACGTTAGGACCCGAA | 9 | 11 | 30 | 3 | 32 | 16 |
| 712 | 391 | 1957 | 78 | TGTCCTTGGACCCGAAGTGCCCTA | 9 | 11 | 32 | 16 | 33 | 26 |
| 713 | 394 | 1969 | 79.3 | TGTCCGTTACCTTCCCGACCGACC | 9 | 12 | 23 | 28 | 32 | 32 |
| 714 | 396 | 1978 | 77.5 | TGTCCTCAGCAATGTCGGACAGCC | 9 | 13 | 21 | 9 | 34 | 36 |

FIG. 25O

| SEQ ID NO: | 4,633 ID# | HEX ID# | Tm | ZIPCODE (5'-3') | TETRAMER NUMBERS | | | | |
|---|---|---|---|---|---|---|---|---|---|
| 715 | 397 | 20181 | 78.4 | TGTCCTCATCCCACCTCACGAGCC | 9 | 13 | 28 | 23 | 30 | 36 |
| 716 | 398 | 20184 | 76.5 | TGTCCTGTACGGAATCAGCCGACC | 9 | 14 | 35 | 4 | 36 | 32 |
| 717 | 400 | 1984 | 81 | TGTCCCATCTTGGACCCAGCACGG | 9 | 15 | 11 | 32 | 31 | 35 |
| 718 | 401 | 1987 | 75.8 | TGTCCCATCGAAAATCCGAACCAT | 9 | 15 | 16 | 4 | 16 | 15 |
| 719 | 402 | 13609 | 77 | TGTCCCATGCAAAGGAAGGAGCAA | 9 | 15 | 21 | 25 | 25 | 21 |
| 720 | 403 | 1992 | 78.5 | TGTCCCATCCTACGTTGTGCGCAA | 9 | 15 | 26 | 12 | 33 | 21 |
| 721 | 404 | 1993 | 80 | TGTCCCATGATGGCAAGTGCCAGC | 9 | 15 | 27 | 21 | 33 | 31 |
| 722 | 405 | 13610 | 79.6 | TGTCCCATCAGCACGGGATGAGGA | 9 | 15 | 31 | 35 | 27 | 25 |
| 723 | 406 | 13612 | 77.3 | TGTCCCATAGCCATACTGCGGTGC | 9 | 15 | 36 | 5 | 29 | 33 |
| 724 | 407 | 30095 | 78.2 | TGTCCGAACGTTGCTTGGACGATG | 9 | 16 | 12 | 17 | 34 | 27 |
| 725 | 408 | 30096 | 76.3 | TGTCCGAAGCTTCTTGGGACGGTA | 9 | 16 | 17 | 11 | 34 | 18 |
| 726 | 409 | 13616 | 77.5 | TGTCCGAAACCTCGAATGCGAGTG | 9 | 16 | 23 | 16 | 29 | 22 |
| 727 | 410 | 40078 | 78.2 | TGTCCGAAAGGAAGGAGGACGAA | 9 | 16 | 25 | 25 | 34 | 21 |
| 728 | 411 | 2007 | 76.3 | TGTCCGAACCTACTCATCCCCACG | 9 | 16 | 26 | 13 | 28 | 30 |
| 729 | 412 | 2011 | 78.7 | TGTCCGAACAGCGGACAAAGAGCC | 9 | 16 | 31 | 34 | 6 | 36 |
| 730 | 413 | 40080 | 77.9 | TGTCGCTTCGTTCGTTATCGGCAA | 9 | 17 | 12 | 12 | 24 | 21 |
| 731 | 414 | 13620 | 78.1 | TGTCGCTTCCATCGTTGATGACGG | 9 | 17 | 15 | 12 | 27 | 35 |
| 732 | 415 | 40081 | 77.3 | TGTCGCTTGCTTCCATTGTCGCTT | 9 | 17 | 17 | 15 | 9 | 17 |
| 733 | 416 | 30098 | 76.9 | TGTCGCTTATCGACCTAGCCGTGC | 9 | 17 | 24 | 23 | 36 | 33 |
| 734 | 417 | 13621 | 78.8 | TGTCGCTTAGGAAGCCACGGCTTG | 9 | 17 | 25 | 36 | 35 | 11 |
| 735 | 419 | 2029 | 80.1 | TGTCGGTATCGTTCCCTCCCGTGC | 9 | 18 | 10 | 28 | 28 | 33 |
| 736 | 420 | 2031 | 76.8 | TGTCGGTAGCAAACCTACGGCAGC | 9 | 18 | 21 | 23 | 35 | 31 |
| 737 | 421 | 2034 | 79.3 | TGTCGGTACAGCCAGCGCAAGCTT | 9 | 18 | 31 | 31 | 21 | 17 |
| 738 | 423 | 2037 | 78.3 | TGTCGTCTTCGTGGACCGTTTCCC | 9 | 19 | 10 | 34 | 12 | 28 |
| 739 | 424 | 2039 | 81.1 | TGTCGTCTCGAATCCCGACCACGG | 9 | 19 | 16 | 28 | 32 | 35 |
| 740 | 426 | 2050 | 79 | TGTCGAGTCAGCAGCCCGAACCAT | 9 | 20 | 31 | 36 | 16 | 15 |
| 741 | 427 | 30099 | 77.2 | TGTCGCAATTGACCATAGCCGACC | 9 | 21 | 1 | 15 | 36 | 32 |
| 742 | 428 | 2054 | 77.1 | TGTCGCAAAATCTCGTGATGTGCG | 9 | 21 | 4 | 10 | 27 | 29 |
| 743 | 429 | 40082 | 78.6 | TGTCGCAATCGTGCTTGATGCCAT | 9 | 21 | 10 | 17 | 27 | 15 |
| 744 | 433 | 2062 | 81.3 | TGTCGCAAGAGTTGCGCACGATCG | 9 | 21 | 20 | 29 | 30 | 24 |
| 745 | 434 | 2063 | 78.7 | TGTCGCAAAGTGGTCTGTGCCGAA | 9 | 21 | 22 | 19 | 33 | 16 |
| 746 | 435 | 13629 | 80.5 | TGTCGCAATGCGGACCCCTATCGT | 9 | 21 | 29 | 32 | 26 | 10 |
| 747 | 437 | 2074 | 83.3 | TGTCAGTGCAGCAGCCGGACTGCG | 9 | 22 | 31 | 36 | 34 | 29 |
| 748 | 438 | 2079 | 81.6 | TGTCACCTCACGCGAAACGGCGTT | 9 | 23 | 30 | 16 | 35 | 12 |
| 749 | 439 | 2082 | 80.4 | TGTCATCGTCGTCAGCGCAAAGCC | 9 | 24 | 10 | 31 | 21 | 36 |
| 750 | 440 | 2090 | 81.7 | TGTCATCGGATGGCAAACGGGTGC | 9 | 24 | 27 | 21 | 35 | 33 |
| 751 | 441 | 30100 | 82 | TGTCATCGTGCGCAGCGTGCAATC | 9 | 24 | 29 | 31 | 33 | 4 |
| 752 | 446 | 2107 | 81.4 | TGTCCCTACAGCAGCCCAGCGTGC | 9 | 26 | 31 | 36 | 31 | 33 |
| 753 | 447 | 40083 | 79.1 | TGTCCCTAACGGGACCTGCGGTCT | 9 | 26 | 35 | 32 | 29 | 19 |
| 754 | 453 | 2119 | 79.4 | TGTCGATGGTGCCCATCTTGCCAT | 9 | 27 | 33 | 15 | 11 | 15 |
| 755 | 454 | 40084 | 80.9 | TGTCGATGGGACGATGCGTTTCCC | 9 | 27 | 34 | 27 | 12 | 28 |
| 756 | 455 | 40085 | 76.5 | TGTCTCCCCGTTAGGATTGATGCG | 9 | 28 | 12 | 25 | 1 | 29 |
| 757 | 456 | 13642 | 79.3 | TGTCTCCCAGGAGGACGACCGCTT | 9 | 28 | 25 | 34 | 32 | 17 |
| 758 | 457 | 2135 | 78.8 | TGTCTGCGTTGAACGGGACCACCT | 9 | 29 | 1 | 35 | 32 | 23 |
| 759 | 458 | 2136 | 80.7 | TGTCTGCGAATCGACCCAGCCCAT | 9 | 29 | 4 | 32 | 31 | 15 |
| 760 | 459 | 2137 | 78.6 | TGTCTGCGAAAGCAGCCTTGGCTT | 9 | 29 | 6 | 31 | 11 | 17 |
| 761 | 460 | 40087 | 76.6 | TGTCTGCGGGTACGAACCTAACGG | 9 | 29 | 18 | 16 | 26 | 35 |
| 762 | 462 | 2145 | 83.4 | TGTCTGCGAGTGGCAATGCGGCAA | 9 | 29 | 22 | 21 | 29 | 21 |
| 763 | 463 | 2146 | 77.2 | TGTCTGCGAGGACGAACACGACCT | 9 | 29 | 25 | 16 | 30 | 23 |
| 764 | 465 | 2149 | 79.7 | TGTCTGCGTGCGGTGCCCTATGAT | 9 | 29 | 29 | 33 | 26 | 2 |
| 765 | 466 | 30103 | 82.4 | TGTCTGCGGTGCCAGCTCTGGTGC | 9 | 29 | 33 | 31 | 8 | 33 |

FIG. 25P

| SEQ ID NO: | 4,633 ID# | HEX ID# | Tm | ZIPCODE (5'-3') | TETRAMER NUMBERS | | | | |
|---|---|---|---|---|---|---|---|---|---|
| 766 | 467 | 13646 | 79.5 | TGTCCACGTCGTGACCCTTGCCAT | 9 | 30 | 10 32 | 11 | 15 |
| 767 | 468 | 2153 | 80.4 | TGTCCACGCTTGGACCCACGTTGA | 9 | 30 | 11 32 | 30 | 1 |
| 768 | 470 | 30104 | 77.2 | TGTCCACGGCTTCCTAGCAACGAA | 9 | 30 | 17 26 | 21 | 16 |
| 769 | 471 | 40088 | 78 | TGTCCACGGGTACTGTCACGACGG | 9 | 30 | 18 14 | 30 | 35 |
| 770 | 474 | 2164 | 77.7 | TGTCCACGGACCTCGTGCTTGGTA | 9 | 30 | 32 10 | 17 | 18 |
| 771 | 475 | 40090 | 78.4 | TGTCCAGCACCTTCGTACGGTCCC | 9 | 31 | 23 10 | 35 | 28 |
| 772 | 478 | 40091 | 78.7 | TGTCCAGCGACCTTGAGGACCAGC | 9 | 31 | 32 1 | 34 | 31 |
| 773 | 479 | 2180 | 79.2 | TGTCGACCAATCTCCCGTGCCTTG | 9 | 32 | 4 28 | 33 | 11 |
| 774 | 483 | 30110 | 80.6 | TGTCGACCAGGACTCATGCGGCAA | 9 | 32 | 25 13 | 29 | 21 |
| 775 | 486 | 13654 | 78.3 | TGTCGTGCAATCAATCCACGCCAT | 9 | 33 | 4 4 | 30 | 15 |
| 776 | 489 | 2198 | 78.1 | TGTCGTGCTCGTGCAAGACCGTCT | 9 | 33 | 10 21 | 32 | 19 |
| 777 | 490 | 30111 | 82.1 | TGTCGTGCCTTGCTGTCACGCACG | 9 | 33 | 11 14 | 30 | 30 |
| 778 | 491 | 30112 | 77.8 | TGTCGTGCGGTATCTGGCAAAGGA | 9 | 33 | 18 8 | 21 | 25 |
| 779 | 492 | 40092 | 79.4 | TGTCGTGCGTCTTCTGGGACGGAC | 9 | 33 | 19 8 | 34 | 34 |
| 780 | 493 | 2205 | 76.6 | TGTCGTGCACCTACCTGTGCGGTA | 9 | 33 | 23 23 | 33 | 18 |
| 781 | 494 | 40093 | 78.3 | TGTCGTGCAGGACTGTCGAAACGG | 9 | 33 | 25 14 | 16 | 35 |
| 782 | 496 | 2210 | 78 | TGTCGTGCTCCCCGAAAATCCTGT | 9 | 33 | 28 16 | 4 | 14 |
| 783 | 500 | 2218 | 76.7 | TGTCGGACCTGTGCTTAGCCCTTG | 9 | 34 | 14 17 | 36 | 11 |
| 784 | 502 | 40094 | 78.3 | TGTCGGACGTCTGGTAAGCCGCTT | 9 | 34 | 19 18 | 36 | 17 |
| 785 | 503 | 13659 | 77.4 | TGTCGGACACCTCGTTACGGCTTG | 9 | 34 | 23 12 | 35 | 11 |
| 786 | 504 | 13660 | 75.5 | TGTCGGACCCTAAATCGCTTCGTT | 9 | 34 | 26 4 | 17 | 12 |
| 787 | 505 | 13661 | 76.7 | TGTCGGACGATGAGTGCCTAAGCC | 9 | 34 | 27 22 | 26 | 36 |
| 788 | 506 | 2226 | 81.2 | TGTCGGACTCCCGACCAGTGGTGC | 9 | 34 | 28 32 | 22 | 33 |
| 789 | 507 | 2230 | 78.6 | TGTCACGGTTGATCCCACGGACCT | 9 | 35 | 1 28 | 35 | 23 |
| 790 | 509 | 2233 | 79.2 | TGTCACGGCTTGCGTTGCAAAGTG | 9 | 35 | 11 12 | 21 | 22 |
| 791 | 511 | 40096 | 76.8 | TGTCACGGGCTTACCTGATGCCAT | 9 | 35 | 17 23 | 27 | 15 |
| 792 | 512 | 30115 | 77.4 | TGTCACGGGAGTAGGACGTTTGCG | 9 | 35 | 20 25 | 12 | 29 |
| 793 | 513 | 30116 | 76.8 | TGTCACGGGCAAAAAGCGAAAAAG | 9 | 35 | 21 6 | 16 | 6 |
| 794 | 514 | 13665 | 80.5 | TGTCACGGTCCCCTTGGGACAGGA | 9 | 35 | 28 11 | 34 | 25 |
| 795 | 516 | 13667 | 75.4 | TGTCAGCCCTGTATACCGAATGCG | 9 | 36 | 14 5 | 16 | 29 |
| 796 | 517 | 2249 | 77.2 | TGTCAGCCGCTTTTGACGTTTCGT | 9 | 36 | 17 1 | 12 | 10 |
| 797 | 518 | 2252 | 77.2 | TGTCAGCCACCTGCAAGATGGCTT | 9 | 36 | 23 21 | 27 | 17 |
| 798 | 519 | 40097 | 77.7 | TGTCAGCCATCGTTAGCAGCCAGC | 9 | 36 | 24 3 | 31 | 31 |
| 799 | 520 | 13669 | 79.6 | TGTCAGCCGACCGCTTTCGTTCTG | 9 | 36 | 32 17 | 10 | 8 |
| 800 | 521 | 13672 | 77.3 | TCGTTGATGCTTCTTGGTGCGCTT | 10 | 2 | 17 11 | 33 | 17 |
| 801 | 522 | 2282 | 80.3 | TCGTTTAGGGACAGCCAGCCACGG | 10 | 3 | 34 36 | 36 | 35 |
| 802 | 523 | 2287 | 77.2 | TCGTAATCCACGCGTTGGTAACGG | 10 | 4 | 30 12 | 18 | 35 |
| 803 | 524 | 2300 | 77.7 | TCGTAAAGGGACAGGATCCCTGCG | 10 | 6 | 34 25 | 28 | 29 |
| 804 | 526 | 13686 | 76.5 | TCGTAAAGAGCCAAAGCACGCCAT | 10 | 6 | 36 6 | 30 | 15 |
| 805 | 528 | 2310 | 79.1 | TCGTTCTGTGCGCGAAGTGCTTGA | 10 | 8 | 29 16 | 33 | 1 |
| 806 | 529 | 30120 | 77.2 | TCGTTCTGCACGATACGACCGCTT | 10 | 8 | 30 5 | 32 | 17 |
| 807 | 530 | 2316 | 77.9 | TCGTTGTCCGTTGAGTTGCGAGGA | 10 | 9 | 12 20 | 29 | 25 |
| 808 | 531 | 2317 | 80.8 | TCGTTGTCCTCAACGGTGCGGCTT | 10 | 9 | 13 35 | 29 | 17 |
| 809 | 532 | 2321 | 79.5 | TCGTTGTCGAGTTGCGCTTGGACC | 10 | 9 | 20 29 | 11 | 32 |
| 810 | 533 | 30121 | 78 | TCGTTGTCCACGAGCCCGTTACCT | 10 | 9 | 30 36 | 12 | 23 |
| 811 | 534 | 30122 | 78.6 | TCGTTGTCACGGTCGTGCAAAGGA | 10 | 9 | 35 10 | 21 | 25 |
| 812 | 535 | 13693 | 77.4 | TCGTTCGTGGTATGCGCCTAATCG | 10 | 10 | 18 29 | 26 | 24 |
| 813 | 536 | 13694 | 79 | TCGTTCGTTGCGATCGTACATGCG | 10 | 10 | 29 24 | 7 | 29 |
| 814 | 538 | 30123 | 78 | TCGTCTTGCGTTCTTGCTTGCAGC | 10 | 11 | 12 11 | 11 | 31 |
| 815 | 539 | 2340 | 79.2 | TCGTCTTGTCCCGGACTCCCGAGT | 10 | 11 | 28 34 | 28 | 20 |
| 816 | 540 | 13698 | 78.5 | TCGTCTTGGACCAGCCACCTGACC | 10 | 11 | 32 36 | 23 | 32 |

FIG. 25Q

| SEQ ID NO: | 4,633 ID# | HEX ID# | Tm | ZIPCODE (5'-3') | TETRAMER NUMBERS | | | | |
|---|---|---|---|---|---|---|---|---|---|
| 817 | 541 | 2345 | 77.5 | TCGTCTTGAGCCAGCCATACACGG | 10 | 11 | 36 | 36 | 5 | 35 |
| 818 | 542 | 2346 | 79.2 | TCGTCGTTTGATGCAACAGCGTGC | 10 | 12 | 2 | 21 | 31 | 33 |
| 819 | 543 | 2347 | 79.1 | TCGTCGTTTGTCAATCGTGCGTGC | 10 | 12 | 9 | 4 | 33 | 33 |
| 820 | 544 | 40099 | 77.6 | TCGTCGTTCGAAGGTAGCAATGCG | 10 | 12 | 16 | 18 | 21 | 29 |
| 821 | 546 | 2354 | 77.5 | TCGTCGTTACCTCGTTCGAATGCG | 10 | 12 | 23 | 12 | 16 | 29 |
| 822 | 549 | 13701 | 81 | TCGTCGTTGACCCACGCACGAGTG | 10 | 12 | 32 | 30 | 30 | 22 |
| 823 | 550 | 2363 | 76.3 | TCGTCGTTAGCCAGCCTTGACCAT | 10 | 12 | 36 | 36 | 1 | 15 |
| 824 | 552 | 2367 | 80 | TCGTCTCACAGCGTGCCGTTCGTT | 10 | 13 | 31 | 33 | 12 | 12 |
| 825 | 553 | 13703 | 76.9 | TCGTCTCAAGCCTTAGGTGCCACG | 10 | 13 | 36 | 3 | 33 | 30 |
| 826 | 555 | 2375 | 80.4 | TCGTCTGTAGCCCAGCTGCGGCTT | 10 | 14 | 36 | 31 | 29 | 17 |
| 827 | 556 | 2379 | 79.6 | TCGTCCATCTCAAGCCCCATGCAA | 10 | 15 | 13 | 36 | 15 | 21 |
| 828 | 558 | 13705 | 80.1 | TCGTCCATCAGCGGTAACGGGACC | 10 | 15 | 31 | 18 | 35 | 32 |
| 829 | 559 | 13706 | 80.1 | TCGTCCATGACCCACGCTTGCTTG | 10 | 15 | 32 | 30 | 11 | 11 |
| 830 | 561 | 2393 | 77.1 | TCGTCGAAAATCACGGTGTCGCTT | 10 | 16 | 4 | 35 | 9 | 17 |
| 831 | 562 | 2394 | 78.1 | TCGTCGAAAAAGGACCACGGAGGA | 10 | 16 | 6 | 32 | 35 | 25 |
| 832 | 563 | 2395 | 82 | TCGTCGAATCTGTGCGGGACCACG | 10 | 16 | 8 | 29 | 34 | 30 |
| 833 | 564 | 40100 | 79.1 | TCGTCGAAACCTTCCCGGACCTGT | 10 | 16 | 23 | 28 | 34 | 14 |
| 834 | 565 | 13712 | 76.4 | TCGTCGAAAGGAATCGGATGGATG | 10 | 16 | 25 | 24 | 27 | 27 |
| 835 | 566 | 2407 | 80.2 | TCGTCGAAGTGCGCAATCCCAGTG | 10 | 16 | 33 | 21 | 28 | 22 |
| 836 | 567 | 2413 | 77.5 | TCGTGCTTCTCAGACCTGCGAGGA | 10 | 17 | 13 | 32 | 29 | 25 |
| 837 | 568 | 2429 | 78.6 | TCGTGGTAAGCCCACGGAGTCAGC | 10 | 18 | 36 | 30 | 20 | 31 |
| 838 | 569 | 2431 | 80.4 | TCGTGTCTCGTTTCCCACGGAGCC | 10 | 19 | 12 | 28 | 35 | 36 |
| 839 | 570 | 13723 | 82.3 | TCGTGTCTGCAAAGCCAGCCGTGC | 10 | 19 | 21 | 36 | 36 | 33 |
| 840 | 571 | 2435 | 81.1 | TCGTGTCTGTGCATCGTGCGGGAC | 10 | 19 | 33 | 24 | 29 | 34 |
| 841 | 572 | 2436 | 79.5 | TCGTGAGTTCGTCAGCGGACGACC | 10 | 20 | 10 | 31 | 34 | 32 |
| 842 | 573 | 20241 | 78.4 | TCGTGAGTCCATTGCGGTCTTCCC | 10 | 20 | 15 | 29 | 19 | 28 |
| 843 | 574 | 40102 | 77.8 | TCGTGCAATTGATGTCGTGCATCG | 10 | 21 | 1 | 9 | 33 | 24 |
| 844 | 575 | 2447 | 76.7 | TCGTGCAAGCTTCTTGGATGGACC | 10 | 21 | 17 | 11 | 27 | 32 |
| 845 | 576 | 2452 | 81.2 | TCGTGCAATGCGGTGCTCGTTCTG | 10 | 21 | 29 | 33 | 10 | 8 |
| 846 | 577 | 2454 | 77.2 | TCGTGCAAGGACAGCCTCGTTGAT | 10 | 21 | 34 | 36 | 10 | 2 |
| 847 | 578 | 2457 | 79.1 | TCGTAGTGTGCGGGTAACGGGTGC | 10 | 22 | 29 | 18 | 35 | 33 |
| 848 | 579 | 2459 | 81 | TCGTAGTGGTGCGATGGTGCGTGC | 10 | 22 | 33 | 27 | 33 | 33 |
| 849 | 580 | 2469 | 80.3 | TCGTACCTCAGCACGGACGGGGAC | 10 | 23 | 31 | 35 | 35 | 34 |
| 850 | 583 | 13733 | 75.5 | TCGTATCGGCTTATCGCACGTGTC | 10 | 24 | 17 | 24 | 30 | 9 |
| 851 | 584 | 2485 | 79.8 | TCGTATCGGGACGACCTCCCAGGA | 10 | 24 | 34 | 32 | 28 | 25 |
| 852 | 585 | 20255 | 75.4 | TCGTAGGAGACCTCTGAGCCAGCC | 10 | 25 | 32 | 8 | 36 | 36 |
| 853 | 586 | 2491 | 78.3 | TCGTAGGAAGCCCCATCCATGTGC | 10 | 25 | 36 | 15 | 15 | 33 |
| 854 | 587 | 20256 | 78.8 | TCGTCCTAAAAGTGCGTGCGAGCC | 10 | 26 | 6 | 29 | 29 | 36 |
| 855 | 590 | 2516 | 80.8 | TCGTGATGAGCCGCAACAGCCTCA | 10 | 27 | 36 | 21 | 31 | 13 |
| 856 | 592 | 13744 | 75.6 | TCGTTCCCTGTTTAGCGAAAGGA | 10 | 28 | 14 | 3 | 16 | 25 |
| 857 | 593 | 40104 | 77 | TCGTTCCCCATAAAGGTGCACCT | 10 | 28 | 15 | 6 | 33 | 23 |
| 858 | 594 | 2528 | 77.2 | TCGTTCCCGTCTGCAACCTAGCAA | 10 | 28 | 19 | 21 | 26 | 21 |
| 859 | 595 | 40106 | 78.8 | TCGTTCCCGAGTCCATCTTGGCAA | 10 | 28 | 20 | 15 | 11 | 21 |
| 860 | 598 | 13745 | 79.4 | TCGTTCCCTGCGTCGTACGGTCTG | 10 | 28 | 29 | 10 | 35 | 8 |
| 861 | 600 | 30130 | 80.8 | TCGTTCCCGGACTGTCGTGCCTGT | 10 | 28 | 34 | 9 | 33 | 14 |
| 862 | 601 | 13747 | 77.7 | TCGTTCGCGAATCAATCGCAACCAT | 10 | 29 | 4 | 4 | 21 | 15 |
| 863 | 603 | 30132 | 78.4 | TCGTTCGCGTCGTAGTGGAGTTGCG | 10 | 29 | 10 | 22 | 20 | 29 |
| 864 | 604 | 13748 | 78.3 | TCGTTCGCGCTCATTGATGCGAATC | 10 | 29 | 13 | 1 | 29 | 4 |
| 865 | 605 | 30133 | 79.3 | TCGTTCGCGGAGTGGTAGACCCACG | 10 | 29 | 20 | 18 | 32 | 30 |
| 866 | 607 | 2550 | 76.2 | TCGTTGCGAGTGAAAGCGAATTGA | 10 | 29 | 22 | 6 | 16 | 1 |
| 867 | 608 | 30134 | 80.2 | TCGTTGCGGATGGGTAGGACAGCC | 10 | 29 | 27 | 18 | 34 | 36 |

FIG. 25R

| SEQ ID NO: | 4,633 ID# | HEX ID# | Tm | ZIPCODE (5'-3') | TETRAMER NUMBERS | | | | |
|---|---|---|---|---|---|---|---|---|---|
| 868 | 611 | 2558 | 81.4 | TCGTTGCGCAGCTGTCCACGTCTG | 10 | 29 | 31 | 9 | 30 | 8 |
| 869 | 612 | 2559 | 80.1 | TCGTTGCGGACCAAAGGTGCAGTG | 10 | 29 | 32 | 6 | 33 | 22 |
| 870 | 614 | 2561 | 78.8 | TCGTTGCGAGCCAATCTCGTAGCC | 10 | 29 | 36 | 4 | 10 | 36 |
| 871 | 615 | 20265 | 75.6 | TCGTCACGAAAGATACACGGCAGC | 10 | 30 | 6 | 5 | 35 | 31 |
| 872 | 616 | 2564 | 81.5 | TCGTCACGTCTGTCCCTGCGAGCC | 10 | 30 | 8 | 28 | 29 | 36 |
| 873 | 617 | 2565 | 79.7 | TCGTCACGCTTGCTCACAGCTCCC | 10 | 30 | 11 | 13 | 31 | 28 |
| 874 | 618 | 13749 | 77.9 | TCGTCACGCGTTTCTGGGTAGCAA | 10 | 30 | 12 | 8 | 18 | 21 |
| 875 | 619 | 30135 | 76 | TCGTCACGCTGTAGCCCCTAGGAC | 10 | 30 | 14 | 36 | 26 | 34 |
| 876 | 620 | 2569 | 78.9 | TCGTCACGCCATGATGGATGCTTG | 10 | 30 | 15 | 27 | 27 | 11 |
| 877 | 621 | 2574 | 77.3 | TCGTCACGGCAATACAGACCGGAC | 10 | 30 | 21 | 7 | 32 | 34 |
| 878 | 622 | 20267 | 75.7 | TCGTCACGAGTGAAAGGCTTGTGC | 10 | 30 | 22 | 6 | 17 | 33 |
| 879 | 623 | 13751 | 77.9 | TCGTCACGATCGTCTGACGGCCTA | 10 | 30 | 24 | 8 | 35 | 26 |
| 880 | 624 | 2580 | 81.5 | TCGTCACGACGGGATGACGGTCGT | 10 | 30 | 35 | 27 | 35 | 10 |
| 881 | 625 | 2585 | 77.3 | TCGTCAGCCTCATGTCAGCCGTCT | 10 | 31 | 13 | 9 | 36 | 19 |
| 882 | 626 | 2587 | 79.4 | TCGTCAGCCCATGACCTGTCAGCC | 10 | 31 | 15 | 32 | 9 | 36 |
| 883 | 627 | 40109 | 76.2 | TCGTCAGCGGTATTGAGGACCGTT | 10 | 31 | 18 | 1 | 34 | 12 |
| 884 | 628 | 30137 | 78.8 | TCGTCAGCGAGTAGTGCAGCGTGC | 10 | 31 | 20 | 22 | 31 | 33 |
| 885 | 630 | 13756 | 80.5 | TCGTCAGCGACCGAGTTCGTTCCC | 10 | 31 | 32 | 20 | 10 | 28 |
| 886 | 631 | 2601 | 80 | TCGTGACCAATCCGTTGGACTGCG | 10 | 32 | 4 | 12 | 34 | 29 |
| 887 | 632 | 2602 | 79.6 | TCGTGACCAAAGCTTGAGCCGTGC | 10 | 32 | 6 | 11 | 36 | 33 |
| 888 | 633 | 40110 | 76.5 | TCGTGACCCGTTACCTTCTGACGG | 10 | 32 | 12 | 23 | 8 | 35 |
| 889 | 634 | 40111 | 78.3 | TCGTGACCCTGTTTGAAGCCGCTT | 10 | 32 | 14 | 1 | 36 | 17 |
| 890 | 635 | 30138 | 78.4 | TCGTGACCGCTTCCATGAGTTCCC | 10 | 32 | 17 | 15 | 20 | 28 |
| 891 | 636 | 30139 | 82.1 | TCGTGACCGTCTCGGACGTGCGACC | 10 | 32 | 19 | 34 | 33 | 32 |
| 892 | 637 | 40112 | 78.1 | TCGTGACCATCGTCGTAGGATGCG | 10 | 32 | 24 | 10 | 25 | 29 |
| 893 | 639 | 2614 | 76.4 | TCGTGTGCAATCTCTGCCATCAGC | 10 | 33 | 4 | 8 | 15 | 31 |
| 894 | 640 | 2615 | 80.8 | TCGTGTGCTCTGCCATAGCCGCAA | 10 | 33 | 8 | 15 | 36 | 21 |
| 895 | 641 | 2616 | 80.9 | TCGTGTGCTGTCGCAATCCCGATG | 10 | 33 | 9 | 21 | 28 | 27 |
| 896 | 642 | 30141 | 78.3 | TCGTGTGCCTTGATACCACGCAGC | 10 | 33 | 11 | 5 | 30 | 31 |
| 897 | 643 | 20269 | 76.2 | TCGTGTGCCTGTGCTTCCATATCG | 10 | 33 | 14 | 17 | 15 | 24 |
| 898 | 645 | 20270 | 79.1 | TCGTGTGCGGTAACCTACGGACGG | 10 | 33 | 18 | 23 | 35 | 35 |
| 899 | 646 | 2626 | 78.8 | TCGTGTGCGTCTGGACAGTGCGTT | 10 | 33 | 19 | 34 | 22 | 12 |
| 900 | 647 | 2627 | 78.6 | TCGTGTGCGAGTCACGAGGAGTGC | 10 | 33 | 20 | 30 | 25 | 33 |
| 901 | 648 | 2628 | 77.9 | TCGTGTGCGCAAAAGAGCCTCTG | 10 | 33 | 21 | 6 | 36 | 8 |
| 902 | 651 | 2637 | 80.8 | TCGTGGACTTGATCCCTGCGCGTT | 10 | 34 | 1 | 28 | 29 | 12 |
| 903 | 652 | 2638 | 80.6 | TCGTGGACAATCCAGCGACCCGTT | 10 | 34 | 4 | 31 | 32 | 12 |
| 904 | 653 | 2639 | 79.8 | TCGTGGACAAAGGCAAGTGCCGAA | 10 | 34 | 6 | 21 | 33 | 16 |
| 905 | 654 | 20272 | 78.4 | TCGTGGACCTTGGACCGTCTACGG | 10 | 34 | 11 | 32 | 19 | 35 |
| 906 | 655 | 40114 | 76.8 | TCGTGGACCTGTTGCGCCTAAAAG | 10 | 34 | 14 | 29 | 26 | 6 |
| 907 | 656 | 40115 | 79.4 | TCGTGGACGAGTTCTGGTGCGACC | 10 | 34 | 20 | 8 | 33 | 32 |
| 908 | 658 | 13764 | 78.8 | TCGTGGACGATGCCTACAGCCCAT | 10 | 34 | 27 | 26 | 31 | 15 |
| 909 | 659 | 13765 | 77.5 | TCGTGGACTCCCTCCCATACAGCC | 10 | 34 | 28 | 28 | 5 | 36 |
| 910 | 660 | 2653 | 81.4 | TCGTGGACTGCGGTGCCTCAGACC | 10 | 34 | 29 | 33 | 13 | 32 |
| 911 | 661 | 40117 | 77.7 | TCGTGGACCACGTTAGATCGGCAA | 10 | 34 | 30 | 3 | 24 | 21 |
| 912 | 662 | 2658 | 79.7 | TCGTGGACAGCCCCATAGTGCGAA | 10 | 34 | 36 | 15 | 22 | 16 |
| 913 | 664 | 30143 | 77.1 | TCGTACGGTCGTTCTGATCGCGTT | 10 | 35 | 10 | 8 | 24 | 12 |
| 914 | 665 | 13771 | 78.3 | TCGTACGGCCATGGTATCGTCAA | 10 | 35 | 15 | 18 | 10 | 21 |
| 915 | 666 | 40118 | 76.7 | TCGTACGGCCTAATCGCTCAATCG | 10 | 35 | 26 | 24 | 13 | 24 |
| 916 | 668 | 2677 | 75.5 | TCGTAGCCTTGACAGCGCAACCTA | 10 | 36 | 1 | 31 | 21 | 26 |
| 917 | 669 | 2681 | 78.8 | TCGTAGCCTGTCGGTAAGCCTGCG | 10 | 36 | 9 | 18 | 36 | 29 |
| 918 | 670 | 13779 | 75 | TCGTAGCCTCGTAGGACTGTTGCG | 10 | 36 | 10 | 25 | 14 | 29 |

FIG. 25S

| SEQ ID NO: | 4,633 ID# | HEX ID# | Tm | ZIPCODE (5'-3') | TETRAMER NUMBERS | | | | |
|---|---|---|---|---|---|---|---|---|---|
| 919 | 671 | 13780 | 77.5 | TCGTAGCCCGTTTCTGTTGATGCG | 10 | 36 | 12 | 8 | 1 | 29 |
| 920 | 672 | 13781 | 77.8 | TCGTAGCCCCATGAGTGACCCCAT | 10 | 36 | 15 | 20 | 32 | 15 |
| 921 | 673 | 30148 | 78.6 | TCGTAGCCTGCGATACTCCCCACG | 10 | 36 | 29 | 5 | 28 | 30 |
| 922 | 674 | 2696 | 78 | CTTGTTGAAGCCGACCGGTAACGG | 11 | 1 | 36 | 32 | 18 | 35 |
| 923 | 675 | 2703 | 81.4 | CTTGAATCGACCACGGGTGCACGG | 11 | 4 | 32 | 35 | 33 | 35 |
| 924 | 676 | 2709 | 79.9 | CTTGAAAGTCCCGGACCGAATGCG | 11 | 6 | 28 | 34 | 16 | 29 |
| 925 | 677 | 2719 | 78.9 | CTTGTCTGCACGGACCCCTATGCG | 11 | 8 | 30 | 32 | 26 | 29 |
| 926 | 680 | 20288 | 75.6 | CTTGCTTGACCTGCAAACGGTTGA | 11 | 11 | 23 | 21 | 35 | 1 |
| 927 | 681 | 2735 | 75.4 | CTTGCTTGATCGTTAGTGCGACGG | 11 | 11 | 24 | 3 | 29 | 35 |
| 928 | 682 | 40122 | 77.8 | CTTGCTTGCCTACTTGCACGGCAA | 11 | 11 | 26 | 11 | 30 | 21 |
| 929 | 683 | 2737 | 79.3 | CTTGCTTGGATGGGACATCGCGAA | 11 | 11 | 27 | 34 | 24 | 16 |
| 930 | 684 | 30149 | 78.1 | CTTGCGTTTTGAAGCCGGTAACGG | 11 | 12 | 1 | 36 | 18 | 35 |
| 931 | 685 | 13804 | 77.7 | CTTGCGTTACCTTGCGGACCACCT | 11 | 12 | 23 | 29 | 32 | 23 |
| 932 | 687 | 2767 | 78.3 | CTTGCTCACACGGGACAGGAAGCC | 11 | 13 | 30 | 34 | 25 | 36 |
| 933 | 688 | 2769 | 81.9 | CTTGCTCAGTGCCAGCGACCACGG | 11 | 13 | 33 | 31 | 32 | 35 |
| 934 | 689 | 40125 | 78 | CTTGCTGTGCAAGTGCCGTTACGG | 11 | 14 | 21 | 33 | 12 | 35 |
| 935 | 690 | 30151 | 79 | CTTGCCATCCATCACGGCAACCAT | 11 | 15 | 15 | 30 | 21 | 15 |
| 936 | 691 | 30152 | 77.2 | CTTGCCATGCTTAGTGGTGCAGCC | 11 | 15 | 17 | 22 | 33 | 36 |
| 937 | 693 | 30153 | 76.6 | CTTGCGAATTGAATCGGTGCCCTA | 11 | 16 | 1 | 24 | 33 | 26 |
| 938 | 694 | 40127 | 75 | CTTGCGAAGCTTCCTAGGACGCTT | 11 | 16 | 17 | 26 | 34 | 17 |
| 939 | 696 | 2811 | 76.9 | CTTGGCTTCCATCACGTCCCAGTG | 11 | 17 | 15 | 30 | 28 | 22 |
| 940 | 697 | 2813 | 79.2 | CTTGGCTTGTCTTCCCGACCGGAC | 11 | 17 | 19 | 28 | 32 | 34 |
| 941 | 698 | 40128 | 79.3 | CTTGGCTTCAGCGGACCTGTTCCC | 11 | 17 | 31 | 34 | 14 | 28 |
| 942 | 699 | 30155 | 78.1 | CTTGGCTTGTGCCTTGCTTGGCTT | 11 | 17 | 33 | 11 | 11 | 17 |
| 943 | 700 | 40129 | 77.9 | CTTGGCTTACGGCGTTAGCCAGGA | 11 | 17 | 35 | 12 | 36 | 25 |
| 944 | 701 | 2828 | 75.3 | CTTGGTCTTCGTCCTATCCCACGG | 11 | 19 | 10 | 26 | 28 | 35 |
| 945 | 702 | 20300 | 78.3 | CTTGGTCTCACGGCAAGACCCAGC | 11 | 19 | 30 | 21 | 32 | 31 |
| 946 | 703 | 40132 | 76.8 | CTTGGCAAGCTTTGATTCCCCCAT | 11 | 21 | 17 | 2 | 28 | 15 |
| 947 | 704 | 2847 | 77.2 | CTTGGCAAGAGTGGACAGGATGCG | 11 | 21 | 20 | 34 | 25 | 29 |
| 948 | 705 | 30156 | 76.1 | CTTGGCAAACCTTTAGCACGCGTT | 11 | 21 | 23 | 3 | 30 | 12 |
| 949 | 706 | 30157 | 75.2 | CTTGGCAAATCGAAAGGATGGCTT | 11 | 21 | 24 | 6 | 27 | 17 |
| 950 | 707 | 40133 | 77.1 | CTTGGCAAAGGAAGCCCTGTTCGT | 11 | 21 | 25 | 36 | 14 | 10 |
| 951 | 708 | 30158 | 82.7 | CTTGGCAAGACCAGCCGTGCGACC | 11 | 21 | 32 | 36 | 33 | 32 |
| 952 | 709 | 2858 | 77.2 | CTTGAGTGCGAAGACCATCGACGG | 11 | 22 | 16 | 32 | 24 | 35 |
| 953 | 710 | 2866 | 81.3 | CTTGACCTGTGCGGACAGCCCGAA | 11 | 23 | 33 | 34 | 36 | 16 |
| 954 | 712 | 30159 | 78.4 | CTTGAGGATGCGACCTCAGCGGAC | 11 | 25 | 29 | 23 | 31 | 34 |
| 955 | 713 | 2881 | 80.6 | CTTGAGGACACGAGCCCAGCCGAA | 11 | 25 | 30 | 36 | 31 | 16 |
| 956 | 714 | 13849 | 75.2 | CTTGCCTAATCGAGGATGCGGTCT | 11 | 26 | 24 | 25 | 29 | 19 |
| 957 | 715 | 13852 | 75.7 | CTTGCCTAACGGTCCCAATCCTCA | 11 | 26 | 35 | 28 | 4 | 13 |
| 958 | 716 | 20309 | 75 | CTTGGATGTCGTGACCAGCCTCTG | 11 | 27 | 10 | 32 | 36 | 8 |
| 959 | 717 | 13853 | 78.8 | CTTGGATGCTTGCAGCAGCCCCTA | 11 | 27 | 11 | 31 | 36 | 26 |
| 960 | 718 | 2898 | 76.7 | CTTGGATGCGTTGCTTGACCGAGT | 11 | 27 | 12 | 17 | 32 | 20 |
| 961 | 719 | 2899 | 77.6 | CTTGGATGCTGTTCGTCAGCCGAA | 11 | 27 | 14 | 10 | 31 | 16 |
| 962 | 720 | 30160 | 77.9 | CTTGGATGGCAAAGCCGAGTGCTT | 11 | 27 | 21 | 36 | 20 | 17 |
| 963 | 722 | 2910 | 76.8 | CTTGTCCCCTGTCTTGAGCCCCAT | 11 | 28 | 14 | 11 | 36 | 15 |
| 964 | 723 | 2921 | 78.6 | CTTGTCCCACGGGCAATTGAATCG | 11 | 28 | 35 | 21 | 1 | 24 |
| 965 | 724 | 2926 | 81.8 | CTTGTGCGTGTCCAGCGTGCTCCC | 11 | 29 | 9 | 31 | 33 | 28 |
| 966 | 725 | 13864 | 78.1 | CTTGTGCGTCGTTTGACAGCCAGC | 11 | 29 | 10 | 1 | 31 | 31 |
| 967 | 728 | 2938 | 80.4 | CTTGTGCGTGCGCCATTCTGCTGT | 11 | 29 | 29 | 15 | 8 | 14 |
| 968 | 729 | 2940 | 79 | CTTGTGCGCAGCAGTGCACGAATC | 11 | 29 | 31 | 22 | 30 | 4 |
| 969 | 730 | 13871 | 77.2 | CTTGCACGAATCTCTGGACCGTGC | 11 | 30 | 4 | 8 | 32 | 33 |

FIG. 25T

| SEQ ID NO: | 4,633 ID# | HEX ID# | Tm | ZIPCODE (5'-3') | TETRAMER NUMBERS | | | | |
|---|---|---|---|---|---|---|---|---|---|
| 970 | 732 | 2947 | 75.8 | CTTGCACGCTTGTTGAGCAATCGT | 11 | 30 | 11 | 1 | 21 | 10 |
| 971 | 734 | 2951 | 79.1 | CTTGCACGAGTGGCAAAGCCCTTG | 11 | 30 | 22 | 21 | 36 | 11 |
| 972 | 735 | 40137 | 76.6 | CTTGCACGAGGACCTACACGCCAT | 11 | 30 | 25 | 26 | 30 | 15 |
| 973 | 736 | 2959 | 76.4 | CTTGCAGCTGATACGGGCAAGGAC | 11 | 31 | 2 | 35 | 21 | 34 |
| 974 | 737 | 2960 | 80 | CTTGCAGCAATCGTGCATCGAGCC | 11 | 31 | 4 | 33 | 24 | 36 |
| 975 | 738 | 30162 | 76.8 | CTTGCAGCCTCAGGTATCCCCCAT | 11 | 31 | 13 | 18 | 28 | 15 |
| 976 | 739 | 13879 | 78 | CTTGCAGCGGTAATCGTGCGTGTC | 11 | 31 | 18 | 24 | 29 | 9 |
| 977 | 740 | 13880 | 75.3 | CTTGCAGCGTCTAAAGACGGCTCA | 11 | 31 | 19 | 6 | 35 | 13 |
| 978 | 741 | 13883 | 77.4 | CTTGCAGCGACCTACAGTGCCAGC | 11 | 31 | 32 | 7 | 33 | 31 |
| 979 | 742 | 2979 | 78.4 | CTTGGACCTTGAGACCACGGGCAA | 11 | 32 | 1 | 32 | 35 | 21 |
| 980 | 743 | 40139 | 77.2 | CTTGGACCAGGACCTAACGGACGG | 11 | 32 | 25 | 26 | 35 | 35 |
| 981 | 744 | 20324 | 76.7 | CTTGGACCGGACCCTAGATGCCAT | 11 | 32 | 34 | 26 | 27 | 15 |
| 982 | 745 | 30163 | 76.3 | CTTGGTGCGGTACTCAAGCCCTTG | 11 | 33 | 18 | 13 | 36 | 11 |
| 983 | 746 | 40140 | 80.3 | CTTGGTGCGTCTTCGTGTGCCGAA | 11 | 33 | 19 | 10 | 33 | 16 |
| 984 | 747 | 13893 | 75.8 | CTTGGTGCGAGTAATCGACCCGTT | 11 | 33 | 20 | 4 | 32 | 12 |
| 985 | 748 | 20327 | 78.4 | CTTGGTGCGGACTCTGTGCGTTGA | 11 | 33 | 34 | 8 | 29 | 1 |
| 986 | 750 | 30165 | 76.8 | CTTGGGACATCGAGGAGCTTGCAA | 11 | 34 | 24 | 25 | 17 | 21 |
| 987 | 751 | 3019 | 78.6 | CTTGGGACGACCCGTTGCTTCTCA | 11 | 34 | 32 | 12 | 17 | 13 |
| 988 | 752 | 40142 | 77.6 | CTTGACGGGAGTAGCCACGGGGTA | 11 | 35 | 20 | 36 | 35 | 18 |
| 989 | 754 | 13905 | 77.6 | CTTGACGGACCTCACGGACCCTGT | 11 | 35 | 23 | 30 | 32 | 14 |
| 990 | 755 | 30166 | 77.4 | CTTGACGGAGGATCGTAGCCGGAC | 11 | 35 | 25 | 10 | 36 | 34 |
| 991 | 756 | 13906 | 77.9 | CTTGACGGGATGGGTAAGGATGCG | 11 | 35 | 27 | 18 | 25 | 29 |
| 992 | 757 | 3036 | 76.8 | CTTGAGCCTTGACTCATCCCGCAA | 11 | 36 | 1 | 13 | 28 | 21 |
| 993 | 758 | 3037 | 78.5 | CTTGAGCCTGATAGCCTGCGACGG | 11 | 36 | 2 | 36 | 29 | 35 |
| 994 | 761 | 13910 | 78.2 | CTTGAGCCGAGTGTGCTGATTGCG | 11 | 36 | 20 | 33 | 2 | 29 |
| 995 | 763 | 3053 | 75.4 | CTTGAGCCTCCCTGATCCATACGG | 11 | 36 | 28 | 2 | 15 | 35 |
| 996 | 764 | 13912 | 79.1 | CTTGAGCCCAGCGGACTACATGCG | 11 | 36 | 31 | 34 | 7 | 29 |
| 997 | 765 | 20336 | 77.6 | CTTGAGCCGGACGAGTTCGTAGCC | 11 | 36 | 34 | 20 | 10 | 36 |
| 998 | 766 | 30168 | 79.2 | CGTTTTGAATCGGGACGTGCAGGA | 12 | 1 | 24 | 34 | 33 | 25 |
| 999 | 767 | 13918 | 80.8 | CGTTTGATCACGCTCATGCGCAGC | 12 | 2 | 30 | 13 | 29 | 31 |
| 1000 | 768 | 13920 | 75 | CGTTTTAGGCAAGATGGGACCGTT | 12 | 3 | 21 | 27 | 34 | 12 |
| 1001 | 769 | 40145 | 75.4 | CGTTAATCGCAAGCTTTGTCGTGC | 12 | 4 | 21 | 17 | 9 | 33 |
| 1002 | 770 | 3086 | 79.7 | CGTTAATCTCCCCACGTCCCGTGC | 12 | 4 | 28 | 30 | 28 | 33 |
| 1003 | 771 | 40146 | 78.2 | CGTTAATCCACGCTCAAGCCAGCC | 12 | 4 | 30 | 13 | 36 | 36 |
| 1004 | 772 | 30172 | 76.3 | CGTAAAGCCATTCCCAAAGCACG | 12 | 6 | 15 | 28 | 6 | 30 |
| 1005 | 774 | 3109 | 75 | CGTTTCTGCGTTGGTAAGGAGCAA | 12 | 8 | 12 | 18 | 25 | 21 |
| 1006 | 775 | 13938 | 75.1 | CGTTTCTGGCAATTAGCTTGCGAA | 12 | 8 | 21 | 3 | 11 | 16 |
| 1007 | 776 | 30174 | 77.9 | CGTTTCTGGGACAATCGCAATCCC | 12 | 8 | 34 | 4 | 21 | 28 |
| 1008 | 777 | 3121 | 78.4 | CGTTTCTGAGCCGGACAGCCAAAG | 12 | 8 | 36 | 34 | 36 | 6 |
| 1009 | 778 | 40147 | 78.5 | CGTTTGTCCCATCACGTGTCTGCG | 12 | 9 | 15 | 30 | 9 | 29 |
| 1010 | 779 | 3127 | 79.6 | CGTTTGTCGTCTTGCGGGTATGCG | 12 | 9 | 19 | 29 | 18 | 29 |
| 1011 | 780 | 3129 | 79.6 | CGTTTGTCATCGCGTTCACGTCCC | 12 | 9 | 24 | 12 | 30 | 28 |
| 1012 | 781 | 3131 | 77.7 | CGTTTGTCGATGCCATACCTTGCG | 12 | 9 | 27 | 15 | 23 | 29 |
| 1013 | 782 | 20344 | 76.1 | CGTTTCGTAAAGCGAATGCGACCT | 12 | 10 | 6 | 16 | 29 | 23 |
| 1014 | 783 | 30177 | 76.9 | CGTTTCGTGGTAACGGCGTTATCG | 12 | 10 | 18 | 35 | 12 | 24 |
| 1015 | 785 | 40148 | 76 | CGTTTCGTACGGAAAGCTTGCCAT | 12 | 10 | 35 | 6 | 11 | 15 |
| 1016 | 786 | 40149 | 80.2 | CGTTCTTGCAGCCGTTCCATGCAA | 12 | 11 | 31 | 12 | 15 | 21 |
| 1017 | 787 | 30179 | 76.9 | CGTTCGTTTTGAGCAATCCCATCG | 12 | 12 | 1 | 21 | 28 | 24 |
| 1018 | 788 | 3159 | 78 | CGTTCGTTAAAGACGGTCCCGTGC | 12 | 12 | 6 | 35 | 28 | 33 |
| 1019 | 789 | 40151 | 76.4 | CGTTCGTTCGAAAAGAGGATGCG | 12 | 12 | 16 | 6 | 25 | 29 |
| 1020 | 790 | 3165 | 80.4 | CGTTCGTTGTCTTGCGTGCGCTGT | 12 | 12 | 19 | 29 | 29 | 14 |

FIG. 25U

| SEQ ID NO: | 4,633 ID# | HEX ID# | Tm | ZIPCODE (5'-3') | TETRAMER NUMBERS | | | | |
|---|---|---|---|---|---|---|---|---|---|
| 1021 | 791 | 13963 | 81.1 | CGTTCTCAATCGGACCCACGCGAA | 12 | 13 | 24 | 32 | 30 | 16 |
| 1022 | 792 | 3182 | 78 | CGTTCTCAACGGGACCCTTGATCG | 12 | 13 | 35 | 32 | 11 | 24 |
| 1023 | 793 | 3183 | 76.2 | CGTTCTGTTCGTAGGAACGGACGG | 12 | 14 | 10 | 25 | 35 | 35 |
| 1024 | 794 | 3190 | 80.7 | CGTTCCATTGTCGACCAGCCCAGC | 12 | 15 | 9 | 32 | 36 | 31 |
| 1025 | 795 | 13969 | 77.7 | CGTTCCATCCATCGAACTGTTGCG | 12 | 15 | 15 | 16 | 14 | 29 |
| 1026 | 796 | 13970 | 79.3 | CGTTCCATATCGCCATTGCGGATG | 12 | 15 | 24 | 15 | 29 | 27 |
| 1027 | 797 | 3201 | 77 | CGTTCCATGATGTGATCAGCGCAA | 12 | 15 | 27 | 2 | 31 | 21 |
| 1028 | 798 | 3202 | 78 | CGTTCCATGACCAATCGATGCGAA | 12 | 15 | 32 | 4 | 27 | 16 |
| 1029 | 799 | 3203 | 78.3 | CGTTCCATGGACGCAAACCTCGTT | 12 | 15 | 34 | 21 | 23 | 12 |
| 1030 | 800 | 20357 | 75.9 | CGTTCCATACGGAGCCTCTGAGGA | 12 | 15 | 35 | 36 | 8 | 25 |
| 1031 | 801 | 30185 | 76.8 | CGTTCGAATCGTAGCCGATGCTGT | 12 | 16 | 10 | 36 | 27 | 14 |
| 1032 | 802 | 13972 | 79 | CGTTCGAACTTGCACGGCTTGACC | 12 | 16 | 11 | 30 | 17 | 32 |
| 1033 | 803 | 3210 | 77 | CGTTCGAACTCAGATGTCCCGTGC | 12 | 16 | 13 | 27 | 28 | 33 |
| 1034 | 805 | 20361 | 75.5 | CGTTCGAAGAGTTGCGGCTTACCT | 12 | 16 | 20 | 29 | 17 | 23 |
| 1035 | 806 | 40152 | 76.2 | CGTTCGAAATCGTACAACGGAGCC | 12 | 16 | 24 | 7 | 35 | 36 |
| 1036 | 807 | 13977 | 80.1 | CGTTCGAAGACCGACCCACGGGTA | 12 | 16 | 32 | 32 | 30 | 18 |
| 1037 | 808 | 20363 | 78 | CGTTGCTTGTCTACGGGACGACC | 12 | 17 | 19 | 35 | 34 | 32 |
| 1038 | 812 | 3249 | 75.2 | CGTTGTCTCGTTATCGGTCTTGCG | 12 | 19 | 12 | 24 | 19 | 29 |
| 1039 | 813 | 3257 | 80.1 | CGTTGAGTTCGTGCAAACGGGCAA | 12 | 20 | 10 | 21 | 35 | 21 |
| 1040 | 814 | 3260 | 78.1 | CGTTGAGTCAGCCGAACGTTTCCC | 12 | 20 | 31 | 16 | 12 | 28 |
| 1041 | 815 | 20369 | 75.9 | CGTTGAGTGGACGATGCAGCAATC | 12 | 20 | 34 | 27 | 31 | 4 |
| 1042 | 816 | 13992 | 77.5 | CGTTGCAATGATGCTTTGCGGTCT | 12 | 21 | 2 | 17 | 29 | 19 |
| 1043 | 817 | 40155 | 77 | CGTTGCAACGAACGAAAATCGACC | 12 | 21 | 16 | 16 | 4 | 32 |
| 1044 | 818 | 30191 | 78.2 | CGTTGCAAGGTAGACCTGCGGACC | 12 | 21 | 18 | 32 | 29 | 32 |
| 1045 | 819 | 13994 | 75.2 | CGTTGCAAGAGTAAAGTGCGCGTT | 12 | 21 | 20 | 6 | 29 | 12 |
| 1046 | 820 | 30192 | 76.4 | CGTTGCAAACCTCCTAGCAAACGG | 12 | 21 | 23 | 26 | 21 | 35 |
| 1047 | 821 | 20374 | 75.3 | CGTTGCAACAGCACCTCTGTAGCC | 12 | 21 | 31 | 23 | 14 | 36 |
| 1048 | 822 | 3277 | 77.8 | CGTTGCAAAGCCGCTTTACAGCAA | 12 | 21 | 36 | 17 | 7 | 21 |
| 1049 | 823 | 3281 | 77.9 | CGTTAGTGCACGGGACACCTTCCC | 12 | 22 | 30 | 34 | 23 | 28 |
| 1050 | 824 | 14003 | 80.7 | CGTTAGTGCAGCCAGCGGACGCTT | 12 | 22 | 31 | 31 | 34 | 17 |
| 1051 | 825 | 14004 | 80.9 | CGTTAGTGGTGCCACGGACCCGAA | 12 | 22 | 33 | 30 | 32 | 16 |
| 1052 | 826 | 3291 | 80.2 | CGTTACCTGACCTGCGCGTTGCAA | 12 | 23 | 32 | 29 | 12 | 21 |
| 1053 | 827 | 14013 | 79.3 | CGTTATCGCTGTCAGCGTGCCCAT | 12 | 24 | 14 | 31 | 33 | 15 |
| 1054 | 828 | 30193 | 76.3 | CGTTATCGGGTATCGTGACCCGAA | 12 | 24 | 18 | 10 | 32 | 16 |
| 1055 | 829 | 40156 | 77 | CGTTATCGGACCTCTGGGACGCTT | 12 | 24 | 32 | 8 | 34 | 17 |
| 1056 | 830 | 3309 | 76 | CGTTAGGATGCGTACAGTGCGTGC | 12 | 25 | 29 | 7 | 33 | 33 |
| 1057 | 831 | 14021 | 77.5 | CGTTAGGAAGCCGGTAGGACTGCG | 12 | 25 | 36 | 18 | 34 | 29 |
| 1058 | 833 | 30194 | 76.1 | CGTTGATGCGTTAATCGGACTCCC | 12 | 27 | 12 | 4 | 34 | 28 |
| 1059 | 834 | 14032 | 79.2 | CGTTGATGGACCGTGCCCTAGCAA | 12 | 27 | 32 | 33 | 26 | 21 |
| 1060 | 835 | 40157 | 81 | CGTTGATGGGACGACCCACGAGGA | 12 | 27 | 34 | 32 | 30 | 25 |
| 1061 | 839 | 3356 | 78.6 | CGTTTCCCAGTGGGTACACGGTGC | 12 | 28 | 22 | 18 | 30 | 33 |
| 1062 | 840 | 40160 | 76.3 | CGTTTCCCCCTAAATCCCATCAGC | 12 | 28 | 26 | 4 | 15 | 31 |
| 1063 | 841 | 3361 | 77.3 | CGTTCCCTCCCTCGTCGAAGATG | 12 | 28 | 28 | 10 | 16 | 27 |
| 1064 | 842 | 14040 | 80.9 | CGTTTCCCTGCGCCATGGTACGAA | 12 | 28 | 29 | 15 | 18 | 16 |
| 1065 | 845 | 40162 | 78.5 | CGTTTGCGATACAGCCTCCCCTCA | 12 | 29 | 5 | 36 | 28 | 13 |
| 1066 | 846 | 40164 | 79.9 | CGTTTGCGCGAATGCGTTAGCTTG | 12 | 29 | 16 | 29 | 3 | 11 |
| 1067 | 847 | 20392 | 80.7 | CGTTTGCGGCTTGTGCCTCAGCTT | 12 | 29 | 17 | 33 | 13 | 17 |
| 1068 | 848 | 40165 | 78.3 | CGTTTGCGGTCTTACACACGCGAA | 12 | 29 | 19 | 7 | 30 | 16 |
| 1069 | 849 | 14044 | 76.9 | CGTTTGCGAGGAATCGTTAGCGAA | 12 | 29 | 25 | 24 | 3 | 16 |
| 1070 | 850 | 3381 | 79.3 | CGTTTGCGGATGCCATGCTTGAGT | 12 | 29 | 27 | 15 | 17 | 20 |
| 1071 | 851 | 14045 | 78.5 | CGTTTGCGTCCCTTGAGCTTCAGC | 12 | 29 | 28 | 1 | 17 | 31 |

FIG. 25V

| SEQ ID NO: | 4,633 ID# | HEX ID# | Tm | ZIPCODE (5'-3') | TETRAMER NUMBERS | | | | |
|---|---|---|---|---|---|---|---|---|---|
| 1072 | 852 | 14046 | 82 | CGTTTGCGCACGCGTTGCTTTGAT | 12 | 29 | 30 | 12 | 17 | 2 |
| 1073 | 853 | 40166 | 78.2 | CGTTCACGTCGTTGTCCAGCGGTA | 12 | 30 | 10 | 9 | 31 | 18 |
| 1074 | 854 | 20396 | 76.2 | CGTTCACGCTTGTGATCCATCGAA | 12 | 30 | 11 | 2 | 15 | 16 |
| 1075 | 855 | 40167 | 78.3 | CGTTCACGCTGTCTTGTGCGGGTA | 12 | 30 | 14 | 11 | 29 | 18 |
| 1076 | 856 | 40171 | 76.1 | CGTTCACGGATGTTAGCGAATCCC | 12 | 30 | 27 | 3 | 16 | 28 |
| 1077 | 858 | 14053 | 81 | CGTTCACGCAGCGCAATCGTGGTA | 12 | 30 | 31 | 21 | 10 | 18 |
| 1078 | 859 | 20400 | 75.2 | CGTTCACGGACCAAAGTTAGTGCG | 12 | 30 | 32 | 6 | 3 | 29 |
| 1079 | 860 | 3401 | 78.7 | CGTTCACGACGGGTCTGCAAGCTT | 12 | 30 | 35 | 19 | 21 | 17 |
| 1080 | 861 | 20402 | 79.6 | CGTTCACGAGCCTCGTCACGCCTA | 12 | 30 | 36 | 10 | 30 | 26 |
| 1081 | 862 | 20403 | 75 | CGTTCAGCTCTGGACCAAAGCTCA | 12 | 31 | 8 | 32 | 6 | 13 |
| 1082 | 863 | 30197 | 77.1 | CGTTCAGCGCTTCGTTTCTGCCTA | 12 | 31 | 17 | 12 | 8 | 26 |
| 1083 | 864 | 3411 | 80.5 | CGTTCAGCCACGCAGCAGGACTCA | 12 | 31 | 30 | 31 | 25 | 13 |
| 1084 | 865 | 14060 | 78.1 | CGTTCAGCGTGCTTGAAATCGTGC | 12 | 31 | 33 | 1 | 4 | 33 |
| 1085 | 866 | 3418 | 77.8 | CGTTGACCTCTGTCCCCAGCGAGT | 12 | 32 | 8 | 28 | 31 | 20 |
| 1086 | 868 | 40173 | 77.9 | CGTTGACCCTGTCGAACGAATCCC | 12 | 32 | 14 | 16 | 16 | 28 |
| 1087 | 869 | 3424 | 75.6 | CGTTGACCATCGTTAGCACGCCTA | 12 | 32 | 24 | 3 | 30 | 26 |
| 1088 | 870 | 3426 | 78.4 | CGTTGACCTGCGCTCAGGTAAGCC | 12 | 32 | 29 | 13 | 18 | 36 |
| 1089 | 871 | 40175 | 77.8 | CGTTGACCCAGCTCCCGTCTAGGA | 12 | 32 | 31 | 28 | 19 | 25 |
| 1090 | 873 | 3435 | 81 | CGTTGTGCTGTCCTTGCAGCTGCG | 12 | 33 | 9 | 11 | 31 | 29 |
| 1091 | 874 | 20413 | 75.9 | CGTTGTGCCTTGTACACAGCGACC | 12 | 33 | 11 | 7 | 31 | 32 |
| 1092 | 875 | 30199 | 78.1 | CGTTGTGCCTCAAAAGTCCCCAGC | 12 | 33 | 13 | 6 | 28 | 31 |
| 1093 | 876 | 40177 | 78.9 | CGTTGTGCGATGTGTCGCTTCAGC | 12 | 33 | 27 | 9 | 17 | 31 |
| 1094 | 877 | 3450 | 80.6 | CGTTGTGCGACCGTCTATCGTGCG | 12 | 33 | 32 | 19 | 24 | 29 |
| 1095 | 879 | 30200 | 78.1 | CGTTGGACCGTTGGACCGAATGAT | 12 | 34 | 12 | 34 | 16 | 2 |
| 1096 | 880 | 30202 | 77.1 | CGTTGGACGGTACGAAGCTTCACG | 12 | 34 | 18 | 16 | 17 | 30 |
| 1097 | 881 | 40178 | 79.7 | CGTTGGACAGGATGTCACGGCAGC | 12 | 34 | 25 | 9 | 35 | 31 |
| 1098 | 882 | 14078 | 77.9 | CGTTGGACGGACTTGAAGTGTGCG | 12 | 34 | 34 | 1 | 22 | 29 |
| 1099 | 883 | 3463 | 80.8 | CGTTGGACACGGCCATCTGTGCAA | 12 | 34 | 35 | 15 | 14 | 21 |
| 1100 | 884 | 14079 | 76.9 | CGTTACGGTTGAACCTGGACGTGC | 12 | 35 | 1 | 23 | 34 | 33 |
| 1101 | 885 | 3465 | 77.5 | CGTTACGGAATCCTTGCACGCTCA | 12 | 35 | 4 | 11 | 30 | 13 |
| 1102 | 886 | 14080 | 77.9 | CGTTACGGAAAGGACCGACCATCG | 12 | 35 | 6 | 32 | 32 | 24 |
| 1103 | 887 | 3468 | 78 | CGTTACGGTCTGGACCGCAAGGAC | 12 | 35 | 8 | 32 | 21 | 34 |
| 1104 | 888 | 30203 | 78 | CGTTACGGCTGTCTTGTCCCGACC | 12 | 35 | 14 | 11 | 28 | 32 |
| 1105 | 889 | 3472 | 75 | CGTTACGGGAGTTTGATTGATGCG | 12 | 35 | 20 | 1 | 1 | 29 |
| 1106 | 890 | 30204 | 80.2 | CGTTACGGGATGCAGCAGTGCGAA | 12 | 35 | 27 | 31 | 22 | 16 |
| 1107 | 891 | 30205 | 77.3 | CGTTAGCCTTGAGTGCCTTGCACG | 12 | 36 | 1 | 33 | 11 | 30 |
| 1108 | 892 | 14087 | 79.2 | CGTTAGCCTGATTGCGCAGCCTTG | 12 | 36 | 2 | 29 | 31 | 11 |
| 1109 | 893 | 14097 | 77.2 | CGTTAGCCGACCTGTCATCGCTTG | 12 | 36 | 32 | 9 | 24 | 11 |
| 1110 | 894 | 3498 | 78.1 | CGTTAGCCACGGCTCAAATCGACC | 12 | 36 | 35 | 13 | 4 | 32 |
| 1111 | 895 | 3502 | 77.2 | CTCATTGAAGCCTCGTACGGTGCG | 13 | 1 | 36 | 10 | 35 | 29 |
| 1112 | 896 | 14102 | 79.4 | CTCAAATCGCTTCAGCAGCCTGCG | 13 | 4 | 17 | 31 | 36 | 29 |
| 1113 | 897 | 14106 | 79.2 | CTCAAAAGCGTTGTGCCAGCAGCC | 13 | 6 | 12 | 33 | 31 | 36 |
| 1114 | 900 | 3525 | 79.9 | CTCATGTCTGCGCAGCTGCGGTCT | 13 | 9 | 29 | 31 | 29 | 19 |
| 1115 | 902 | 3532 | 82.1 | CTCATCGTCACGGGACTGCGGCAA | 13 | 10 | 30 | 34 | 29 | 21 |
| 1116 | 903 | 20437 | 76.8 | CTCATCGTAGCCAGGAGTGCCGAA | 13 | 10 | 36 | 25 | 33 | 16 |
| 1117 | 904 | 20439 | 76.2 | CTCACTTGAGTGCGTTCGTTTGCG | 13 | 11 | 22 | 12 | 12 | 29 |
| 1118 | 905 | 20441 | 76 | CTCACGTTTCGTGACCTGTCTGCG | 13 | 12 | 10 | 32 | 9 | 29 |
| 1119 | 906 | 14112 | 78.1 | CTCACGTTACGGCGAAAGGAACGG | 13 | 12 | 35 | 16 | 25 | 35 |
| 1120 | 907 | 3546 | 81.2 | CTCACTCAACGGCGAATGCGCCAT | 13 | 13 | 35 | 16 | 29 | 15 |
| 1121 | 908 | 3547 | 79.6 | CTCACCATGCTTGGACGGACACGG | 13 | 15 | 17 | 34 | 34 | 35 |
| 1122 | 909 | 3548 | 75.7 | CTCACCATTGCGAAAGGACCCTGT | 13 | 15 | 29 | 6 | 32 | 14 |

FIG. 25W

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1123 | 910 | 14114 | 80.1 | CTCACGAAATCGATCGCAGCTGCG | 13 | 16 | 24 | 24 | 31 | 29 |
| 1124 | 911 | 3557 | 78 | CTCACGAACACGAGGAACGGTCCC | 13 | 16 | 30 | 25 | 35 | 28 |
| 1125 | 912 | 3558 | 82.6 | CTCACGAACAGCACGGCACGGTGC | 13 | 16 | 31 | 35 | 30 | 33 |
| 1126 | 913 | 30207 | 77.4 | CTCAGCAAACGGACGGAAAGGGAC | 13 | 21 | 35 | 35 | 6 | 34 |
| 1127 | 914 | 3582 | 80.1 | CTCAAGTGGTGCCGAAGTGCTGCG | 13 | 22 | 33 | 16 | 33 | 29 |
| 1128 | 915 | 3585 | 80.7 | CTCAACCTACGGTGCGGACCGTGC | 13 | 23 | 35 | 29 | 32 | 33 |
| 1129 | 916 | 20457 | 77.2 | CTCAATCGCTTGGCAAACGGTCTG | 13 | 24 | 11 | 21 | 35 | 8 |
| 1130 | 917 | 30208 | 77.4 | CTCAATCGCCATCACGCGTTTGAT | 13 | 24 | 15 | 30 | 12 | 2 |
| 1131 | 918 | 3591 | 76.5 | CTCAATCGGGTAGCTTCAGCGTGC | 13 | 24 | 18 | 17 | 31 | 33 |
| 1132 | 919 | 14129 | 78.8 | CTCAATCGACGGGTCTGGACACGG | 13 | 24 | 35 | 19 | 34 | 35 |
| 1133 | 920 | 3600 | 78.2 | CTCAAGGAGCTTCAGCCAGCCGAA | 13 | 25 | 17 | 31 | 31 | 16 |
| 1134 | 921 | 3601 | 81.6 | CTCAAGGACACGGTGCCACGACGG | 13 | 25 | 30 | 33 | 30 | 35 |
| 1135 | 922 | 14132 | 78.8 | CTCATCCCGCTTGCAACCATGACC | 13 | 28 | 17 | 21 | 15 | 32 |
| 1136 | 924 | 3624 | 80.7 | CTCATGCGAATCATCGCAGCCACG | 13 | 29 | 4 | 24 | 31 | 30 |
| 1137 | 925 | 3625 | 79 | CTCATGCGTCTGAGCCTGCGGTCT | 13 | 29 | 8 | 36 | 29 | 19 |
| 1138 | 926 | 3629 | 76.7 | CTCATGCGCTCAGGACCGTTTGAT | 13 | 29 | 13 | 34 | 12 | 2 |
| 1139 | 927 | 14135 | 76 | CTCATGCGGTCTAGCCCTTGTCGT | 13 | 29 | 19 | 36 | 11 | 10 |
| 1140 | 928 | 3637 | 77.2 | CTCATGCGTCCCCCTACCTAACGG | 13 | 29 | 28 | 26 | 26 | 35 |
| 1141 | 929 | 40180 | 80.5 | CTCATGCGGACCGCTTGACCTCGT | 13 | 29 | 32 | 17 | 32 | 10 |
| 1142 | 930 | 14139 | 79.2 | CTCACACGCCTAGGACACGGCAGC | 13 | 30 | 26 | 34 | 35 | 31 |
| 1143 | 931 | 3649 | 81.8 | CTCACACGCAGCGTGCCTCACACG | 13 | 30 | 31 | 33 | 13 | 30 |
| 1144 | 932 | 3650 | 80.6 | CTCACACGGACCGTCTGCAATGCG | 13 | 30 | 32 | 19 | 21 | 29 |
| 1145 | 933 | 3658 | 82.3 | CTCACAGCATCGAGCCACGGCGAA | 13 | 31 | 24 | 36 | 35 | 16 |
| 1146 | 934 | 14144 | 79.7 | CTCACAGCTGCGGGACAGGAGCAA | 13 | 31 | 29 | 34 | 25 | 21 |
| 1147 | 935 | 20484 | 77 | CTCAGACCGATGGTCTCCATTGCG | 13 | 32 | 27 | 19 | 15 | 29 |
| 1148 | 936 | 3672 | 79.4 | CTCAGACCGTGCGAGTAGCCTGCG | 13 | 32 | 33 | 20 | 36 | 29 |
| 1149 | 937 | 3691 | 80.8 | CTCAGGACGATGCACGTCCCGGAC | 13 | 34 | 27 | 30 | 28 | 34 |
| 1150 | 938 | 14153 | 78.5 | CTCAGGACGGACCCATAGCCCCAT | 13 | 34 | 34 | 15 | 36 | 15 |
| 1151 | 939 | 30211 | 75.5 | CTCAACGGCCATAAAGGCAAGACC | 13 | 35 | 15 | 6 | 21 | 32 |
| 1152 | 940 | 3701 | 75.4 | CTCAACGGGTCTCCATTTGAAGCC | 13 | 35 | 19 | 15 | 1 | 36 |
| 1153 | 941 | 3703 | 78.8 | CTCAACGGATCGGACCTGTCCACG | 13 | 35 | 24 | 32 | 9 | 30 |
| 1154 | 942 | 40182 | 78.7 | CTCAACGGAGGAAAAGTGCGGCAA | 13 | 35 | 25 | 6 | 29 | 21 |
| 1155 | 943 | 20493 | 78 | CTCAACGGCCTAGGACGTGCGTCT | 13 | 35 | 26 | 34 | 33 | 19 |
| 1156 | 944 | 3708 | 76 | CTCAAGCCTTGAAATCACGGCGTT | 13 | 36 | 1 | 4 | 35 | 12 |
| 1157 | 945 | 3711 | 77.1 | CTCAAGCCTCTGAGCCCGTTCCAT | 13 | 36 | 8 | 36 | 12 | 15 |
| 1158 | 946 | 30212 | 77.4 | CTCAAGCCCGTTGGACTCCCAAAG | 13 | 36 | 12 | 34 | 28 | 6 |
| 1159 | 947 | 30213 | 75.5 | CTCAAGCCGGTACGAACCATAGCC | 13 | 36 | 18 | 16 | 15 | 36 |
| 1160 | 948 | 30214 | 76.4 | CTCAAGCCGATGTCCCTGCGTTAG | 13 | 36 | 27 | 28 | 29 | 3 |
| 1161 | 950 | 3749 | 79 | CTGTCGTTCGTTACGGCAGCGGAC | 14 | 12 | 12 | 35 | 31 | 34 |
| 1162 | 951 | 3750 | 79.8 | CTGTCGTTCCATTCCCTGCGGGAC | 14 | 12 | 15 | 28 | 29 | 34 |
| 1163 | 952 | 3757 | 79.2 | CTGTCGTTCAGCCCTATGCGCAGC | 14 | 12 | 31 | 26 | 29 | 31 |
| 1164 | 953 | 3765 | 78.1 | CTGTCGAACGTTTGCGCAGCAATC | 14 | 16 | 12 | 29 | 31 | 4 |
| 1165 | 954 | 20509 | 77.6 | CTGTCGAATCCCCGTTGACCGAGT | 14 | 16 | 28 | 12 | 32 | 20 |
| 1166 | 955 | 20511 | 76.8 | CTGTGCTTGTGCGAGTCCATCACG | 14 | 17 | 33 | 20 | 15 | 30 |
| 1167 | 956 | 3781 | 80.1 | CTGTGCAACCATAGCCGGACGCAA | 14 | 21 | 15 | 36 | 34 | 21 |
| 1168 | 957 | 3782 | 78.6 | CTGTGCAACGAATGTCAGCCACGG | 14 | 21 | 16 | 9 | 36 | 35 |
| 1169 | 958 | 14170 | 76.3 | CTGTGCAAGCAATCTGCAGCCTTG | 14 | 21 | 21 | 8 | 31 | 11 |
| 1170 | 959 | 3786 | 80.7 | CTGTGCAAGACCGCAAATCGTGCG | 14 | 21 | 32 | 21 | 24 | 29 |
| 1171 | 960 | 14173 | 79.1 | CTGTGATGTGCGAATCGGACGCAA | 14 | 27 | 29 | 4 | 34 | 21 |
| 1172 | 962 | 3800 | 76 | CTGTTCCCCTTGAGGACCATCACG | 14 | 28 | 11 | 25 | 15 | 30 |
| 1173 | 963 | 30215 | 77.5 | CTGTTCCCGCTTCCTAGTGCGACC | 14 | 28 | 17 | 26 | 33 | 32 |

FIG. 25X

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1174 | 964 | 3805 | 79.8 | CTGTTCCCAGTGCGAATCCCGGAC | 14 | 28 | 22 | 16 | 28 | 34 |
| 1175 | 966 | 3817 | 80.6 | CTGTTGCGTGTCCACGCCTATGCG | 14 | 29 | 9 | 30 | 26 | 29 |
| 1176 | 967 | 14180 | 78.3 | CTGTTGCGCGAACTTGCCATGGTA | 14 | 29 | 16 | 11 | 15 | 18 |
| 1177 | 968 | 40184 | 77.7 | CTGTTGCGGCTTTCGTGCTTTTGA | 14 | 29 | 17 | 10 | 17 | 1 |
| 1178 | 969 | 40185 | 78.8 | CTGTTGCGGAGTCCATCAGCGCTT | 14 | 29 | 20 | 15 | 31 | 17 |
| 1179 | 970 | 40186 | 77.4 | CTGTTGCGAGGAAAAGCTGTTGCG | 14 | 29 | 25 | 6 | 14 | 29 |
| 1180 | 971 | 14181 | 77.2 | CTGTTGCGCAGCACGGCCTAATAC | 14 | 29 | 31 | 35 | 26 | 5 |
| 1181 | 974 | 3832 | 79.4 | CTGTCACGCTGTTCCCGACCAGGA | 14 | 30 | 14 | 28 | 32 | 25 |
| 1182 | 975 | 20528 | 78.5 | CTGTCACGCCATAATCGTGCCACG | 14 | 30 | 15 | 4 | 33 | 30 |
| 1183 | 976 | 14182 | 76.4 | CTGTCACGCGAAATACGCAACGAA | 14 | 30 | 16 | 5 | 21 | 16 |
| 1184 | 977 | 3836 | 79.3 | CTGTCACGGGTAACGGCGAAGCAA | 14 | 30 | 18 | 35 | 16 | 21 |
| 1185 | 978 | 3837 | 79.7 | CTGTCACGGATGGGACGCAACAGC | 14 | 30 | 27 | 34 | 21 | 31 |
| 1186 | 979 | 3847 | 81.6 | CTGTCAGCATCGCGTTGCAATGCG | 14 | 31 | 24 | 12 | 21 | 29 |
| 1187 | 980 | 3849 | 82 | CTGTCAGCGATGTGCGGTGCCCAT | 14 | 31 | 27 | 29 | 33 | 15 |
| 1188 | 981 | 40187 | 80.4 | CTGTCAGCTGCGAGTGAGCCGTGC | 14 | 31 | 29 | 22 | 36 | 33 |
| 1189 | 983 | 40188 | 77.7 | CTGTGACCGCAAATACGACCGTGC | 14 | 32 | 21 | 5 | 32 | 33 |
| 1190 | 984 | 14187 | 80.6 | CTGTGACCTCCCCAGCTGCGTCGT | 14 | 32 | 28 | 31 | 29 | 10 |
| 1191 | 985 | 14188 | 80.7 | CTGTGACCTGCGCACGCCATTGTC | 14 | 32 | 29 | 30 | 15 | 9 |
| 1192 | 986 | 20536 | 77 | CTGTGACCCACGACCTACGGCTTG | 14 | 32 | 30 | 23 | 35 | 11 |
| 1193 | 988 | 3869 | 77 | CTGTGTGCGCTTCCATCTTGGGAC | 14 | 33 | 17 | 15 | 11 | 34 |
| 1194 | 990 | 40189 | 81 | CTGTGTGCTGCGGATGATCGGCAA | 14 | 33 | 29 | 27 | 24 | 21 |
| 1195 | 992 | 14190 | 79.6 | CTGTGTGCGGACTGATCACGTGCG | 14 | 33 | 34 | 2 | 30 | 29 |
| 1196 | 995 | 3884 | 76.5 | CTGTGGACGGACATACGGACGCTT | 14 | 34 | 34 | 5 | 34 | 17 |
| 1197 | 996 | 14193 | 80.7 | CTGTGGACAGCCCTCACACGTGCG | 14 | 34 | 36 | 13 | 30 | 29 |
| 1198 | 997 | 3886 | 79.7 | CTGTACGGCTTGGACCGTGCGATG | 14 | 35 | 11 | 32 | 33 | 27 |
| 1199 | 998 | 3891 | 77.8 | CTGTACGGACCTACGGGACCACGG | 14 | 35 | 23 | 35 | 32 | 35 |
| 1200 | 999 | 3900 | 77.9 | CTGTAGCCTCGTGCTTCACGCGAA | 14 | 36 | 10 | 17 | 30 | 16 |
| 1201 | 1000 | 30218 | 75.5 | CTGTAGCCGCTTATCGTGTCTGCG | 14 | 36 | 17 | 24 | 9 | 29 |
| 1202 | 1001 | 3905 | 80.9 | CTGTAGCCGTCTTGCGGGACGTGC | 14 | 36 | 19 | 29 | 34 | 33 |
| 1203 | 1002 | 3912 | 75.7 | CTGTAGCCTCCCAAAGCTCAACGG | 14 | 36 | 28 | 6 | 13 | 35 |
| 1204 | 1003 | 3915 | 76.8 | CTGTAGCCGACCTCTGCTTGCAGC | 14 | 36 | 32 | 8 | 11 | 31 |
| 1205 | 1004 | 3923 | 78.7 | CCATTTGAGGACCGAACACGACGG | 15 | 1 | 34 | 16 | 30 | 35 |
| 1206 | 1005 | 3927 | 81.6 | CCATTGATGACCGGACCACGGCAA | 15 | 2 | 32 | 34 | 30 | 21 |
| 1207 | 1006 | 20546 | 76.1 | CCATTTAGGACCAAAGCCATTGCG | 15 | 3 | 32 | 6 | 15 | 29 |
| 1208 | 1007 | 20548 | 76.3 | CCATAATCCGTTGCTTGTGCCCAT | 15 | 4 | 12 | 17 | 33 | 15 |
| 1209 | 1008 | 3942 | 78.1 | CCATAATCTCCCCCATCACGCGAA | 15 | 4 | 28 | 15 | 30 | 16 |
| 1210 | 1009 | 14213 | 78 | CCATAATCAGCCCGAATCCCTCCC | 15 | 4 | 36 | 16 | 28 | 28 |
| 1211 | 1010 | 3948 | 77.6 | CCATAAAGCTTGCAGCATCGGCAA | 15 | 6 | 11 | 31 | 24 | 21 |
| 1212 | 1011 | 14216 | 76.9 | CCATAAAGACGGCGAAGACCCGTT | 15 | 6 | 35 | 16 | 32 | 12 |
| 1213 | 1012 | 3965 | 79.8 | CCATTCTGAGGATGCGGGACGGAC | 15 | 8 | 25 | 29 | 34 | 34 |
| 1214 | 1013 | 14222 | 77.6 | CCATTCTGAGCCTGTCATCGCGAA | 15 | 8 | 36 | 9 | 24 | 16 |
| 1215 | 1014 | 3982 | 80.2 | CCATTGTCATCGCCATGACCGTGC | 15 | 9 | 24 | 15 | 32 | 33 |
| 1216 | 1015 | 3985 | 79.6 | CCATTGTCTGCGCCATCGTTGGAC | 15 | 9 | 29 | 15 | 12 | 34 |
| 1217 | 1017 | 3990 | 79.2 | CCATTGTCACGGCCATGATGGACC | 15 | 9 | 35 | 15 | 27 | 32 |
| 1218 | 1019 | 30219 | 77 | CCATTCGTGCTTTACAAGCCACGG | 15 | 10 | 17 | 7 | 36 | 35 |
| 1219 | 1021 | 14233 | 75.4 | CCATCTTGCGAATTAGGTGCTCCC | 15 | 11 | 16 | 3 | 33 | 28 |
| 1220 | 1022 | 4021 | 81.6 | CCATCGTTCTCATCCCTGCGTGCG | 15 | 12 | 13 | 28 | 29 | 29 |
| 1221 | 1023 | 4025 | 76.5 | CCATCGTTGCAAATACATCGTGCG | 15 | 12 | 21 | 5 | 24 | 29 |
| 1222 | 1024 | 4026 | 76.2 | CCATCGTTACCTAGCCACCTTGCG | 15 | 12 | 23 | 36 | 23 | 29 |
| 1223 | 1025 | 4027 | 75.6 | CCATCGTTATCGTGCGAAAGCTCA | 15 | 12 | 24 | 29 | 6 | 13 |
| 1224 | 1026 | 4033 | 78.8 | CCATCGTTGACCGCTTAGGATGCG | 15 | 12 | 32 | 17 | 25 | 29 |

FIG. 25Y

| SEQ ID NO: | 4,633 ID# | H3X ID# | Tm | ZIPCODE (5'-3') | TETRAMER NUMBERS | | | | | |
|---|---|---|---|---|---|---|---|---|---|---|
| 1225 | 1027 | 4034 | 77.9 | CCATCGTTGTGCCCTAGGACGGAC | 15 | 12 | 33 | 26 | 34 | 34 |
| 1226 | 1028 | 4040 | 78.6 | CCATCTCAACGGCACGAGCCTGAT | 15 | 13 | 35 | 30 | 36 | 2 |
| 1227 | 1029 | 4042 | 78.6 | CCATCTGTTCGTGCAATCGTTGCG | 15 | 14 | 10 | 21 | 10 | 29 |
| 1228 | 1030 | 4045 | 77.7 | CCATCTGTTCCCGGTACACGTCCC | 15 | 14 | 28 | 18 | 30 | 28 |
| 1229 | 1031 | 4046 | 82.3 | CCATCTGTGTGCGTGCGATGTGCG | 15 | 14 | 33 | 33 | 27 | 29 |
| 1230 | 1032 | 4052 | 79.1 | CCATCCATCCTACAGCTGCGCAGC | 15 | 15 | 26 | 31 | 29 | 31 |
| 1231 | 1033 | 14242 | 80.2 | CCATCCATGGACGACCTGCGACCT | 15 | 15 | 34 | 32 | 29 | 23 |
| 1232 | 1034 | 14243 | 78 | CCATCGAATCGTCGTTGATGGCAA | 15 | 16 | 10 | 12 | 27 | 21 |
| 1233 | 1035 | 14244 | 78 | CCATCGAACGTTCACGAGTGCAGC | 15 | 16 | 12 | 30 | 22 | 31 |
| 1234 | 1036 | 40192 | 76.9 | CCATCGAACGAACCTACGAATGCG | 15 | 16 | 16 | 26 | 16 | 29 |
| 1235 | 1037 | 40193 | 78.7 | CCATCGAAACCTTGTCGACCACGG | 15 | 16 | 23 | 9 | 32 | 35 |
| 1236 | 1038 | 30222 | 79.5 | CCATCGAACAGCCCATTCGTCACG | 15 | 16 | 31 | 15 | 10 | 30 |
| 1237 | 1039 | 4076 | 79.9 | CCATGCTTCTCAACGGCAGCATCG | 15 | 17 | 13 | 35 | 31 | 24 |
| 1238 | 1040 | 14253 | 75.2 | CCATGCTTAGGAAGGAATCGCGTT | 15 | 17 | 25 | 25 | 24 | 12 |
| 1239 | 1041 | 14255 | 77 | CCATGCTTCAGCTACATCCCGTGC | 15 | 17 | 31 | 7 | 28 | 33 |
| 1240 | 1042 | 4087 | 78.3 | CCATGCTTGACCCGAAGCTTCAGC | 15 | 17 | 32 | 16 | 17 | 31 |
| 1241 | 1043 | 4088 | 80.1 | CCATGCTTGTGCGACCGACCTTGA | 15 | 17 | 33 | 32 | 32 | 1 |
| 1242 | 1044 | 4093 | 77.5 | CCATGGTAGCTTGCAAATCGCGAA | 15 | 18 | 17 | 21 | 24 | 16 |
| 1243 | 1045 | 4099 | 79.1 | CCATGGTACAGCTGCGACGGGGTA | 15 | 18 | 31 | 29 | 35 | 18 |
| 1244 | 1046 | 4100 | 81.5 | CCATGGTAGTGCACGGAGCCGTGC | 15 | 18 | 33 | 35 | 36 | 33 |
| 1245 | 1047 | 4104 | 79.7 | CCATGTCTCACGTGCGCTTGTCCC | 15 | 19 | 30 | 29 | 11 | 28 |
| 1246 | 1048 | 14264 | 78.1 | CCATGCAATCGTGCAAATCGAGGA | 15 | 21 | 10 | 21 | 24 | 25 |
| 1247 | 1049 | 40195 | 76.2 | CCATGCAACGAATCCCAATCCCTA | 15 | 21 | 16 | 28 | 4 | 26 |
| 1248 | 1050 | 4121 | 79.9 | CCATGCAAGTCTTCCCAGCCGGAC | 15 | 21 | 19 | 28 | 36 | 34 |
| 1249 | 1051 | 4122 | 80.7 | CCATGCAAGAGTTCCCCAGCCACG | 15 | 21 | 20 | 28 | 31 | 30 |
| 1250 | 1052 | 40196 | 76.8 | CCATGCAAATCGTTAGGGACGTGC | 15 | 21 | 24 | 3 | 34 | 33 |
| 1251 | 1054 | 14269 | 78.3 | CCATGCAACACGATCGATCGGATG | 15 | 21 | 30 | 24 | 24 | 27 |
| 1252 | 1055 | 14270 | 77.6 | CCATGCAAGACCCGTTAGCCCCTA | 15 | 21 | 32 | 12 | 36 | 26 |
| 1253 | 1056 | 20576 | 76.2 | CCATGCAAGGACGAGTTCCCTCTG | 15 | 21 | 34 | 20 | 28 | 8 |
| 1254 | 1057 | 4132 | 79.1 | CCATGCAAAGCCCTCAGCAAGTGC | 15 | 21 | 36 | 13 | 21 | 33 |
| 1255 | 1058 | 20578 | 77 | CCATAGTGGACCCTTGCTGTTGCG | 15 | 22 | 32 | 11 | 14 | 29 |
| 1256 | 1059 | 4140 | 76.1 | CCATACCTTCCCATACCAGCTGCG | 15 | 23 | 28 | 5 | 31 | 29 |
| 1257 | 1060 | 4147 | 75.7 | CCATATCGGGTATCTGGACCACGG | 15 | 24 | 18 | 8 | 32 | 35 |
| 1258 | 1061 | 20580 | 76.6 | CCATATCGGAGTGATGTGCGGGAC | 15 | 24 | 20 | 27 | 29 | 34 |
| 1259 | 1062 | 4150 | 78.2 | CCATATCGTCCCCGTTCACGAGGA | 15 | 24 | 28 | 12 | 30 | 25 |
| 1260 | 1063 | 4158 | 79.6 | CCATAGGAAGGATCCCCACGCACG | 15 | 25 | 25 | 28 | 30 | 30 |
| 1261 | 1064 | 14279 | 77.2 | CCATGATGCGTTCAGCGTCTAGCC | 15 | 27 | 12 | 31 | 19 | 36 |
| 1262 | 1065 | 4178 | 80.1 | CCATGATGATCGGATGGTGCACGG | 15 | 27 | 24 | 27 | 33 | 35 |
| 1263 | 1066 | 4179 | 76 | CCATGATGCCTAGGACGACCCTTG | 15 | 27 | 26 | 34 | 32 | 11 |
| 1264 | 1067 | 4181 | 79.5 | CCATGATGTCCCGATGCGAACAGC | 15 | 27 | 28 | 27 | 16 | 31 |
| 1265 | 1068 | 4182 | 80 | CCATGATGCAGCCACGCCATCTGT | 15 | 27 | 31 | 30 | 15 | 14 |
| 1266 | 1069 | 14281 | 76.8 | CCATTCCCTTAGCGTTCAGCCCAT | 15 | 28 | 3 | 12 | 31 | 15 |
| 1267 | 1070 | 14283 | 77.7 | CCATTCCCCTCAACGGGATGTCTG | 15 | 28 | 13 | 35 | 27 | 8 |
| 1268 | 1071 | 20589 | 78.2 | CCATTCCCACCTAGTGCACGCCAT | 15 | 28 | 23 | 22 | 30 | 15 |
| 1269 | 1072 | 40200 | 75.3 | CCATTGCGTGATAATCCTTGGCAA | 15 | 29 | 2 | 4 | 11 | 21 |
| 1270 | 1073 | 40201 | 78.3 | CCATTGCGTTAGCGTTTCCCGGTA | 15 | 29 | 3 | 12 | 28 | 18 |
| 1271 | 1075 | 14287 | 77.7 | CCATTGCGTGTCGGTAAAAGTGCG | 15 | 29 | 9 | 18 | 6 | 29 |
| 1272 | 1076 | 40202 | 76.8 | CCATTGCGTCGTAAAGTCCCATCG | 15 | 29 | 10 | 6 | 28 | 24 |
| 1273 | 1078 | 40203 | 79.7 | CCATTGCGAGGACACGGAGTGTGC | 15 | 29 | 25 | 30 | 20 | 33 |
| 1274 | 1079 | 4213 | 80.6 | CCATTGCGTGCGAATCCAGCAGTG | 15 | 29 | 29 | 4 | 31 | 22 |
| 1275 | 1080 | 4214 | 82.1 | CCATTGCGCACGGCAAGAGTCGAA | 15 | 29 | 30 | 21 | 20 | 16 |

FIG. 25Z

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1276 | 1081 | 4215 | 81.3 | CCATTGCGGACCCACGTCTGGATG | 15 | 29 | 32 | 30 | 8 | 27 |
| 1277 | 1082 | 4216 | 81.3 | CCATTGCGGTGCGGACCGTTAGTG | 15 | 29 | 33 | 34 | 12 | 22 |
| 1278 | 1083 | 4217 | 80.1 | CCATTGCGACGGCCATATCGACCT | 15 | 29 | 35 | 15 | 24 | 23 |
| 1279 | 1084 | 4218 | 80.4 | CCATCACGTTGAAGCCTGCGGCTT | 15 | 30 | 1 | 36 | 29 | 17 |
| 1280 | 1086 | 4221 | 80.6 | CCATCACGTCTGGCAATCCCAGCC | 15 | 30 | 8 | 21 | 28 | 36 |
| 1281 | 1087 | 4224 | 77.3 | CCATCACGAGTGACCTTCCCCCAT | 15 | 30 | 22 | 23 | 28 | 15 |
| 1282 | 1088 | 40204 | 79.6 | CCATCACGATCGGCTTTTGATGCG | 15 | 30 | 24 | 17 | 1 | 29 |
| 1283 | 1089 | 40205 | 79 | CCATCACGTGCGAAAGATCGAGCC | 15 | 30 | 29 | 6 | 24 | 36 |
| 1284 | 1090 | 40206 | 81.6 | CCATCACGGACCGAGTGCTTTGCG | 15 | 30 | 32 | 20 | 17 | 29 |
| 1285 | 1091 | 4230 | 80.6 | CCATCACGAGCCGATGAGTGCACG | 15 | 30 | 36 | 27 | 22 | 30 |
| 1286 | 1092 | 4231 | 77.9 | CCATCAGCTTGATCCCCCATCAGC | 15 | 31 | 1 | 28 | 15 | 31 |
| 1287 | 1094 | 4233 | 78.4 | CCATCAGCCTTGGGACCGTTCTCA | 15 | 31 | 11 | 34 | 12 | 13 |
| 1288 | 1095 | 20601 | 76.6 | CCATCAGCCGTTTTAGTCCCCCAT | 15 | 31 | 12 | 3 | 28 | 15 |
| 1289 | 1096 | 4236 | 80 | CCATCAGCAGTGGCAAGTGCAGCC | 15 | 31 | 22 | 21 | 33 | 36 |
| 1290 | 1097 | 4237 | 76.2 | CCATCAGCACCTTTAGTGCGGACC | 15 | 31 | 23 | 3 | 29 | 32 |
| 1291 | 1098 | 4238 | 76.9 | CCATCAGCTCCCAGGAGACCCCTA | 15 | 31 | 28 | 25 | 32 | 26 |
| 1292 | 1100 | 30226 | 78.8 | CCATGACCGAGTAGGAACGGTGCG | 15 | 32 | 20 | 25 | 35 | 29 |
| 1293 | 1101 | 4253 | 77 | CCATGACCAGGAAATCTCCCGACC | 15 | 32 | 25 | 4 | 28 | 32 |
| 1294 | 1102 | 40209 | 79.3 | CCATGACCGATGCTTGGCTTCGAA | 15 | 32 | 27 | 11 | 17 | 16 |
| 1295 | 1103 | 4256 | 78 | CCATGACCTCCCGGTAGTCTTGCG | 15 | 32 | 28 | 18 | 19 | 29 |
| 1296 | 1104 | 14299 | 80.6 | CCATGACCAGCCGAGTGCAATCCC | 15 | 32 | 36 | 20 | 21 | 28 |
| 1297 | 1105 | 4261 | 77 | CCATGTGCTGATACCTGTGCGCAA | 15 | 33 | 2 | 23 | 33 | 21 |
| 1298 | 1106 | 4262 | 81.4 | CCATGTGCAATCTGCGACGGGACC | 15 | 33 | 4 | 29 | 35 | 32 |
| 1299 | 1107 | 4264 | 79.5 | CCATGTGCTCTGCGTTGGACGCTT | 15 | 33 | 8 | 12 | 34 | 17 |
| 1300 | 1108 | 4268 | 78.4 | CCATGTGCCTGTCGTTTGTCACGG | 15 | 33 | 14 | 12 | 9 | 35 |
| 1301 | 1109 | 14301 | 76.4 | CCATGTGCGCTTCGTTAATCCCAT | 15 | 33 | 17 | 12 | 4 | 15 |
| 1302 | 1110 | 4273 | 77.6 | CCATGTGCATCGGGTAACCTTCCC | 15 | 33 | 24 | 18 | 23 | 28 |
| 1303 | 1111 | 4274 | 75.5 | CCATGTGCAGGAATACTCCCCGTT | 15 | 33 | 25 | 5 | 28 | 12 |
| 1304 | 1112 | 4275 | 80.8 | CCATGTGCTGCGGGACTCTGGACC | 15 | 33 | 29 | 34 | 8 | 32 |
| 1305 | 1113 | 14305 | 78.6 | CCATGTGCGACCCCTACCTATGCG | 15 | 33 | 32 | 26 | 26 | 29 |
| 1306 | 1114 | 4278 | 80.2 | CCATGTGCAGCCCACGAAAGCTCA | 15 | 33 | 36 | 30 | 6 | 13 |
| 1307 | 1115 | 40211 | 77.6 | CCATGGACGGTACTCATGCGATCG | 15 | 34 | 18 | 13 | 29 | 24 |
| 1308 | 1116 | 4288 | 77.2 | CCATGGACAGGACACGAGGACGAA | 15 | 34 | 25 | 30 | 25 | 16 |
| 1309 | 1117 | 4292 | 80.5 | CCATGGACCACGGTCTCACGGGAC | 15 | 34 | 30 | 19 | 30 | 34 |
| 1310 | 1118 | 14310 | 80.2 | CCATGGACGTGCCAGCTTGAGCAA | 15 | 34 | 33 | 31 | 1 | 21 |
| 1311 | 1119 | 4297 | 80.5 | CCATACGGAATCGCAATGCGAGCC | 15 | 35 | 4 | 21 | 29 | 36 |
| 1312 | 1120 | 4298 | 81 | CCATACGGTCTGGCAAAGCCGCAA | 15 | 35 | 8 | 21 | 36 | 21 |
| 1313 | 1121 | 40213 | 77.5 | CCATACGGCTTGCCTATCCCGGTA | 15 | 35 | 11 | 26 | 28 | 18 |
| 1314 | 1122 | 4304 | 77.7 | CCATACGGGCAATCTGAGTGCACG | 15 | 35 | 21 | 8 | 22 | 30 |
| 1315 | 1123 | 4309 | 77.4 | CCATACGGGACCCTGTAGCCGGTA | 15 | 35 | 32 | 14 | 36 | 18 |
| 1316 | 1124 | 30227 | 78.2 | CCATACGGGTGCTCGTCCATCGTT | 15 | 35 | 33 | 10 | 15 | 12 |
| 1317 | 1125 | 14321 | 79.7 | CCATAGCCGTGCGCAACGAACTTG | 15 | 36 | 33 | 21 | 16 | 11 |
| 1318 | 1127 | 4335 | 78.8 | CGAATGATTGCGCCATTGATGCAA | 16 | 2 | 29 | 15 | 2 | 21 |
| 1319 | 1128 | 20626 | 78.1 | CGAATGATCACGCTGTACGGGCAA | 16 | 2 | 30 | 14 | 35 | 21 |
| 1320 | 1130 | 40217 | 77.6 | CGAAAATCCACGACGGTTGACACG | 16 | 4 | 30 | 35 | 1 | 30 |
| 1321 | 1131 | 30232 | 78.6 | CGAAAATCGTGCCTGTTGCGGTCT | 16 | 4 | 33 | 14 | 29 | 19 |
| 1322 | 1132 | 40218 | 77.2 | CGAAAATCGGACTTGATGCGCTTG | 16 | 4 | 34 | 1 | 29 | 11 |
| 1323 | 1133 | 20631 | 80.6 | CGAAATACGCTTTCCCGCAATGCG | 16 | 5 | 17 | 28 | 21 | 29 |
| 1324 | 1134 | 30233 | 77.2 | CGAAAAGCGAAATCGTTGATGCG | 16 | 6 | 16 | 24 | 1 | 29 |
| 1325 | 1135 | 30234 | 76 | CGAAAAAGTCCCTGCGGAGTTTGA | 16 | 6 | 28 | 29 | 20 | 1 |
| 1326 | 1136 | 30235 | 75.8 | CGAAAAAGCACGAAAGCCATAGCC | 16 | 6 | 30 | 6 | 15 | 36 |

FIG. 25AA

| SEQ ID NO: | 4,633 ID# | HEX ID# | Tm | ZIPCODE (5'-3') | TETRAMER NUMBERS | | | | |
|---|---|---|---|---|---|---|---|---|---|
| 1327 | 1137 | 4381 | 78 | CGAAAAAGCAGCGGACCTCAAGGA | 16 | 6 | 31 | 34 | 13 25 |
| 1328 | 1138 | 14350 | 79.1 | CGAAAAAGGTGCCACGCAGCTGTC | 16 | 6 | 33 | 30 | 31 9 |
| 1329 | 1139 | 4385 | 78.5 | CGAAAAAGAGCCGTGCCTCAGTGC | 16 | 6 | 36 | 33 | 13 33 |
| 1330 | 1140 | 4388 | 80.9 | CGAATCTGTCGTTGCGCGAAAGCC | 16 | 8 | 10 | 29 | 16 36 |
| 1331 | 1141 | 30236 | 76.1 | CGAATCTGCCATAGGAGACCACGG | 16 | 8 | 15 | 25 | 32 35 |
| 1332 | 1143 | 4399 | 76.8 | CGAATCTGCACGTACACAGCCACG | 16 | 8 | 30 | 7 | 31 30 |
| 1333 | 1144 | 4403 | 80.2 | CGAATGTCCTCAAGCCGTGCCCAT | 16 | 9 | 13 | 36 | 33 15 |
| 1334 | 1146 | 20640 | 77.3 | CGAATGTCGTCTCTGTTGCGAGCC | 16 | 9 | 19 | 14 | 29 36 |
| 1335 | 1149 | 4421 | 78.2 | CGAATCGTCTGTCAGCGCAACAGC | 16 | 10 | 14 | 31 | 21 31 |
| 1336 | 1150 | 14364 | 77 | CGAATCGTGCTTCCATAGCCATCG | 16 | 10 | 17 | 15 | 36 24 |
| 1337 | 1153 | 4437 | 79.7 | CGAACTTGTCGTGACCCAGCCACG | 16 | 11 | 10 | 32 | 31 30 |
| 1338 | 1154 | 40222 | 78.9 | CGAACTTGGCTTGACCCACGATCG | 16 | 11 | 17 | 32 | 30 24 |
| 1339 | 1155 | 30240 | 78.5 | CGAACTTGCAGCAGTGGATGCGAA | 16 | 11 | 31 | 22 | 27 16 |
| 1340 | 1156 | 4448 | 78.6 | CGAACTTGGACCCTTGTGCGCTGT | 16 | 11 | 32 | 11 | 29 14 |
| 1341 | 1157 | 14373 | 79.7 | CGAACTTGGTGCCAGCCGTTGATG | 16 | 11 | 33 | 31 | 12 27 |
| 1342 | 1158 | 20649 | 77.2 | CGAACTTGAGCCGATGGAGTCACG | 16 | 11 | 36 | 27 | 20 30 |
| 1343 | 1160 | 20650 | 75.9 | CGAACGTTGAGTCGAACACGATCG | 16 | 12 | 20 | 16 | 30 24 |
| 1344 | 1161 | 4464 | 76.8 | CGAACGTTGTGCTCTGCAGCTTGA | 16 | 12 | 33 | 8 | 31 1 |
| 1345 | 1163 | 4468 | 79.2 | CGAACTCACCATGCAAACGGCGTT | 16 | 13 | 15 | 21 | 35 12 |
| 1346 | 1164 | 4469 | 79.3 | CGAACTCAGCTTTGCGAGGATGCG | 16 | 13 | 17 | 29 | 25 29 |
| 1347 | 1165 | 4471 | 75.5 | CGAACTCATCCCATACGCAAGCAA | 16 | 13 | 28 | 5 | 21 21 |
| 1348 | 1166 | 4473 | 80.2 | CGAACTCACAGCCAGCGCTTGTGC | 16 | 13 | 31 | 31 | 17 33 |
| 1349 | 1168 | 40224 | 78.5 | CGAACCATCGAACCATGACCGGAC | 16 | 15 | 16 | 15 | 32 34 |
| 1350 | 1169 | 4487 | 77 | CGAACCATATCGAGTGCAGCGGAC | 16 | 15 | 24 | 22 | 31 34 |
| 1351 | 1170 | 14385 | 76.1 | CGAACCATCCTAAATCCGTTTGCG | 16 | 15 | 26 | 4 | 12 29 |
| 1352 | 1171 | 20658 | 75.6 | CGAACCATCACGTTAGGCAAGCAA | 16 | 15 | 30 | 3 | 21 21 |
| 1353 | 1173 | 4493 | 78.8 | CGAACCATGGACCTCATCCCTCCC | 16 | 15 | 34 | 13 | 28 28 |
| 1354 | 1174 | 30244 | 78.6 | CGAACGAAAAGACCTTGCGGCAA | 16 | 16 | 6 | 23 | 29 21 |
| 1355 | 1175 | 14389 | 75.7 | CGAACGAATCGTTTAGCGTTGCAA | 16 | 16 | 10 | 3 | 12 21 |
| 1356 | 1176 | 14395 | 77.2 | CGAAGCTTTGATCACGCGTTGACC | 16 | 17 | 2 | 30 | 12 32 |
| 1357 | 1177 | 4513 | 76.1 | CGAAGCTTTACATGCGTTGATGCG | 16 | 17 | 7 | 29 | 1 29 |
| 1358 | 1178 | 4517 | 76.2 | CGAAGCTTCGTTCGAAGGACAGGA | 16 | 17 | 12 | 16 | 34 25 |
| 1359 | 1180 | 30245 | 76.7 | CGAAGCTTCGAATCGTGCAACCAT | 16 | 17 | 16 | 10 | 21 15 |
| 1360 | 1181 | 20663 | 75.8 | CGAAGCTTGTGCGGACAAAGTTGA | 16 | 17 | 33 | 34 | 6 1 |
| 1361 | 1182 | 20668 | 77.2 | CGAAGAGTCCATACGGTCCCAGCC | 16 | 20 | 15 | 35 | 28 36 |
| 1362 | 1183 | 20670 | 78.1 | CGAAGCAATTGAACCTTGCGGGAC | 16 | 21 | 1 | 23 | 29 34 |
| 1363 | 1184 | 4548 | 76.3 | CGAAGCAAAATCAGCCACCTACGG | 16 | 21 | 4 | 36 | 23 35 |
| 1364 | 1185 | 40225 | 79 | CGAAGCAAAAGCCATCGTTTGCG | 16 | 21 | 6 | 15 | 12 29 |
| 1365 | 1186 | 30248 | 75.2 | CGAAGCAACCATACGGCGTTAGTG | 16 | 21 | 15 | 35 | 12 22 |
| 1366 | 1187 | 20673 | 77.3 | CGAAGCAAGATGAGCCTGTCCACG | 16 | 21 | 27 | 36 | 9 30 |
| 1367 | 1188 | 4557 | 78 | CGAAAGTGCTTGGCAACGTTCACG | 16 | 22 | 11 | 21 | 12 30 |
| 1368 | 1189 | 20675 | 79.9 | CGAAAGTGCGTTTGCGTCTGGTGC | 16 | 22 | 12 | 29 | 8 33 |
| 1369 | 1190 | 4558 | 76.5 | CGAAAGTGCGAATGTCAGTGCGAA | 16 | 22 | 16 | 9 | 22 16 |
| 1370 | 1191 | 14414 | 77.4 | CGAAAGTGGCTTGGACTCGTTCCC | 16 | 22 | 17 | 34 | 10 28 |
| 1371 | 1192 | 14416 | 80.8 | CGAAAGTGGATGGACCCAGCTGCG | 16 | 22 | 27 | 32 | 31 29 |
| 1372 | 1194 | 4578 | 78.6 | CGAAACCTGAGTACGGTGCGCGTT | 16 | 23 | 20 | 35 | 29 12 |
| 1373 | 1195 | 4579 | 75.9 | CGAAACCTGCAACTGTGGTATGCG | 16 | 23 | 21 | 14 | 18 29 |
| 1374 | 1196 | 4584 | 77.7 | CGAAACCTTGCGGGTAACCTCGAA | 16 | 23 | 29 | 18 | 23 16 |
| 1375 | 1197 | 30249 | 79.1 | CGAAACCTGACCTTGATGCGCAGC | 16 | 23 | 32 | 1 | 29 31 |
| 1376 | 1198 | 4585 | 78.9 | CGAAACCTGTGCGTCTGACCGGAC | 16 | 23 | 33 | 19 | 32 34 |
| 1377 | 1199 | 30250 | 78.9 | CGAAATCGGAGTTCTGCCATTGCG | 16 | 24 | 20 | 8 | 15 29 |

FIG. 25BB

| SEQ ID NO: | 4,633 ID# | H3X ID# | Tm | ZIPCODE (5'-3') | TETRAMER NUMBERS | | | | |
|---|---|---|---|---|---|---|---|---|---|
| 1378 | 1202 | 14431 | 78.2 | CGAAAGGAAGTGCACGGATGAGCC | 16 | 25 | 22 | 30 | 27 | 36 |
| 1379 | 1203 | 4616 | 78.2 | CGAAAGGATCCCGGTAGGACGACC | 16 | 25 | 28 | 18 | 34 | 32 |
| 1380 | 1204 | 40232 | 78.3 | CGAAAGGAAGCCAGCCTGTCGATG | 16 | 25 | 36 | 36 | 9 | 27 |
| 1381 | 1205 | 14434 | 75.8 | CGAACCTAGCAATGTCGCAAGCAA | 16 | 26 | 21 | 9 | 21 | 21 |
| 1382 | 1206 | 14435 | 76.2 | CGAACCTAGTGCAATCAGCCGCTT | 16 | 26 | 33 | 4 | 36 | 17 |
| 1383 | 1207 | 4628 | 80.7 | CGAAGATGTCGTTGCGACGGTCCC | 16 | 27 | 10 | 29 | 35 | 28 |
| 1384 | 1208 | 20694 | 75.9 | CGAAGATGGTCTATCGAGCCCGAA | 16 | 27 | 19 | 24 | 36 | 16 |
| 1385 | 1209 | 4633 | 78.1 | CGAAGATGTCCCCTCAAGCCATCG | 16 | 27 | 28 | 13 | 36 | 24 |
| 1386 | 1210 | 4634 | 78.4 | CGAAGATGCACGCTGTGCAACGTT | 16 | 27 | 30 | 14 | 21 | 12 |
| 1387 | 1211 | 40233 | 79.2 | CGAAGATGGGACTCCCACGGGGTA | 16 | 27 | 34 | 28 | 35 | 18 |
| 1388 | 1212 | 30252 | 78.5 | CGAAGATGAGCCTGATGTGCGCAA | 16 | 27 | 36 | 2 | 33 | 21 |
| 1389 | 1213 | 4640 | 77.8 | CGAATCCCTGTCCAGCAATCGCTT | 16 | 28 | 9 | 31 | 4 | 17 |
| 1390 | 1214 | 30254 | 77.7 | CGAATCCCGATGATACGACCGGAC | 16 | 28 | 27 | 5 | 32 | 34 |
| 1391 | 1215 | 4649 | 79.5 | CGAATCCCCACGAATCAGTGTGCG | 16 | 28 | 30 | 4 | 22 | 29 |
| 1392 | 1216 | 4650 | 81.2 | CGAATCCCCAGCGTGCTGATCGAA | 16 | 28 | 31 | 33 | 2 | 16 |
| 1393 | 1217 | 4652 | 79 | CGAATCCCACGGATCGTCGTGGTA | 16 | 28 | 35 | 24 | 10 | 18 |
| 1394 | 1218 | 14444 | 76.9 | CGAATGCGTGATCAGCAAAGGCTT | 16 | 29 | 2 | 31 | 6 | 17 |
| 1395 | 1219 | 40235 | 80.7 | CGAATGCGTACACAGCGTGCCAGC | 16 | 29 | 7 | 31 | 33 | 31 |
| 1396 | 1220 | 4658 | 79.4 | CGAATGCGCGAACAGCAGGATGAT | 16 | 29 | 16 | 31 | 25 | 2 |
| 1397 | 1223 | 4665 | 79.9 | CGAATGCGCAGCTACAGACCCACG | 16 | 29 | 31 | 7 | 32 | 30 |
| 1398 | 1224 | 4668 | 78.3 | CGAACACGTCTGTCTGGTGCCGAA | 16 | 30 | 8 | 8 | 33 | 16 |
| 1399 | 1225 | 20704 | 79.8 | CGAACACGCCATTCCCAATCCCAT | 16 | 30 | 15 | 28 | 4 | 15 |
| 1400 | 1226 | 4671 | 76.3 | CGAACACGGAGTTTAGTCCCTGCG | 16 | 30 | 20 | 3 | 28 | 29 |
| 1401 | 1227 | 4674 | 80.9 | CGAACACGTGCGGATGGTCTGCAA | 16 | 30 | 29 | 27 | 19 | 21 |
| 1402 | 1228 | 14449 | 79.9 | CGAACACGCACGCACGTTAGAGCC | 16 | 30 | 30 | 30 | 3 | 36 |
| 1403 | 1229 | 14453 | 79.7 | CGAACAGCAATCACGGACGGATCG | 16 | 31 | 4 | 35 | 35 | 24 |
| 1404 | 1230 | 30255 | 76.4 | CGAACAGCTCGTAGTGCTGTTGCG | 16 | 31 | 10 | 22 | 14 | 29 |
| 1405 | 1231 | 40236 | 80.3 | CGAACAGCCTTGCCATGCAAGCAA | 16 | 31 | 11 | 15 | 21 | 21 |
| 1406 | 1232 | 4689 | 75.8 | CGAACAGCGAGTTTGATCCCACCT | 16 | 31 | 20 | 1 | 28 | 23 |
| 1407 | 1233 | 4690 | 75.6 | CGAACAGCAGTGTTAGCAGCAGCC | 16 | 31 | 22 | 3 | 31 | 36 |
| 1408 | 1234 | 40238 | 77.9 | CGAACAGCGATGAAAGGTGCGATG | 16 | 31 | 27 | 6 | 33 | 27 |
| 1409 | 1236 | 4696 | 79.5 | CGAACAGCCAGCGACCGGTACTCA | 16 | 31 | 31 | 32 | 18 | 13 |
| 1410 | 1237 | 4704 | 77.3 | CGAAGACCCTGTCTCAGTGCGTGC | 16 | 32 | 14 | 13 | 33 | 33 |
| 1411 | 1238 | 14466 | 75 | CGAAGACCGTCTAGGATCCCCTCA | 16 | 32 | 19 | 25 | 28 | 13 |
| 1412 | 1239 | 4713 | 76.2 | CGAAGACCTCCCCCTAATCGCTGT | 16 | 32 | 28 | 26 | 24 | 14 |
| 1413 | 1240 | 14470 | 75.9 | CGAAGACCTGCGTTAGCTCAAGCC | 16 | 32 | 29 | 3 | 13 | 36 |
| 1414 | 1241 | 40239 | 77.2 | CGAAGTGCGGTAAATCTCGTTGCG | 16 | 33 | 18 | 4 | 10 | 29 |
| 1415 | 1242 | 14481 | 77 | CGAAGTGCAGGAAGCCTCGTCTCA | 16 | 33 | 25 | 36 | 10 | 13 |
| 1416 | 1243 | 4734 | 77.9 | CGAAGTGCTCCCCCTAGATGCGAA | 16 | 33 | 28 | 26 | 27 | 16 |
| 1417 | 1244 | 14485 | 80.5 | CGAAGTGCAGCCGATGGGACTCGT | 16 | 33 | 36 | 27 | 34 | 10 |
| 1418 | 1245 | 4747 | 77.6 | CGAAGGACGCTTGACCTGATGCAA | 16 | 34 | 17 | 32 | 2 | 21 |
| 1419 | 1247 | 14491 | 78 | CGAAGGACACCTTCTGTCCCACGG | 16 | 34 | 23 | 8 | 28 | 35 |
| 1420 | 1248 | 4755 | 77 | CGAAGGACGATGGAGTACGGGCTT | 16 | 34 | 27 | 20 | 35 | 17 |
| 1421 | 1250 | 30260 | 77.9 | CGAAACGGTGATTCCCTGTCGACC | 16 | 35 | 2 | 28 | 9 | 32 |
| 1422 | 1252 | 14498 | 78.3 | CGAAACGGTCTGCAGCAAAGTCCC | 16 | 35 | 8 | 31 | 6 | 28 |
| 1423 | 1253 | 30262 | 77.5 | CGAAACGGGAGTGGACGGTATCGT | 16 | 35 | 20 | 34 | 18 | 10 |
| 1424 | 1254 | 20723 | 75.1 | CGAAACGGACCTAGGACGTTTCGT | 16 | 35 | 23 | 25 | 12 | 10 |
| 1425 | 1255 | 40241 | 77.5 | CGAAACGGAGGACTTGATCGAGCC | 16 | 35 | 25 | 11 | 24 | 36 |
| 1426 | 1256 | 4775 | 76 | CGAAACGGCCTATCGTGCAAGAGT | 16 | 35 | 26 | 10 | 21 | 20 |
| 1427 | 1257 | 4778 | 81.2 | CGAAACGGTGCGCTGTTCGTCGTT | 16 | 35 | 29 | 14 | 10 | 12 |
| 1428 | 1258 | 4781 | 81 | CGAAACGGACGGCACGATCGTGAT | 16 | 35 | 35 | 30 | 24 | 2 |

FIG. 25CC

```
SEQ    4,633  H3X              ZIPCODE (5'-3')        TETRAMER NUMBERS
ID NO: ID#    ID#   Tm
1429   1260   30263 76.5  CGAAAGCCTGATCCTATCCCGGAC   16  36   2   26  28  34
1430   1261   4786  77.6  CGAAAGCCTCTGGCAACGAAGGAC   16  36   8   21  16  34
1431   1262   40243 77.2  CGAAAGCCCTCAAATCGATGGGAC   16  36  13    4  27  34
1432   1264   14508 75.6  CGAAAGCCACCTTTAGCAGCTCGT   16  36  23    3  31  10
1433   1265   4795  79.4  CGAAAGCCATCGGTCTGATGCGAA   16  36  24   19  27  16
1434   1266   30266 77.1  CGAAAGCCAGGAAGTGGATGGCTT   16  36  25   22  27  17
1435   1267   14510 78.2  CGAAAGCCGATGCGAATGATAGCC   16  36  27   16   2  36
1436   1268   14511 82.2  CGAAAGCCGTGCGATGGGACGTCT   16  36  33   27  34  19
1437   1269   20732 75.4  GCTTTGATATCGCTTGACGGGACC   17   2  24   11  35  32
1438   1270   4811  80.2  GCTTTGATCAGCTCCCGACCTGCG   17   2  31   28  32  29
1439   1271   4812  78.8  GCTTTGATGACCCCATTCCCGACC   17   2  32   15  28  32
1440   1272   4829  77.1  GCTTAATCCAGCGGTATCCCCACG   17   4  31   18  28  30
1441   1273   30268 79.1  GCTTAAAGCGTTTGCGCCATGTGC   17   6  12   29  15  33
1442   1274   30269 77.5  GCTTAAAGCAGCGACCGCTTCGTT   17   6  31   32  17  12
1443   1275   14530 78.9  GCTTTCTGCTTGACGGCTTGGCAA   17   8  11   35  11  21
1444   1276   14532 75.6  GCTTTCTGCTCAGGACGCTTTCGT   17   8  13   34  17  10
1445   1277   4845  78    GCTTTCTGCTGTTCCCCAGCCTCA   17   8  14   28  31  13
1446   1278   14535 75.8  GCTTTCTGCCTAAGGATGCGATCG   17   8  26   25  29  24
1447   1279   14536 77.9  GCTTTCTGGGACGCAAATCGCCTA   17   8  34   21  24  26
1448   1280   20744 76.5  GCTTTGTCGAGTGTCTTCCCTGCG   17   9  20   19  28  29
1449   1281   14544 78.9  GCTTTGTCGACCGCTTCGAAGCAA   17   9  32   17  16  21
1450   1282   4867  80.6  GCTTTCGTTGTCGTGCTGCGCTCA   17  10   9   33  29  13
1451   1283   14548 77.7  GCTTTCGTCGTTGTGCAGGAGCAA   17  10  12   33  25  21
1452   1285   14552 78.2  GCTTTCGTGATGCCTATCCCTGCG   17  10  27   26  28  29
1453   1286   30272 75.5  GCTTTCGTAGCCTTAGTCCCGCAA   17  10  36   3   28  21
1454   1287   30273 77.1  GCTTCTTGCCATCTTGGATGTGCG   17  11  15   11  27  29
1455   1288   30274 76.5  GCTTCTTGGCAAAGTGCGTTACGG   17  11  21   22  12  35
1456   1289   4887  79.9  GCTTCTTGATCGACGGTCCCACGG   17  11  24   35  28  35
1457   1291   4907  78.7  GCTTCGTTCAGCCGTTGACCAGGA   17  12  31   12  32  25
1458   1292   30275 79    GCTTCGTTGTGCAGCCCGAATGTC   17  12  33   36  16   9
1459   1293   4917  80.9  GCTTCTCAGTGCGCTTTGCGCGTT   17  13  33   17  29  12
1460   1294   14568 80.1  GCTTCTGTACGGGACCGACCTGCG   17  14  35   32  32  29
1461   1295   30276 79.9  GCTTCCATTCCCGATGTCCCTCCC   17  15  28   27  28  28
1462   1296   14575 80    GCTTCGAACTTGGCAATCCCGTGC   17  16  11   21  28  33
1463   1297   4950  78.5  GCTTCGAACTGTGCAAAGCCCAGC   17  16  14   21  36  31
1464   1298   4953  78.1  GCTTCGAAAGTGGCAAACGGGATG   17  16  22   21  35  27
1465   1299   30277 77.3  GCTTCGAAAGGATGCGCTGTGATG   17  16  25   29  14  27
1466   1300   20755 75.2  GCTTGCTTCTTGATACAGCCGCAA   17  17  11    5  36  21
1467   1301   40247 76.7  GCTTGCTTTCCCTCTGAGCCGAGT   17  17  28    8  36  20
1468   1302   4982  76.1  GCTTGGTAGCAAGTGCGGACGAGT   17  18  21   33  34  20
1469   1303   4991  79.3  GCTTGAGTCGTTTCCCGACCAGCC   17  20  12   28  32  36
1470   1304   4994  81.1  GCTTGAGTGTGCTGCGCTTGCACG   17  20  33   29  11  30
1471   1305   14589 77.5  GCTTGCAAAAAGCACGCGAAAGTG   17  21   6   30  16  22
1472   1306   30279 78.2  GCTTGCAATCGTCTCAGCAATGCG   17  21  10   13  21  29
1473   1307   30280 78    GCTTGCAACGAAGTCTCAGCGCAA   17  21  16   19  31  21
1474   1308   30281 76.7  GCTTGCAAACCTCACGCCATCCTA   17  21  23   30  15  26
1475   1309   5005  78    GCTTGCAAGATGCAGCTCCCCCTA   17  21  27   31  28  26
1476   1310   5022  78.8  GCTTACCTCAGCTCCCAGCCAGCC   17  23  31   28  36  36
1477   1311   40248 75.7  GCTTATCGCTTGTCTGGTGCTCCC   17  24  11    8  33  28
1478   1312   30283 75.3  GCTTATCGCCTATTGAACGGCGTT   17  24  26    1  35  12
1479   1313   14603 78.7  GCTTATCGGACCGACCCTTGCGTT   17  24  32   32  11  12
```

FIG. 25DD

| SEQ ID NO: | 4,633 ID# | H3X ID# | Tm | ZIPCODE (5'-3') | TETRAMER NUMBERS | | | | |
|---|---|---|---|---|---|---|---|---|---|
| 1480 | 1314 | 5045 | 78.9 | GCTTCCTACGTTTGCGCTTGCGAA | 17 26 | 12 | 29 | 11 | 16 |
| 1481 | 1315 | 30284 | 78.9 | GCTTGATGGCAAAGGACACGACGG | 17 27 | 21 | 25 | 30 | 35 |
| 1482 | 1316 | 30285 | 77 | GCTTGATGCACGAAAGCGTTGCTT | 17 27 | 30 | 6 | 12 | 17 |
| 1483 | 1317 | 20770 | 76 | GCTTGATGGTGCATACCGTTTCCC | 17 27 | 33 | 5 | 12 | 28 |
| 1484 | 1318 | 5072 | 78.3 | GCTTTCCCATCGGTCTGACCTCCC | 17 28 | 24 | 19 | 32 | 28 |
| 1485 | 1319 | 14622 | 80.2 | GCTTTCCCGACCGGTATGTCGCAA | 17 28 | 32 | 18 | 9 | 21 |
| 1486 | 1320 | 30289 | 79.7 | GCTTTGCGTACAACGGGCAATCCC | 17 29 | 7 | 35 | 21 | 28 |
| 1487 | 1321 | 14629 | 78.8 | GCTTTGCGCGAAGAGTATCGGCAA | 17 29 | 16 | 20 | 24 | 21 |
| 1488 | 1322 | 5087 | 75.6 | GCTTTGCGGGTAAATCGAGTACGG | 17 29 | 18 | 4 | 20 | 35 |
| 1489 | 1323 | 30290 | 79.4 | GCTTTGCGAGTGGGACCTTGAGCC | 17 29 | 22 | 34 | 11 | 36 |
| 1490 | 1324 | 14631 | 77.5 | GCTTTGCGATCGGCAATCCCTTAG | 17 29 | 24 | 21 | 28 | 3 |
| 1491 | 1325 | 14632 | 79.4 | GCTTTGCGACGGTGTCAAAGGCAA | 17 29 | 35 | 9 | 6 | 21 |
| 1492 | 1326 | 5097 | 81.5 | GCTTCACGTGTCCACGTCCCCACG | 17 30 | 9 | 30 | 28 | 30 |
| 1493 | 1327 | 40252 | 76.5 | GCTTCACGCTTGAAAGCAGCGAGT | 17 30 | 11 | 6 | 31 | 20 |
| 1494 | 1328 | 5100 | 75.7 | GCTTCACGCTGTTACAATCGGCAA | 17 30 | 14 | 7 | 24 | 21 |
| 1495 | 1329 | 14636 | 79.9 | GCTTCACGTCCCGATGCTTGGACC | 17 30 | 28 | 27 | 11 | 32 |
| 1496 | 1330 | 30293 | 80.4 | GCTTCACGGACCCACGGAGTCGAA | 17 30 | 32 | 30 | 20 | 16 |
| 1497 | 1331 | 5108 | 78.6 | GCTTCAGCAATCTCCCCGAAAGCC | 17 31 | 4 | 28 | 16 | 36 |
| 1498 | 1332 | 5109 | 79.6 | GCTTCAGCTCTGAGCCTCCCCACG | 17 31 | 8 | 36 | 28 | 30 |
| 1499 | 1333 | 30294 | 75 | GCTTCAGCTCGTAATCTCCCCAGC | 17 31 | 10 | 4 | 28 | 31 |
| 1500 | 1334 | 5117 | 75.8 | GCTTCAGCGCAAAAAGAATCGACC | 17 31 | 21 | 6 | 4 | 32 |
| 1501 | 1335 | 40256 | 78.3 | GCTTCAGCACCTGGTAAGCCACGG | 17 31 | 23 | 18 | 36 | 35 |
| 1502 | 1336 | 5123 | 79.7 | GCTTCAGCCACGGCAACTCAGCAA | 17 31 | 30 | 21 | 13 | 21 |
| 1503 | 1337 | 5128 | 80.8 | GCTTGACCAATCCACGTGCGAGCC | 17 32 | 4 | 30 | 29 | 36 |
| 1504 | 1338 | 30296 | 77.5 | GCTTGACCCCATGCTTGCTTAGCC | 17 32 | 15 | 17 | 17 | 36 |
| 1505 | 1339 | 40258 | 79.7 | GCTTGACCCCTAAGCCCACGCTCA | 17 32 | 26 | 36 | 30 | 13 |
| 1506 | 1340 | 14653 | 81.1 | GCTTGACCCAGCGACCGTGCTCTG | 17 32 | 31 | 32 | 33 | 8 |
| 1507 | 1341 | 14656 | 78.6 | GCTTGTGCATCGGTGCCTTGACCT | 17 33 | 24 | 33 | 11 | 23 |
| 1508 | 1342 | 5148 | 77.6 | GCTTGTGCTCCCAATCTGCGTTGA | 17 33 | 28 | 4 | 29 | 1 |
| 1509 | 1343 | 20786 | 79.4 | GCTTGGACCGTTTCTGGTGCCCAT | 17 34 | 12 | 8 | 33 | 15 |
| 1510 | 1344 | 5158 | 76.1 | GCTTGGACCGAATCTGGCAATGTC | 17 34 | 16 | 8 | 21 | 9 |
| 1511 | 1345 | 5161 | 78.6 | GCTTGGACTCCCCTTGTGTCGCAA | 17 34 | 28 | 11 | 9 | 21 |
| 1512 | 1346 | 40259 | 77.9 | GCTTGGACCACGTACATCCCAGCC | 17 34 | 30 | 7 | 28 | 36 |
| 1513 | 1347 | 14668 | 78.6 | GCTTACGGTCTGACGGTGCGTCGT | 17 35 | 8 | 35 | 29 | 10 |
| 1514 | 1348 | 30301 | 75.9 | GCTTAGCCCTGTAATCACGGGCAA | 17 36 | 14 | 4 | 35 | 21 |
| 1515 | 1349 | 5192 | 76.4 | GCTTAGCCATCGCTCAAAAGCGAA | 17 36 | 24 | 13 | 6 | 16 |
| 1516 | 1350 | 5216 | 76.9 | GGTATCTGGTGCAGGACGAATGCG | 18 8 | 33 | 25 | 16 | 29 |
| 1517 | 1351 | 5219 | 80.1 | GGTATGTCGCTTTGCGCAGCTCCC | 18 9 | 17 | 29 | 31 | 28 |
| 1518 | 1352 | 5252 | 78.6 | GGTACGAACAGCGGTAAGCCGCAA | 18 16 | 31 | 18 | 36 | 21 |
| 1519 | 1353 | 30304 | 75.2 | GGTACGAAAGCCTACAAGCCCGAA | 18 16 | 36 | 7 | 36 | 16 |
| 1520 | 1354 | 5266 | 80.2 | GGTAGCAACAGCGACCCAGCCAGC | 18 21 | 31 | 32 | 31 | 31 |
| 1521 | 1355 | 5268 | 77.3 | GGTAGCAAGGACTGCGTCTGTGCG | 18 21 | 34 | 29 | 8 | 29 |
| 1522 | 1356 | 5277 | 79.8 | GGTAACCTCACGTGCGCTGTTGCG | 18 23 | 30 | 29 | 14 | 29 |
| 1523 | 1357 | 40264 | 76.1 | GGTAATCGGCAACGTTCTTGACGG | 18 24 | 21 | 12 | 11 | 35 |
| 1524 | 1358 | 5296 | 76.5 | GGTAGATGGCTTCGTTTCCCCAGC | 18 27 | 17 | 12 | 28 | 31 |
| 1525 | 1359 | 14728 | 76.9 | GGTATGCGGCAACTGTATCGGTGC | 18 29 | 21 | 14 | 24 | 33 |
| 1526 | 1360 | 5328 | 77 | GGTATGCGAGTGGTGCGGTAGTGC | 18 29 | 22 | 33 | 18 | 33 |
| 1527 | 1361 | 30306 | 76.3 | GGTACGGCAACGTTCCATTCGT | 18 30 | 21 | 12 | 15 | 10 |
| 1528 | 1362 | 5341 | 78.7 | GGTACGGATCGGACCAGGATGCG | 18 30 | 24 | 32 | 25 | 29 |
| 1529 | 1363 | 5344 | 78.1 | GGTACGGAGCCGAGTCAGCGCTT | 18 30 | 36 | 20 | 31 | 17 |
| 1530 | 1364 | 30307 | 75.7 | GGTACAGCGCTTAGGAGGACGTGC | 18 31 | 17 | 25 | 34 | 33 |

FIG. 25EE

| SEQ ID NO: | 4,633 ID# | HEX ID# | Tm | ZIPCODE (5'-3') | TETRAMER NUMBERS | | | | |
|---|---|---|---|---|---|---|---|---|---|
| 1531 | 1365 | 5355 | 78.2 | GGTACAGCGACCCTGTTCCCTCCC | 18 | 31 | 32 | 14 | 28 28 |
| 1532 | 1366 | 5360 | 76.6 | GGTAGACCGGTACAGCATCGCGAA | 18 | 32 | 18 | 31 | 24 16 |
| 1533 | 1367 | 5362 | 79.8 | GGTAGACCATCGCAGCGTGCATCG | 18 | 32 | 24 | 31 | 33 24 |
| 1534 | 1368 | 40267 | 80.4 | GGTAGACCGTGCCCATCCATTGCG | 18 | 32 | 33 | 15 | 15 29 |
| 1535 | 1369 | 5368 | 75.5 | GGTAGACCACGGTTAGTGCGAGCC | 18 | 32 | 35 | 3 | 29 36 |
| 1536 | 1370 | 30308 | 76.2 | GGTAACGGTCGTTTAGACGGTGCG | 18 | 35 | 10 | 3 | 35 29 |
| 1537 | 1371 | 30309 | 77.6 | GGTAACGGCTGTGTGCGATGGATG | 18 | 35 | 14 | 33 | 27 27 |
| 1538 | 1372 | 30310 | 75.4 | GGTAAGCCGAGTACCTTGCGCTGT | 18 | 36 | 20 | 23 | 29 14 |
| 1539 | 1373 | 5420 | 77.3 | GTCTTTGATGCGCGTTTGCGAAAG | 19 | 1 | 29 | 12 | 29 6 |
| 1540 | 1374 | 5425 | 79 | GTCTTCTGCAGCTGCGCTTGCCAT | 19 | 8 | 31 | 29 | 11 15 |
| 1541 | 1376 | 5437 | 81.1 | GTCTCTTGCAGCACGGTCCCTGCG | 19 | 11 | 31 | 35 | 28 29 |
| 1542 | 1377 | 5440 | 78.2 | GTCTCGTTCGAACAGCAGCCGCTT | 19 | 12 | 16 | 31 | 36 17 |
| 1543 | 1378 | 5444 | 80.7 | GTCTCGTTGTGCCACGTCGTTGCG | 19 | 12 | 33 | 30 | 10 29 |
| 1544 | 1379 | 5449 | 77.2 | GTCTCCATTCCCACGGCTGTAGCC | 19 | 15 | 28 | 35 | 14 36 |
| 1545 | 1380 | 5450 | 78.1 | GTCTCGAACGAACAGCGCAACACG | 19 | 16 | 16 | 31 | 21 30 |
| 1546 | 1381 | 5453 | 79.1 | GTCTCGAAATCGCGAAACGGGACC | 19 | 16 | 24 | 16 | 35 32 |
| 1547 | 1382 | 20836 | 75 | GTCTGCAAATCGAATCTCCCCGTT | 19 | 21 | 24 | 4 | 28 12 |
| 1548 | 1383 | 5481 | 81.2 | GTCTGATGCAGCATCGTGCGGCAA | 19 | 27 | 31 | 24 | 29 21 |
| 1549 | 1384 | 30311 | 80.3 | GTCTTCCCCTTGACGGCGTTGCAA | 19 | 28 | 11 | 35 | 12 21 |
| 1550 | 1385 | 30312 | 76.5 | GTCTTCCCCCATTCTGACGGGGTA | 19 | 28 | 15 | 8 | 35 18 |
| 1551 | 1386 | 40269 | 78.8 | GTCTTCCCACGGAGTGCCATGTGC | 19 | 28 | 35 | 22 | 15 33 |
| 1552 | 1387 | 5498 | 78.5 | GTCTTGCGAGTGATCGAGCCAGCC | 19 | 29 | 22 | 24 | 36 36 |
| 1553 | 1388 | 30313 | 77.3 | GTCTTGCGGACCTCCCTACAACGG | 19 | 29 | 32 | 28 | 7 35 |
| 1554 | 1389 | 5507 | 78.7 | GTCTCACGCTCAACGGCTTGCCAT | 19 | 30 | 13 | 35 | 11 15 |
| 1555 | 1390 | 30314 | 79.2 | GTCTCACGGCTTTGTCAGCCGTGC | 19 | 30 | 17 | 9 | 36 33 |
| 1556 | 1391 | 5509 | 78.8 | GTCTCACGCCTAGACCTGCGGCAA | 19 | 30 | 26 | 32 | 29 21 |
| 1557 | 1392 | 5510 | 79.1 | GTCTCACGTCCCCTGTGCTTTGCG | 19 | 30 | 28 | 14 | 17 29 |
| 1558 | 1393 | 14801 | 79.9 | GTCTCACGACGGCGTTCGTTGTGC | 19 | 30 | 35 | 12 | 12 33 |
| 1559 | 1394 | 5519 | 77.1 | GTCTCAGCCAGCTCGTTCGTCGAA | 19 | 31 | 31 | 10 | 10 16 |
| 1560 | 1395 | 5520 | 79.6 | GTCTCAGCGGACGGACGGACCCTA | 19 | 31 | 34 | 34 | 34 26 |
| 1561 | 1396 | 40271 | 78.9 | GTCTGTGCGCTTCACGTTGATGCG | 19 | 33 | 17 | 30 | 1 29 |
| 1562 | 1397 | 40272 | 78.5 | GTCTGTGCGCAAGGACCGTTCCAT | 19 | 33 | 21 | 34 | 12 15 |
| 1563 | 1399 | 40273 | 80.6 | GTCTGTGCAGCCGCTTTCCAGGA | 19 | 33 | 36 | 17 | 28 25 |
| 1564 | 1400 | 30315 | 75.8 | GTCTGGACGCTTACGGCGAAAAAG | 19 | 34 | 17 | 35 | 16 6 |
| 1565 | 1401 | 5540 | 81.7 | GTCTGGACTCCCGCAACACGTGCG | 19 | 34 | 28 | 21 | 30 29 |
| 1566 | 1402 | 5545 | 79.8 | GTCTGGACAGCCATCGATCGTGCG | 19 | 34 | 36 | 24 | 24 29 |
| 1567 | 1403 | 14814 | 75.6 | GTCTAGCCGGTACAGCTCCCATCG | 19 | 36 | 18 | 31 | 28 24 |
| 1568 | 1404 | 5568 | 83.1 | GAGTTCTGTGCGCACGCACGGCAA | 20 | 8 | 29 | 30 | 30 21 |
| 1569 | 1405 | 5569 | 80.9 | GAGTTCTGCACGACGGCACGTCCC | 20 | 8 | 30 | 35 | 30 28 |
| 1570 | 1407 | 5577 | 79 | GAGTCTTGCACGCCATAGCCCACG | 20 | 11 | 30 | 15 | 36 30 |
| 1571 | 1408 | 5580 | 77.2 | GAGTCGTTCGTTAGCCATCGTGCG | 20 | 12 | 12 | 36 | 24 29 |
| 1572 | 1409 | 20857 | 77.9 | GAGTCTGTCACGCAGCAGCCAGGA | 20 | 14 | 30 | 31 | 36 25 |
| 1573 | 1410 | 30317 | 77.9 | GAGTCGAAAGCCTGCGTCGTCCAT | 20 | 16 | 36 | 29 | 10 15 |
| 1574 | 1411 | 5597 | 77.7 | GAGTGCTTGCAACACGCACGACCT | 20 | 17 | 21 | 30 | 30 23 |
| 1575 | 1412 | 5599 | 81.9 | GAGTGCTTCACGGTGCGTGCAGCC | 20 | 17 | 30 | 33 | 33 36 |
| 1576 | 1413 | 5612 | 76.5 | GAGTATCGTGCGATCGGACCCTCA | 20 | 24 | 29 | 24 | 32 13 |
| 1577 | 1414 | 20866 | 77.7 | GAGTCCTACAGCTCCCGCTTTGCG | 20 | 26 | 31 | 28 | 17 29 |
| 1578 | 1415 | 5633 | 78 | GAGTCCCGTGCCCTATCGTGTGC | 20 | 28 | 33 | 26 | 10 33 |
| 1579 | 1416 | 14828 | 80.9 | GAGTGCGAAAGCACGGGACGTGC | 20 | 29 | 6 | 30 | 34 33 |
| 1580 | 1417 | 5645 | 76.4 | GAGTGCGCCATTACATCCCGGTA | 20 | 29 | 15 | 7 | 28 18 |
| 1581 | 1418 | 40276 | 77.2 | GAGTTGCGGGTAGCAATCTGCACG | 20 | 29 | 18 | 21 | 8 30 |

FIG. 25FF

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1582 | 1419 | 40277 | 79.5 | GAGTTGCGACCTAGCCTCCCTGCG | 20 | 29 | 23 | 36 | 28 | 29 |
| 1583 | 1420 | 5671 | 81.7 | GAGTCAGCGATGGTGCGGACACGG | 20 | 31 | 27 | 33 | 34 | 35 |
| 1584 | 1421 | 20874 | 76.3 | GAGTCAGCTCCCTCTGGACCCGTT | 20 | 31 | 28 | 8 | 32 | 12 |
| 1585 | 1422 | 5673 | 79.3 | GAGTCAGCGGACAGCCGAGTCACG | 20 | 31 | 34 | 36 | 20 | 30 |
| 1586 | 1423 | 5676 | 76.7 | GAGTGACCCGTTTCCCCGAACTGT | 20 | 32 | 12 | 28 | 16 | 14 |
| 1587 | 1425 | 14843 | 80.9 | GAGTGACCGTGCGACCAGCCCTTG | 20 | 32 | 33 | 32 | 36 | 11 |
| 1588 | 1426 | 20876 | 76.4 | GAGTGTGCTTGAGGACTCCCGTGC | 20 | 33 | 1 | 34 | 28 | 33 |
| 1589 | 1428 | 5693 | 77.8 | GAGTGGACCCATTGTCGGACGGAC | 20 | 34 | 15 | 9 | 34 | 34 |
| 1590 | 1429 | 5699 | 77.8 | GAGTGGACGGACTGTCATCGCACG | 20 | 34 | 34 | 9 | 24 | 30 |
| 1591 | 1430 | 14849 | 75.3 | GAGTACGGCCATTTAGTGCGGCTT | 20 | 35 | 15 | 3 | 29 | 17 |
| 1592 | 1431 | 5716 | 79.9 | GAGTAGCCATCGGACCAGCCCACG | 20 | 36 | 24 | 32 | 36 | 30 |
| 1593 | 1432 | 5730 | 79 | GCAATTGAGTGCGGACCGAACAGC | 21 | 1 | 33 | 34 | 16 | 31 |
| 1594 | 1433 | 5732 | 78.7 | GCAATGATTCGTTCCCCTTGCACG | 21 | 2 | 10 | 28 | 11 | 30 |
| 1595 | 1434 | 5737 | 80.1 | GCAATGATCAGCGCTTTCCCAGCC | 21 | 2 | 31 | 17 | 28 | 36 |
| 1596 | 1435 | 5752 | 77.6 | GCAAAATCATCGGTGCCGAAACCT | 21 | 4 | 24 | 33 | 16 | 23 |
| 1597 | 1436 | 40281 | 77.2 | GCAAAATCTCCCATCGCTCATCCC | 21 | 4 | 28 | 24 | 13 | 28 |
| 1598 | 1437 | 14874 | 78.9 | GCAAAATCCACGCAGCCTGTGACC | 21 | 4 | 30 | 31 | 14 | 32 |
| 1599 | 1438 | 5778 | 75.5 | GCAAAAGACCTAGGAAGCCGCAA | 21 | 6 | 23 | 25 | 36 | 21 |
| 1600 | 1440 | 30319 | 76.2 | GCAATCTGCGTTTTAGGGACACGG | 21 | 8 | 12 | 3 | 34 | 35 |
| 1601 | 1441 | 30320 | 76.7 | GCAATCTGGCAACGTTATCGCGTT | 21 | 8 | 21 | 12 | 24 | 12 |
| 1602 | 1442 | 5792 | 78.2 | GCAATCTGTCCCGCAACTCAAGCC | 21 | 8 | 28 | 21 | 13 | 36 |
| 1603 | 1443 | 5793 | 80.8 | GCAATCTGTGCGCTGTGGACGTGC | 21 | 8 | 29 | 14 | 34 | 33 |
| 1604 | 1444 | 30321 | 77.4 | GCAATCTGGACCAATCAGCCCCAT | 21 | 8 | 32 | 4 | 36 | 15 |
| 1605 | 1445 | 40284 | 82.7 | GCAATCTGGGACAGCCGTGCCAGC | 21 | 8 | 34 | 36 | 33 | 31 |
| 1606 | 1446 | 5796 | 80.4 | GCAATGTCTCGTGACCTGCGCGAA | 21 | 9 | 10 | 32 | 29 | 16 |
| 1607 | 1447 | 30323 | 78.4 | GCAATGTCGCTTTCGTGTGCCTCA | 21 | 9 | 17 | 10 | 33 | 13 |
| 1608 | 1448 | 20893 | 77 | GCAATGTCGGTAGACCTCCCGCTT | 21 | 9 | 18 | 32 | 28 | 17 |
| 1609 | 1449 | 14901 | 80.5 | GCAATGTCATCGTCCCTCCCCACG | 21 | 9 | 24 | 28 | 28 | 30 |
| 1610 | 1450 | 5804 | 79 | GCAATGTCTGCGGATGCGAAGGAC | 21 | 9 | 29 | 27 | 16 | 34 |
| 1611 | 1451 | 14902 | 79.2 | GCAATGTCCACGCGAAATCGTCGT | 21 | 9 | 30 | 16 | 24 | 10 |
| 1612 | 1452 | 5812 | 77.5 | GCAATCGTCTGTTGCGAATCCGAA | 21 | 10 | 14 | 29 | 4 | 16 |
| 1613 | 1453 | 5818 | 77.5 | GCAATCGTACCTGCTTGTGCCGAA | 21 | 10 | 23 | 17 | 33 | 16 |
| 1614 | 1455 | 30324 | 77.3 | GCAATCGTAGCCTGATTCCCCAGC | 21 | 10 | 36 | 2 | 28 | 31 |
| 1615 | 1456 | 5835 | 81.2 | GCAACTTGGATGAGCCCACGCGAA | 21 | 11 | 27 | 36 | 30 | 16 |
| 1616 | 1457 | 14911 | 79.4 | GCAACTTGCAGCCGAAGCAAGTGC | 21 | 11 | 31 | 16 | 21 | 33 |
| 1617 | 1458 | 40286 | 77.1 | GCAACGTTTGATCGTCACGAGCC | 21 | 12 | 1 | 10 | 30 | 36 |
| 1618 | 1459 | 5842 | 80.2 | GCAACGTTTACAACGGCAGCGCAA | 21 | 12 | 7 | 35 | 31 | 21 |
| 1619 | 1460 | 14919 | 81.6 | GCAACGTTGATGGTGCTCCCTGCG | 21 | 12 | 27 | 33 | 28 | 29 |
| 1620 | 1461 | 30326 | 77.3 | GCAACGTTTCCCACCTTTGAAGCC | 21 | 12 | 28 | 23 | 1 | 36 |
| 1621 | 1464 | 5860 | 78.6 | GCAACTCAATCGCGAAGTGCCCAT | 21 | 13 | 24 | 16 | 33 | 15 |
| 1622 | 1466 | 5863 | 80.2 | GCAACTCACACGACGGGTGCAGGA | 21 | 13 | 30 | 35 | 33 | 25 |
| 1623 | 1467 | 5864 | 78.6 | GCAACTCAACGGGCTTGGACAGGA | 21 | 13 | 35 | 17 | 34 | 25 |
| 1624 | 1468 | 30327 | 78.7 | GCAACTGTTGCGGCAAGCAAACCT | 21 | 14 | 29 | 21 | 21 | 23 |
| 1625 | 1469 | 5875 | 79.5 | GCAACCATCTCAGGACCAGCGCAA | 21 | 15 | 13 | 34 | 31 | 21 |
| 1626 | 1470 | 20911 | 77.5 | GCAACCATCGAATGTCACGGATCG | 21 | 15 | 16 | 9 | 35 | 24 |
| 1627 | 1471 | 5881 | 79 | GCAACCATGATGACGGTCCCAGGA | 21 | 15 | 27 | 35 | 28 | 25 |
| 1628 | 1472 | 5882 | 75.8 | GCAACCATTGCGTCCCTTAGTCGT | 21 | 15 | 29 | 28 | 3 | 10 |
| 1629 | 1473 | 5885 | 79.7 | GCAACCATGGACGATGCGAAGTGC | 21 | 15 | 34 | 27 | 16 | 33 |
| 1630 | 1474 | 20915 | 76.2 | GCAACGAAGCTTGACCTGTCGCTT | 21 | 16 | 17 | 32 | 9 | 17 |
| 1631 | 1475 | 40288 | 77 | GCAAGCTTGCTTTGTCCTTGGCAA | 21 | 17 | 17 | 9 | 11 | 21 |
| 1632 | 1476 | 5912 | 78.2 | GCAAGCTTCACGGCTTCAGCCTGT | 21 | 17 | 30 | 17 | 31 | 14 |

FIG. 25GG

| SEQ ID NO: | 4,633 ID# | HEX ID# | Tm | ZIPCODE (5'-3') | TETRAMER NUMBERS | | | | |
|---|---|---|---|---|---|---|---|---|---|
| 1633 | 1477 | 5914 | 78.8 | GCAAGCTTAGCCGATGGTGCCTCA | 21 17 | 36 | 27 | 33 | 13 |
| 1634 | 1478 | 5924 | 75 | GCAAGTCTGCTTAATCGACCGCAA | 21 19 | 17 | 4 | 32 | 21 |
| 1635 | 1480 | 14946 | 78.1 | GCAAGCAAAATCGCAATCGTTCCC | 21 21 | 4 | 21 | 10 | 28 |
| 1636 | 1481 | 5946 | 79.3 | GCAAGCAACTTGCTCATGCGAGCC | 21 21 | 11 | 13 | 29 | 36 |
| 1637 | 1482 | 5948 | 76.7 | GCAAGCAACTCAGACCCACGTCGT | 21 21 | 13 | 32 | 30 | 10 |
| 1638 | 1483 | 5952 | 75.6 | GCAAGCAAGCTTTCCCGATGAATC | 21 21 | 17 | 28 | 27 | 4 |
| 1639 | 1484 | 40290 | 78.4 | GCAAGCAACAGCATACGACCGCAA | 21 21 | 31 | 5 | 32 | 21 |
| 1640 | 1486 | 14955 | 77.4 | GCAAAGTGGGTACCATTGCGCTCA | 21 22 | 18 | 15 | 29 | 13 |
| 1641 | 1487 | 20929 | 78.4 | GCAAACCTTCTGAGCCCTTGCACG | 21 23 | 8 | 36 | 11 | 30 |
| 1642 | 1488 | 5978 | 79.2 | GCAAACCTTGTCCAGCTCCCGGAC | 21 23 | 9 | 31 | 28 | 34 |
| 1643 | 1490 | 20930 | 77.9 | GCAAACCTCCATTGCGGGACAATC | 21 23 | 15 | 29 | 34 | 4 |
| 1644 | 1491 | 30333 | 76.8 | GCAAACCTGCAAGACCCTCAGCAA | 21 23 | 21 | 32 | 13 | 21 |
| 1645 | 1492 | 40294 | 80.3 | GCAAACCTGACCGCAAAGCCGGTA | 21 23 | 32 | 21 | 36 | 18 |
| 1646 | 1493 | 14961 | 80 | GCAAACCTGGACGCAAGACCGACC | 21 23 | 34 | 21 | 32 | 32 |
| 1647 | 1494 | 40295 | 75.4 | GCAAATCGCTCACCTAAGCCGTCT | 21 24 | 13 | 26 | 36 | 19 |
| 1648 | 1495 | 30334 | 78.2 | GCAAATCGGAGTTGTCCAGCAGCC | 21 24 | 20 | 9 | 31 | 36 |
| 1649 | 1497 | 40297 | 79.4 | GCAAATCGTCCCCAGCTGTCCCAT | 21 24 | 28 | 31 | 9 | 15 |
| 1650 | 1498 | 6006 | 77.2 | GCAAATCGGACCATACGTGCAGGA | 21 24 | 32 | 5 | 33 | 25 |
| 1651 | 1500 | 6010 | 78.9 | GCAAAGGATCTGTGCGGCAAATCG | 21 25 | 8 | 29 | 21 | 24 |
| 1652 | 1501 | 14971 | 80.7 | GCAAAGGACTTGGGACACGGTGCG | 21 25 | 11 | 34 | 35 | 29 |
| 1653 | 1502 | 6012 | 79.7 | GCAAAGGACTCAGTGCAGCCGCAA | 21 25 | 13 | 33 | 36 | 21 |
| 1654 | 1503 | 40298 | 75.1 | GCAAAGGAACCTATCGGATGCGTT | 21 25 | 23 | 24 | 27 | 12 |
| 1655 | 1504 | 14972 | 78.4 | GCAAAGGAATCGCACGGGTACGAA | 21 25 | 24 | 30 | 18 | 16 |
| 1656 | 1505 | 6024 | 79.1 | GCAACCTAGACCGCTTTCCCACGG | 21 26 | 32 | 17 | 28 | 35 |
| 1657 | 1506 | 14975 | 76.5 | GCAACCTAAGCCAGGATCGTTCCC | 21 26 | 36 | 25 | 10 | 28 |
| 1658 | 1507 | 30336 | 76.3 | GCAAGATGCGTTAGTGGGACAGCC | 21 27 | 12 | 22 | 34 | 36 |
| 1659 | 1508 | 14978 | 78.3 | GCAAGATGCCTACACGCGAAAGCC | 21 27 | 26 | 30 | 16 | 36 |
| 1660 | 1509 | 6038 | 77.2 | GCAAGATGTGCGTTGAGACCCAGC | 21 27 | 29 | 1 | 32 | 31 |
| 1661 | 1510 | 14982 | 77.1 | GCAATCCCAATCACGGCGAATACA | 21 28 | 4 | 35 | 16 | 7 |
| 1662 | 1511 | 14983 | 78.2 | GCAATCCCTCTGCAGCGAGTGCTT | 21 28 | 8 | 31 | 20 | 17 |
| 1663 | 1512 | 30342 | 82.2 | GCAATCCCACGGGACAATCGTGC | 21 28 | 35 | 34 | 4 | 33 |
| 1664 | 1513 | 40304 | 79.6 | GCAATGCGTTAGGATGCCATTGCG | 21 29 | 3 | 27 | 15 | 29 |
| 1665 | 1514 | 40305 | 79.3 | GCAATGCGAAAGGATGCGTTCGAA | 21 29 | 6 | 27 | 12 | 16 |
| 1666 | 1515 | 6065 | 78.4 | GCAATGCGTCGTCGAATCGTCTCA | 21 29 | 10 | 16 | 10 | 13 |
| 1667 | 1516 | 6067 | 80.9 | GCAATGCGCGTTGTGCCTGTGGTA | 21 29 | 12 | 33 | 14 | 18 |
| 1668 | 1517 | 30344 | 79.9 | GCAATGCGCTCAACCTCGTTGTGC | 21 29 | 13 | 23 | 12 | 33 |
| 1669 | 1518 | 6069 | 79.7 | GCAATGCGCGAATCTGGATGATCG | 21 29 | 16 | 8 | 27 | 24 |
| 1670 | 1519 | 6071 | 81.9 | GCAATGCGCAGCGCTTTCTGATCG | 21 29 | 31 | 17 | 8 | 24 |
| 1671 | 1520 | 6072 | 76.5 | GCAATGCGGGACTTAGACCTTCCC | 21 29 | 34 | 3 | 23 | 28 |
| 1672 | 1521 | 6075 | 79.8 | GCAACACGAATCGATGCAGCGGAC | 21 30 | 4 | 27 | 31 | 34 |
| 1673 | 1522 | 6077 | 79.3 | GCAACACGTCTGCCTATGCGCCAT | 21 30 | 8 | 26 | 29 | 15 |
| 1674 | 1523 | 14994 | 77.8 | GCAACACGCGTTCTGTGGTAACGG | 21 30 | 12 | 14 | 18 | 35 |
| 1675 | 1524 | 40306 | 77 | GCAACACGCTCAGCAAAAAGCGTT | 21 30 | 13 | 21 | 6 | 12 |
| 1676 | 1525 | 6091 | 79.4 | GCAACACGTCCCGTCTTCCCCTGT | 21 30 | 28 | 19 | 28 | 14 |
| 1677 | 1526 | 15001 | 80.2 | GCAACACGGGACCACGATCGGAGT | 21 30 | 34 | 30 | 24 | 20 |
| 1678 | 1527 | 15002 | 80.7 | GCAACAGCTTGATGCGCCATCACG | 21 31 | 1 | 29 | 15 | 30 |
| 1679 | 1528 | 40308 | 75.4 | GCAACAGCTCGTAGGAATCGGCTT | 21 31 | 10 | 25 | 24 | 17 |
| 1680 | 1529 | 20970 | 77.8 | GCAACAGCCCATAGTGATCGCACG | 21 31 | 15 | 22 | 24 | 30 |
| 1681 | 1530 | 30346 | 75.9 | GCAACAGCGGTAAAAGGCTTCAGC | 21 31 | 18 | 6 | 17 | 31 |
| 1682 | 1531 | 30347 | 77.3 | GCAACAGCGAGTAGGAGTGCCACG | 21 31 | 20 | 25 | 33 | 30 |
| 1683 | 1532 | 15007 | 75.1 | GCAACAGCCCTAATACAGCCCGTT | 21 31 | 26 | 5 | 36 | 12 |

FIG. 25HH

| SEQ ID NO: | 4,633 ID# | HEX ID# | Tm | ZIPCODE (5'-3') | TETRAMER NUMBERS | | | | |
|---|---|---|---|---|---|---|---|---|---|
| 1684 | 1533 | 15008 | 80.3 | GCAACAGCCACGCTTGCAGCTCTG | 21 | 31 | 30 | 11 | 31 | 8 |
| 1685 | 1534 | 40312 | 77.6 | GCAAGACCCCATTCGTCGTTTCGT | 21 | 32 | 15 | 10 | 12 | 10 |
| 1686 | 1535 | 30348 | 76.1 | GCAAGACCACCTAATCGGACACGG | 21 | 32 | 23 | 4 | 34 | 35 |
| 1687 | 1536 | 40313 | 79.9 | GCAAGACCGGACGGACCACGAAAG | 21 | 32 | 34 | 34 | 30 | 6 |
| 1688 | 1537 | 30349 | 78.2 | GCAAGTGCCTTGAATCTGCGGGAC | 21 | 33 | 11 | 4 | 29 | 34 |
| 1689 | 1538 | 30350 | 78.9 | GCAAGTGCCTGTCTGTTCCCACGG | 21 | 33 | 14 | 14 | 28 | 35 |
| 1690 | 1539 | 20980 | 76.9 | GCAAGTGCGGTATCCCGAGTGATG | 21 | 33 | 18 | 28 | 20 | 27 |
| 1691 | 1540 | 40314 | 78.1 | GCAAGTGCGCAATTAGATCGTGCG | 21 | 33 | 21 | 3 | 24 | 29 |
| 1692 | 1541 | 40315 | 80.8 | GCAAGTGCACCTGACCTCCCCACG | 21 | 33 | 23 | 32 | 28 | 30 |
| 1693 | 1542 | 6133 | 78.4 | GCAAGTGCATCGCCTAGTGCTCCC | 21 | 33 | 24 | 26 | 33 | 28 |
| 1694 | 1543 | 15018 | 78.1 | GCAAGTGCCCTAGTGCGTGCAGTG | 21 | 33 | 26 | 33 | 33 | 22 |
| 1695 | 1544 | 6137 | 80.4 | GCAAGTGCTCCCGTCTGTGCCCAT | 21 | 33 | 28 | 19 | 33 | 15 |
| 1696 | 1545 | 15020 | 77.7 | GCAAGTGCGTGCAAAGGCTTTTGA | 21 | 33 | 33 | 6 | 17 | 1 |
| 1697 | 1546 | 15021 | 78.5 | GCAAGTGCACGGACCTTCGTCCAT | 21 | 33 | 35 | 23 | 10 | 15 |
| 1698 | 1547 | 6142 | 81 | GCAAGGACAATCCGAATGCGGCAA | 21 | 34 | 4 | 16 | 29 | 21 |
| 1699 | 1548 | 40316 | 81.8 | GCAAGGACTCGTGGACGTGCGTGC | 21 | 34 | 10 | 34 | 33 | 33 |
| 1700 | 1549 | 30351 | 78.1 | GCAAGGACCTGTTCTGGCAAACGG | 21 | 34 | 14 | 8 | 21 | 35 |
| 1701 | 1551 | 6151 | 78 | GCAAGGACATCGCCATTCCCTGTC | 21 | 34 | 24 | 15 | 28 | 9 |
| 1702 | 1552 | 40317 | 77.6 | GCAAGGACCAGCTTAGGGACTGCG | 21 | 34 | 31 | 3 | 34 | 29 |
| 1703 | 1553 | 6156 | 77.5 | GCAAGGACGGACAGGAGCTTGACC | 21 | 34 | 34 | 25 | 17 | 32 |
| 1704 | 1554 | 6159 | 78.3 | GCAAACGGCTGTCACGTGATCGAA | 21 | 35 | 14 | 30 | 2 | 16 |
| 1705 | 1555 | 6160 | 78.1 | GCAAACGGGCTTGTGCCCTAAGTG | 21 | 35 | 17 | 33 | 26 | 22 |
| 1706 | 1556 | 40318 | 79.9 | GCAAACGGGTCTGAGTCACGCACG | 21 | 35 | 19 | 20 | 30 | 30 |
| 1707 | 1557 | 15029 | 78.7 | GCAAACGGAGTGCTCACAGCCGTT | 21 | 35 | 22 | 13 | 31 | 12 |
| 1708 | 1558 | 6164 | 81.8 | GCAAACGGTGCGCGAAGTCTGTGC | 21 | 35 | 29 | 16 | 19 | 33 |
| 1709 | 1559 | 6167 | 81.1 | GCAAACGGGGACGATGTCTGCGAA | 21 | 35 | 34 | 27 | 8 | 16 |
| 1710 | 1562 | 6175 | 77.9 | GCAAAGCCGTCTGTCTGCAAGCAA | 21 | 36 | 19 | 19 | 21 | 21 |
| 1711 | 1563 | 6176 | 75.9 | GCAAAGCCACCTCCATCGAACCTA | 21 | 36 | 23 | 15 | 16 | 26 |
| 1712 | 1564 | 20998 | 75.3 | GCAAAGCCAGGAACCTAAAGGCAA | 21 | 36 | 25 | 23 | 6 | 21 |
| 1713 | 1565 | 30357 | 76.5 | GCAAAGCCCCTAGTGCCGAAGTCT | 21 | 36 | 26 | 33 | 16 | 19 |
| 1714 | 1566 | 6178 | 78.4 | GCAAAGCCTCCCCTGTGGTAAGCC | 21 | 36 | 28 | 14 | 18 | 36 |
| 1715 | 1567 | 6183 | 76.1 | AGTGAATCCGAAAGGAGTGCTGCG | 22 | 4 | 16 | 25 | 33 | 29 |
| 1716 | 1568 | 6187 | 81.3 | AGTGAATCACGGCAGCAGCCACGG | 22 | 4 | 35 | 31 | 36 | 35 |
| 1717 | 1569 | 6195 | 81.4 | AGTGTCTGCACGCAGCCACGGACC | 22 | 8 | 30 | 31 | 30 | 32 |
| 1718 | 1570 | 6200 | 79.4 | AGTGTCGTACGGACCTTGCGTGCG | 22 | 10 | 35 | 23 | 29 | 29 |
| 1719 | 1571 | 40320 | 77.5 | AGTGCTTGCCATAGCCAGCCCTGT | 22 | 11 | 15 | 36 | 36 | 14 |
| 1720 | 1572 | 6205 | 76.6 | AGTGCTTGGGTAGGACGTGCGATG | 22 | 11 | 18 | 34 | 33 | 27 |
| 1721 | 1573 | 15037 | 75.6 | AGTGCTTGCCTACCATAGCCCGAA | 22 | 11 | 26 | 15 | 36 | 16 |
| 1722 | 1574 | 30358 | 77 | AGTGCTTGGGACTGCGGGTAGACC | 22 | 11 | 34 | 29 | 18 | 32 |
| 1723 | 1575 | 30359 | 76.8 | AGTGCGTTTCGTAGTGGGACTGCG | 22 | 12 | 10 | 22 | 34 | 29 |
| 1724 | 1576 | 6219 | 78.4 | AGTGCGTTGTCTGATGCGTTTGCG | 22 | 12 | 19 | 27 | 12 | 29 |
| 1725 | 1577 | 6230 | 78.7 | AGTGCTCATCCCCGAAGGACGACC | 22 | 13 | 28 | 16 | 34 | 32 |
| 1726 | 1578 | 30360 | 80.4 | AGTGCTGTTCCCATCGGTGCCAGC | 22 | 14 | 28 | 24 | 33 | 31 |
| 1727 | 1579 | 6238 | 78.6 | AGTGCCATCTTGACGGCTCAACGG | 22 | 15 | 11 | 35 | 13 | 35 |
| 1728 | 1581 | 6258 | 76.1 | AGTGCGAATGCGAAAGTTGAAGCC | 22 | 16 | 29 | 6 | 1 | 36 |
| 1729 | 1582 | 40323 | 77.8 | AGTGGCTTCGTTCTTGCACGTCCC | 22 | 17 | 12 | 11 | 30 | 28 |
| 1730 | 1583 | 40324 | 78.6 | AGTGGCTTTCCCGGACCCTACACG | 22 | 17 | 28 | 34 | 26 | 30 |
| 1731 | 1584 | 6269 | 76.9 | AGTGGCTTTGCGCCTAGATGGCTT | 22 | 17 | 29 | 26 | 27 | 17 |
| 1732 | 1585 | 6270 | 77.9 | AGTGGCTTGACCCTGTACGGCAGC | 22 | 17 | 32 | 14 | 35 | 31 |
| 1733 | 1586 | 30364 | 77.9 | AGTGGCTTAGCCTCGTGACCCACG | 22 | 17 | 36 | 10 | 32 | 30 |
| 1734 | 1587 | 6273 | 76.9 | AGTGGGTACGTTACGGGTGCCCAT | 22 | 18 | 12 | 35 | 33 | 15 |

FIG. 25II

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1735 | 1588 | 6278 | 78 | AGTGGGTATGCGGCTTGACCCTCA | 22 | 18 | 29 | 17 | 32 | 13 |
| 1736 | 1589 | 6283 | 75.1 | AGTGGCAAAAAGTCTGCTGTTGCG | 22 | 21 | 6 | 8 | 14 | 29 |
| 1737 | 1590 | 6290 | 80.9 | AGTGGCAAAGTGAGCCTGCGCAGC | 22 | 21 | 22 | 36 | 29 | 31 |
| 1738 | 1591 | 40325 | 79.6 | AGTGGCAAGACCTCGTGTGCGTGC | 22 | 21 | 32 | 10 | 33 | 33 |
| 1739 | 1592 | 6300 | 78.2 | AGTGATCGCTCAACGGAGCCGGTA | 22 | 24 | 13 | 35 | 36 | 18 |
| 1740 | 1593 | 15068 | 77.4 | AGTGATCGTGCGACCTTGTCACGG | 22 | 24 | 29 | 23 | 9 | 35 |
| 1741 | 1594 | 15069 | 78.4 | AGTGATCGCAGCACCTTGCGGAGT | 22 | 24 | 31 | 23 | 29 | 20 |
| 1742 | 1595 | 40327 | 79.8 | AGTGATCGGTGCATCGGCTTGCAA | 22 | 24 | 33 | 24 | 17 | 21 |
| 1743 | 1596 | 15071 | 79.1 | AGTGATCGACGGGGTATCCCACGG | 22 | 24 | 35 | 18 | 28 | 35 |
| 1744 | 1597 | 6313 | 75.8 | AGTGCCTATCCCCTTGGCTTCGTT | 22 | 26 | 28 | 11 | 17 | 12 |
| 1745 | 1598 | 6316 | 82.2 | AGTGCCTACAGCGCAATGCGCACG | 22 | 26 | 31 | 21 | 29 | 30 |
| 1746 | 1599 | 21014 | 78.4 | AGTGCCTAGTGCGCTTACGGGCAA | 22 | 26 | 33 | 17 | 35 | 21 |
| 1747 | 1600 | 6325 | 79.9 | AGTGGATGAGCCGGACACGGCCTA | 22 | 27 | 36 | 34 | 35 | 26 |
| 1748 | 1601 | 15080 | 77.5 | AGTGTCCCTCGTAGCCAGCCAGGA | 22 | 28 | 10 | 36 | 36 | 25 |
| 1749 | 1602 | 6329 | 79.5 | AGTGTCCCCTGTTCCCGATGCAGC | 22 | 28 | 14 | 28 | 27 | 31 |
| 1750 | 1604 | 6337 | 76.4 | AGTGTCCCGTGCATACCGAAATCG | 22 | 28 | 33 | 5 | 16 | 24 |
| 1751 | 1605 | 6341 | 80.2 | AGTGTGCGAATCTGCGCAGCAGGA | 22 | 29 | 4 | 29 | 31 | 25 |
| 1752 | 1606 | 6343 | 79.4 | AGTGTGCGCTTGGTCTGACCACGG | 22 | 29 | 11 | 19 | 32 | 35 |
| 1753 | 1607 | 6347 | 77.9 | AGTGTGCGCGAACTGTGATGCCAT | 22 | 29 | 16 | 14 | 27 | 15 |
| 1754 | 1608 | 30366 | 75.3 | AGTGTGCGCCTAGAGTAGCCGCTT | 22 | 29 | 26 | 20 | 36 | 17 |
| 1755 | 1609 | 15086 | 78.6 | AGTGTGCGTGCGTACACACGCCAT | 22 | 29 | 29 | 7 | 30 | 15 |
| 1756 | 1610 | 40331 | 75.8 | AGTGCACGCGTTAAAGAGCCACCT | 22 | 30 | 12 | 6 | 36 | 23 |
| 1757 | 1611 | 15088 | 78.3 | AGTGCACGCGAATACACAGCACGG | 22 | 30 | 16 | 7 | 31 | 35 |
| 1758 | 1612 | 40332 | 79.5 | AGTGCACGTGCGCGTTTACAAGCC | 22 | 30 | 29 | 12 | 7 | 36 |
| 1759 | 1613 | 30369 | 76.5 | AGTGCACGGACCTTAGAGCCCCAT | 22 | 30 | 32 | 3 | 36 | 15 |
| 1760 | 1614 | 15093 | 75.6 | AGTGCAGCGCTTCCTAAAAGGTGC | 22 | 31 | 17 | 26 | 6 | 33 |
| 1761 | 1615 | 6392 | 76.6 | AGTGGACCGCAACCTAGTGCATCG | 22 | 32 | 21 | 26 | 33 | 24 |
| 1762 | 1616 | 40333 | 78.7 | AGTGGACCGGACTCTGTCCCGACC | 22 | 32 | 34 | 8 | 28 | 32 |
| 1763 | 1617 | 21032 | 75.8 | AGTGGTGCAATCCTCAGTGCTCCC | 22 | 33 | 4 | 13 | 33 | 28 |
| 1764 | 1618 | 30374 | 77.7 | AGTGGTGCCCATCGAAGCTTGGAC | 22 | 33 | 15 | 16 | 17 | 34 |
| 1765 | 1619 | 15105 | 75 | AGTGGTGCGTCTATACTGCGCAGC | 22 | 33 | 19 | 5 | 29 | 31 |
| 1766 | 1620 | 40334 | 77.7 | AGTGGTGCGAGTCCTATGCGGACC | 22 | 33 | 20 | 26 | 29 | 32 |
| 1767 | 1621 | 6416 | 76.7 | AGTGGGACTCGTCTTGATCGTGCG | 22 | 34 | 10 | 11 | 24 | 29 |
| 1768 | 1622 | 40335 | 75.5 | AGTGGGACCCATAATCCTTGTGCG | 22 | 34 | 15 | 4 | 11 | 29 |
| 1769 | 1623 | 30377 | 81.1 | AGTGACGGCTCAGTGCTGCGCCAT | 22 | 35 | 13 | 33 | 29 | 15 |
| 1770 | 1624 | 30378 | 77.5 | AGTGACGGGGTACTTGGGACGTGC | 22 | 35 | 18 | 11 | 34 | 33 |
| 1771 | 1625 | 30379 | 76.9 | AGTGACGGGATGTGATTCCCCGTT | 22 | 35 | 27 | 2 | 28 | 12 |
| 1772 | 1626 | 6444 | 79.1 | AGTGACGGGACGTCTTCCCAGGA | 22 | 35 | 34 | 19 | 28 | 25 |
| 1773 | 1627 | 15116 | 76.4 | AGTGAGCCCTTGATACCAGCGCAA | 22 | 36 | 11 | 5 | 31 | 21 |
| 1774 | 1628 | 15118 | 76.5 | AGTGAGCCATCGAAAGCGTTCGAA | 22 | 36 | 24 | 6 | 12 | 16 |
| 1775 | 1629 | 15120 | 79.8 | AGTGAGCCGGACGTCTAGCCACGG | 22 | 36 | 34 | 19 | 36 | 35 |
| 1776 | 1630 | 6461 | 78.1 | ACCTTTGACGAATGCGACGGTCGT | 23 | 1 | 16 | 29 | 35 | 10 |
| 1777 | 1631 | 30380 | 76.3 | ACCTTGATTGCGTGCGGTCTCCTA | 23 | 2 | 29 | 29 | 19 | 26 |
| 1778 | 1633 | 6493 | 76.2 | ACCTTCTGCTTGTGCGGCTTATCG | 23 | 8 | 11 | 29 | 17 | 24 |
| 1779 | 1634 | 40339 | 79.9 | ACCTTCTGTGCGCAGCGTCTTCCC | 23 | 8 | 29 | 31 | 19 | 28 |
| 1780 | 1635 | 6505 | 78.9 | ACCTTGTCCCATGTGCCCATCACG | 23 | 9 | 15 | 33 | 15 | 30 |
| 1781 | 1636 | 30382 | 77.8 | ACCTTCGTTCGTATCGTGCGAGCC | 23 | 10 | 10 | 24 | 29 | 36 |
| 1782 | 1637 | 40340 | 77.5 | ACCTTCGTCGTTACGGCCATACGG | 23 | 10 | 12 | 35 | 15 | 35 |
| 1783 | 1638 | 6521 | 75 | ACCTTCGTTCCCTTAGGATGTGCG | 23 | 10 | 28 | 3 | 27 | 29 |
| 1784 | 1639 | 40341 | 81.9 | ACCTTCGTCAGCACGGTGCGCTCA | 23 | 10 | 31 | 35 | 29 | 13 |
| 1785 | 1640 | 30383 | 77.9 | ACCTCTTGGCTTCCTATGCGTGCG | 23 | 11 | 17 | 26 | 29 | 29 |

FIG. 25JJ

| SEQ ID NO: | 4,633 ID# | H3X ID# | Tm | ZIPCODE (5'-3') | T3TRAMER NUMBERS | | | | |
|---|---|---|---|---|---|---|---|---|---|
| 1786 | 1642 | 6539 | 78.1 | ACCTCGTTCTTGCCATACGGCGAA | 23 12 | 11 | 15 | 35 | 16 |
| 1787 | 1643 | 6540 | 75.7 | ACCTCGTTCCATAGCCCTGTGTGC | 23 12 | 15 | 36 | 14 | 33 |
| 1788 | 1644 | 6549 | 78.6 | ACCTCCATCACGGCTTGAGTTGCG | 23 15 | 30 | 17 | 20 | 29 |
| 1789 | 1645 | 6551 | 77.9 | ACCTCCATACGGGATGCACGCCTA | 23 15 | 35 | 27 | 30 | 26 |
| 1790 | 1646 | 30384 | 76.8 | ACCTCGAACGTTAGCCCAGCGAGT | 23 16 | 12 | 36 | 31 | 20 |
| 1791 | 1648 | 6558 | 78.7 | ACCTCGAAGGTATGCGCTCATGCG | 23 16 | 18 | 29 | 13 | 29 |
| 1792 | 1649 | 6569 | 77.4 | ACCTGCTTCTTGTCCCCACGAGGA | 23 17 | 11 | 28 | 30 | 25 |
| 1793 | 1651 | 6575 | 77.5 | ACCTGCTTTGCGGAGTCGAACGTT | 23 17 | 29 | 20 | 16 | 12 |
| 1794 | 1652 | 40344 | 81.5 | ACCTGCTTCAGCCTTGCACGTGCG | 23 17 | 31 | 11 | 30 | 29 |
| 1795 | 1653 | 6589 | 80.9 | ACCTGCAATGATGCAATGCGTGCG | 23 21 | 2 | 21 | 29 | 29 |
| 1796 | 1654 | 21067 | 76.1 | ACCTGCAAGAGTCTTGGTGCAGCC | 23 21 | 20 | 11 | 33 | 36 |
| 1797 | 1656 | 6602 | 75.8 | ACCTAGTGCCATTCTGCAGCGCTT | 23 22 | 15 | 8 | 31 | 17 |
| 1798 | 1657 | 6638 | 78.2 | ACCTTCCCAATCGATGGTGCATCG | 23 28 | 4 | 27 | 33 | 24 |
| 1799 | 1658 | 40349 | 77.6 | ACCTTCCCAAAGTGATTGCGGTGC | 23 28 | 6 | 2 | 29 | 33 |
| 1800 | 1659 | 30387 | 76.6 | ACCTTCCCCTGTCAGCGAGTTCGT | 23 28 | 14 | 31 | 20 | 10 |
| 1801 | 1660 | 30388 | 77.3 | ACCTTCCCACCTCGAACACGCCTA | 23 28 | 23 | 16 | 30 | 26 |
| 1802 | 1661 | 15180 | 77.9 | ACCTTCCCATCGTCGTCACGTCGT | 23 28 | 24 | 10 | 30 | 10 |
| 1803 | 1662 | 21077 | 76.5 | ACCTTCCCCCTAAGCCTCCCTCTG | 23 28 | 26 | 36 | 28 | 8 |
| 1804 | 1663 | 6652 | 79.5 | ACCTTCCCACGGCTCAGATGACGG | 23 28 | 35 | 13 | 27 | 35 |
| 1805 | 1664 | 30389 | 77 | ACCTTGCGTTGATGATTGCGTCGT | 23 29 | 1 | 2 | 29 | 10 |
| 1806 | 1665 | 6665 | 77.5 | ACCTTGCGCGAAAAGTCGTCGTT | 23 29 | 16 | 6 | 10 | 12 |
| 1807 | 1666 | 6666 | 78.5 | ACCTTGCGGCTTGCTTTCGTCTCA | 23 29 | 17 | 17 | 10 | 13 |
| 1808 | 1667 | 6671 | 81.1 | ACCTTGCGACGGCAGCACCTCTCA | 23 29 | 35 | 31 | 23 | 13 |
| 1809 | 1668 | 6672 | 79.5 | ACCTCACGAAAGTCCCAGCCACGG | 23 30 | 6 | 28 | 36 | 35 |
| 1810 | 1669 | 15189 | 77.9 | ACCTCACGGTCTTCCCCGAAGACC | 23 30 | 19 | 28 | 16 | 32 |
| 1811 | 1670 | 6678 | 76.6 | ACCTCACGGAGTCTGTACGGTGCG | 23 30 | 20 | 14 | 35 | 29 |
| 1812 | 1671 | 15190 | 79.7 | ACCTCACGTCCCCATACGGCTCA | 23 30 | 28 | 15 | 35 | 13 |
| 1813 | 1672 | 40354 | 77.6 | ACCTGACCCGAACTGTGGACCAGC | 23 32 | 16 | 14 | 34 | 31 |
| 1814 | 1673 | 30390 | 77.2 | ACCTGACCCACGAAAGGCAACGTT | 23 32 | 30 | 6 | 21 | 12 |
| 1815 | 1674 | 21097 | 77.2 | ACCTGACCACGGTTGATGCGTGTC | 23 32 | 35 | 1 | 29 | 9 |
| 1816 | 1676 | 6711 | 76.7 | ACCTGTGCCTCAGCAAGATGACGG | 23 33 | 13 | 21 | 27 | 35 |
| 1817 | 1677 | 30391 | 80.4 | ACCTGTGCGAGTCGAAACGGGTGC | 23 33 | 20 | 16 | 35 | 33 |
| 1818 | 1678 | 15203 | 79.7 | ACCTGTGCACCTCAGCGATGCAGC | 23 33 | 23 | 31 | 27 | 31 |
| 1819 | 1679 | 15205 | 78.3 | ACCTGTGCAGGATCCCACGGTGTC | 23 33 | 25 | 28 | 35 | 9 |
| 1820 | 1680 | 30392 | 78.3 | ACCTGTGCCCTACACGGGACATCG | 23 33 | 26 | 30 | 34 | 24 |
| 1821 | 1681 | 15207 | 77.4 | ACCTGGACCTTGTGCGAATCGCTT | 23 34 | 11 | 29 | 4 | 17 |
| 1822 | 1682 | 15212 | 77.1 | ACCTGGACGATGTGCGCTGTAGGA | 23 34 | 27 | 29 | 14 | 25 |
| 1823 | 1683 | 15213 | 77.8 | ACCTGGACTCCCTCGTCAGCGATG | 23 34 | 28 | 10 | 31 | 27 |
| 1824 | 1684 | 30393 | 79.5 | ACCTGGACAGCCAATCCACGAGCC | 23 34 | 36 | 4 | 30 | 36 |
| 1825 | 1685 | 6736 | 76.7 | ACCTACGGTTGACGAAGCAATGCG | 23 35 | 1 | 16 | 21 | 29 |
| 1826 | 1686 | 30394 | 75.7 | ACCTACGGCGTTCGAAGCTTGGTA | 23 35 | 12 | 16 | 17 | 18 |
| 1827 | 1687 | 6766 | 80.8 | ATCGTTGACGAAAGCCAGCCGCAA | 24 1 | 16 | 36 | 36 | 21 |
| 1828 | 1688 | 6770 | 78.3 | ATCGTTGAAGGATGCGGACCATCG | 24 1 | 25 | 29 | 32 | 24 |
| 1829 | 1689 | 30398 | 77.3 | ATCGTTGAACGGTGCGTCTGGATG | 24 1 | 35 | 29 | 8 | 27 |
| 1830 | 1690 | 6773 | 82.3 | ATCGTGATCACGGTGCACGGCGAA | 24 2 | 30 | 33 | 35 | 16 |
| 1831 | 1691 | 6779 | 76.4 | ATCGTAGGTGCACCTTGCGCCTA | 24 3 | 33 | 23 | 29 | 26 |
| 1832 | 1692 | 30399 | 76.4 | ATCGAATCCGTTACGGTGCGTGTC | 24 4 | 12 | 35 | 29 | 9 |
| 1833 | 1693 | 6781 | 76.5 | ATCGAATCCTCAATCGGCAACACG | 24 4 | 13 | 24 | 21 | 30 |
| 1834 | 1694 | 6783 | 80.1 | ATCGAATCATCGGGACAGCCACGG | 24 4 | 24 | 34 | 36 | 35 |
| 1835 | 1695 | 40358 | 80.2 | ATCGAATCGACCTGCGTCCCATCG | 24 4 | 32 | 29 | 28 | 24 |
| 1836 | 1696 | 6789 | 77.5 | ATCGAATCGGACCTTGATCGGTGC | 24 4 | 34 | 11 | 24 | 33 |

FIG. 25KK

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1837 | 1697 | 6793 | 75 | ATCGATACGCTTTGCGCTGTATCG | 24 | 5 | 17 | 29 | 14 | 24 |
| 1838 | 1698 | 6796 | 80.4 | ATCGATACCAGCCCATTGCGGCAA | 24 | 5 | 31 | 15 | 29 | 21 |
| 1839 | 1699 | 6797 | 76.8 | ATCGATACACGGTTGAACGGCGAA | 24 | 5 | 35 | 1 | 35 | 16 |
| 1840 | 1701 | 40360 | 79.4 | ATCGTCTGCCATGCTTCACGACGG | 24 | 8 | 15 | 17 | 30 | 35 |
| 1841 | 1702 | 6814 | 77.8 | ATCGTCTGCCTAAGCCGATGACGG | 24 | 8 | 26 | 36 | 27 | 35 |
| 1842 | 1703 | 6815 | 80 | ATCGTCTGCAGCGGACAGTGGCAA | 24 | 8 | 31 | 34 | 22 | 21 |
| 1843 | 1704 | 6820 | 77.9 | ATCGTGTCCCATTCGTGCAACACG | 24 | 9 | 15 | 10 | 21 | 30 |
| 1844 | 1705 | 21109 | 82.8 | ATCGTGTCGTGCGATGACGGTGCG | 24 | 9 | 33 | 27 | 35 | 29 |
| 1845 | 1706 | 6828 | 79.6 | ATCGTCGTTTGACACGGGACGCAA | 24 | 10 | 1 | 30 | 34 | 21 |
| 1846 | 1707 | 6837 | 79.4 | ATCGTCGTGATGGGACGCTTTCCC | 24 | 10 | 27 | 34 | 17 | 28 |
| 1847 | 1708 | 21110 | 76.4 | ATCGTCGTGTGCTTGACTGTTGCG | 24 | 10 | 33 | 1 | 14 | 29 |
| 1848 | 1709 | 6841 | 78.5 | ATCGTCGTAGCCCAGCTCTGCGAA | 24 | 10 | 36 | 31 | 8 | 16 |
| 1849 | 1711 | 15250 | 78 | ATCGCTTGCTTGCGAAGCAAGCTT | 24 | 11 | 11 | 16 | 21 | 17 |
| 1850 | 1713 | 30401 | 76.9 | ATCGCTTGGGTATCGTTGCGTTGA | 24 | 11 | 18 | 10 | 29 | 1 |
| 1851 | 1714 | 30402 | 77.1 | ATCGCTTGACCTTGTCGCTTTCCC | 24 | 11 | 23 | 9 | 17 | 28 |
| 1852 | 1715 | 40364 | 76.1 | ATCGCTTGCCTATGATCAGCAGCC | 24 | 11 | 26 | 2 | 31 | 36 |
| 1853 | 1716 | 15254 | 79.2 | ATCGCTTGCACGGAGTTCCCACCT | 24 | 11 | 30 | 20 | 28 | 23 |
| 1854 | 1717 | 30403 | 76.5 | ATCGCGTTTGATACGGTCTGGTGC | 24 | 12 | 2 | 35 | 8 | 33 |
| 1855 | 1718 | 30404 | 76.3 | ATCGCGTTTTAGGCTTAGCCGCTT | 24 | 12 | 3 | 17 | 36 | 17 |
| 1856 | 1719 | 6860 | 76.8 | ATCGCGTTAAAGCACGGTCTGTGC | 24 | 12 | 6 | 30 | 19 | 33 |
| 1857 | 1720 | 6865 | 76.6 | ATCGCGTTCTTGGGTAAGCCACCT | 24 | 12 | 11 | 18 | 36 | 23 |
| 1858 | 1721 | 30405 | 78.2 | ATCGCGTTCGTTCAGCATCGGAGT | 24 | 12 | 12 | 31 | 24 | 20 |
| 1859 | 1722 | 30406 | 77.3 | ATCGCGTTCTGTTCCCGAACCTA | 24 | 12 | 14 | 28 | 16 | 26 |
| 1860 | 1723 | 40366 | 76.2 | ATCGCGTTGGTATGTCCAGCGAGT | 24 | 12 | 18 | 9 | 31 | 20 |
| 1861 | 1725 | 6871 | 77.5 | ATCGCGTTAGTGTCTGACGGCACG | 24 | 12 | 22 | 8 | 35 | 30 |
| 1862 | 1726 | 6873 | 76.8 | ATCGCGTTATCGGCTTAGTGCACG | 24 | 12 | 24 | 17 | 22 | 30 |
| 1863 | 1727 | 6874 | 76.1 | ATCGCGTTGATGTACACCATTGCG | 24 | 12 | 27 | 7 | 15 | 29 |
| 1864 | 1728 | 6877 | 75.9 | ATCGCGTTGGACTACAAGCCCTTG | 24 | 12 | 34 | 7 | 36 | 11 |
| 1865 | 1729 | 6880 | 78.2 | ATCGCTCATGATACGGTCCCCACG | 24 | 13 | 2 | 35 | 28 | 30 |
| 1866 | 1731 | 30407 | 79.5 | ATCGCTCACGTTTGCGACCTGTGC | 24 | 13 | 12 | 29 | 23 | 33 |
| 1867 | 1732 | 6886 | 78.8 | ATCGCTCAGATGGCAAGACCTGCG | 24 | 13 | 27 | 21 | 32 | 29 |
| 1868 | 1733 | 6894 | 80.4 | ATCGCTGTTGATTCCCAGCCTGCG | 24 | 14 | 2 | 28 | 36 | 29 |
| 1869 | 1734 | 6895 | 81.1 | ATCGCTGTTGTCCACGCACGGGAC | 24 | 14 | 9 | 30 | 30 | 34 |
| 1870 | 1735 | 6896 | 81.4 | ATCGCTGTCTTGCCATTGCGCAGC | 24 | 14 | 11 | 15 | 29 | 31 |
| 1871 | 1736 | 15268 | 77.9 | ATCGCTGTGCAATGCGTGTCCTGT | 24 | 14 | 21 | 29 | 9 | 14 |
| 1872 | 1738 | 15270 | 79.5 | ATCGCTGTTGCGCGTTTGATCAGC | 24 | 14 | 29 | 12 | 2 | 31 |
| 1873 | 1739 | 30408 | 77.3 | ATCGCTGTCACGAATCTGCGCTGT | 24 | 14 | 30 | 4 | 29 | 14 |
| 1874 | 1740 | 30409 | 81.2 | ATCGCTGTGACCGACCCTCATGCG | 24 | 14 | 32 | 32 | 13 | 29 |
| 1875 | 1741 | 30410 | 77.6 | ATCGCCATTTGATGCGTGATCGAA | 24 | 15 | 1 | 29 | 2 | 16 |
| 1876 | 1742 | 15272 | 77 | ATCGCCATTGATCGAACTTGCGAA | 24 | 15 | 2 | 16 | 11 | 16 |
| 1877 | 1744 | 30411 | 75.3 | ATCGCCATTCGTAATCCGTTCGTT | 24 | 15 | 10 | 4 | 12 | 12 |
| 1878 | 1745 | 30412 | 75 | ATCGCCATCTTGAAAGCTTGGCTT | 24 | 15 | 11 | 6 | 11 | 17 |
| 1879 | 1746 | 30413 | 78.5 | ATCGCCATCTCACTTGCGAAACGG | 24 | 15 | 13 | 11 | 16 | 35 |
| 1880 | 1747 | 6918 | 77.2 | ATCGCCATGCTTCTGTGTGCTCGT | 24 | 15 | 17 | 14 | 33 | 10 |
| 1881 | 1748 | 30414 | 77.3 | ATCGCCATAGGAAGCCCGTTCTCA | 24 | 15 | 25 | 36 | 12 | 13 |
| 1882 | 1749 | 40369 | 76.4 | ATCGCCATCCTAAGGAACGGTCGT | 24 | 15 | 26 | 25 | 35 | 10 |
| 1883 | 1750 | 30415 | 76.6 | ATCGCCATGTGCTTAGGCAAATCG | 24 | 15 | 33 | 3 | 21 | 24 |
| 1884 | 1751 | 6929 | 77.4 | ATCGCGAAATACCTCATCCCACGG | 24 | 16 | 5 | 13 | 28 | 35 |
| 1885 | 1752 | 6932 | 76.9 | ATCGCGAATCTGCTCATGCGAAAG | 24 | 16 | 8 | 13 | 29 | 6 |
| 1886 | 1753 | 21122 | 76.5 | ATCGCGAATCGTGGTAAATCGTGC | 24 | 16 | 10 | 18 | 4 | 33 |
| 1887 | 1754 | 40370 | 78.8 | ATCGCGAACTGTCTTGCACGAGCC | 24 | 16 | 14 | 11 | 30 | 36 |

FIG. 25LL

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1888 | 1755 | 6936 | 75.1 | ATCGCGAAGGTATTGAGACCAGCC | 24 | 16 | 18 | 1 | 32 | 36 |
| 1889 | 1756 | 6937 | 75.9 | ATCGCGAAGTCTCGAAGCAAAGGA | 24 | 16 | 19 | 16 | 21 | 25 |
| 1890 | 1757 | 30416 | 76.6 | ATCGCGAAACCTCCATGGTATCCC | 24 | 16 | 23 | 15 | 18 | 28 |
| 1891 | 1758 | 15285 | 75.4 | ATCGCGAACCTACAGCTCGTAGCC | 24 | 16 | 26 | 31 | 10 | 36 |
| 1892 | 1759 | 6943 | 79.8 | ATCGCGAATGCGTGTCGCAACTGT | 24 | 16 | 29 | 9 | 21 | 14 |
| 1893 | 1760 | 30417 | 78.3 | ATCGCGAAGACCATACCACGACGG | 24 | 16 | 32 | 5 | 30 | 35 |
| 1894 | 1761 | 21125 | 78 | ATCGGCTTTTAGCCATCAGCTGCG | 24 | 17 | 3 | 15 | 31 | 29 |
| 1895 | 1762 | 6947 | 76.4 | ATCGGCTTTACACCATGTGCGGAC | 24 | 17 | 7 | 15 | 33 | 34 |
| 1896 | 1763 | 40373 | 76 | ATCGGCTTTCTGTTGACAGCGACC | 24 | 17 | 8 | 1 | 31 | 32 |
| 1897 | 1764 | 6950 | 77.6 | ATCGGCTTCGTTGACCACCTGGAC | 24 | 17 | 12 | 32 | 23 | 34 |
| 1898 | 1765 | 30418 | 76.9 | ATCGGCTTCTGTATCGGACCCAGC | 24 | 17 | 14 | 24 | 32 | 31 |
| 1899 | 1767 | 6958 | 76.7 | ATCGGCTTGTGCTTAGCAGCCTCA | 24 | 17 | 33 | 3 | 31 | 13 |
| 1900 | 1768 | 40375 | 75.3 | ATCGGGTACGTTAGGACACGCGTT | 24 | 18 | 12 | 25 | 30 | 12 |
| 1901 | 1769 | 15292 | 76.1 | ATCGGGTAGCAAGTCTCAGCGTGC | 24 | 18 | 21 | 19 | 31 | 33 |
| 1902 | 1770 | 6968 | 75.5 | ATCGGGTAAGGAACCTGCAAGCAA | 24 | 18 | 25 | 23 | 21 | 21 |
| 1903 | 1771 | 15294 | 76.8 | ATCGGGTATCCCAGGACCATCGAA | 24 | 18 | 28 | 25 | 15 | 16 |
| 1904 | 1772 | 6974 | 75 | ATCGGGTAACGGTACAGCAAAGCC | 24 | 18 | 35 | 7 | 21 | 36 |
| 1905 | 1773 | 30421 | 76.1 | ATCGGGTAAGCCTGATACGGAGCC | 24 | 18 | 36 | 2 | 35 | 36 |
| 1906 | 1774 | 15298 | 76.3 | ATCGGTCTCGAAAATCGCAACGAA | 24 | 19 | 16 | 4 | 21 | 16 |
| 1907 | 1775 | 40376 | 76.4 | ATCGGTCTGCTTAGCCGGTAAGCC | 24 | 19 | 17 | 36 | 18 | 36 |
| 1908 | 1776 | 6981 | 79.5 | ATCGGTCTATCGCACGGGACCAGC | 24 | 19 | 24 | 30 | 34 | 31 |
| 1909 | 1777 | 6986 | 77.5 | ATCGGTCTACGGCCATGGACCTTG | 24 | 19 | 35 | 15 | 34 | 11 |
| 1910 | 1778 | 40377 | 77.8 | ATCGGAGTGCAAGCTTGACCGGAC | 24 | 20 | 21 | 17 | 32 | 34 |
| 1911 | 1779 | 6990 | 79.2 | ATCGGAGTATCGCTTGCAGCGCAA | 24 | 20 | 24 | 11 | 31 | 21 |
| 1912 | 1780 | 6992 | 76.1 | ATCGGAGTCAGCTTAGACGGCACG | 24 | 20 | 31 | 3 | 35 | 30 |
| 1913 | 1782 | 40378 | 78.3 | ATCGGCAATGATTGCGACCTGACC | 24 | 21 | 2 | 29 | 23 | 32 |
| 1914 | 1783 | 15303 | 75.8 | ATCGGCAATACAAATCGCAAAGCC | 24 | 21 | 7 | 4 | 21 | 36 |
| 1915 | 1784 | 30422 | 78.6 | ATCGGCAATGTCTCCCTCTGCACG | 24 | 21 | 9 | 28 | 8 | 30 |
| 1916 | 1785 | 40379 | 77.6 | ATCGGCAACTCAAAAGGGACCACG | 24 | 21 | 13 | 6 | 34 | 30 |
| 1917 | 1786 | 40380 | 76.1 | ATCGGCAACCATACCTTCTGGCAA | 24 | 21 | 15 | 23 | 8 | 21 |
| 1918 | 1787 | 40381 | 75.8 | ATCGGCAAGCTTTTAGATCGCGAA | 24 | 21 | 17 | 3 | 24 | 16 |
| 1919 | 1788 | 40382 | 76.1 | ATCGGCAAGAGTAGCCGTCTGTGC | 24 | 21 | 20 | 36 | 19 | 33 |
| 1920 | 1789 | 15309 | 77.1 | ATCGGCAAGCAATCGTAGTGGCAA | 24 | 21 | 21 | 10 | 22 | 21 |
| 1921 | 1790 | 7008 | 77.7 | ATCGGCAAAGTGCTTGATCGTCCC | 24 | 21 | 22 | 11 | 24 | 28 |
| 1922 | 1791 | 30423 | 77.4 | ATCGGCAAAGGAAGTGGTGCTCGT | 24 | 21 | 25 | 22 | 33 | 10 |
| 1923 | 1792 | 7013 | 78.5 | ATCGGCAACAGCAGTGCTGTGTGC | 24 | 21 | 31 | 22 | 14 | 33 |
| 1924 | 1793 | 7015 | 75.8 | ATCGGCAAGGACTGTCGGTAATCG | 24 | 21 | 34 | 9 | 18 | 24 |
| 1925 | 1795 | 7019 | 77.2 | ATCGAGTGCGAATGATGGACCACG | 24 | 22 | 16 | 2 | 34 | 30 |
| 1926 | 1796 | 7022 | 77 | ATCGAGTGCCTATGCGCTCACAGC | 24 | 22 | 26 | 29 | 13 | 31 |
| 1927 | 1797 | 30424 | 77.8 | ATCGAGTGGTGCTTGAACGGAGCC | 24 | 22 | 33 | 1 | 35 | 36 |
| 1928 | 1798 | 7026 | 79.3 | ATCGACCTGGTAACGGCACGGACC | 24 | 23 | 18 | 35 | 30 | 32 |
| 1929 | 1799 | 7027 | 75.8 | ATCGACCTGCAATCTGAGGAACGG | 24 | 23 | 21 | 8 | 25 | 35 |
| 1930 | 1800 | 7032 | 80.7 | ATCGACCTGGACCACGTGCGTCGT | 24 | 23 | 34 | 30 | 29 | 10 |
| 1931 | 1801 | 30425 | 79.1 | ATCGATCGCTGTATCGCAGCCGAA | 24 | 24 | 14 | 24 | 31 | 16 |
| 1932 | 1802 | 30426 | 75.8 | ATCGATCGGCTTAGGAGACCCGTT | 24 | 24 | 17 | 25 | 32 | 12 |
| 1933 | 1803 | 15317 | 76.9 | ATCGATCGAGGAAGCCGGACAATC | 24 | 24 | 25 | 36 | 34 | 4 |
| 1934 | 1804 | 30427 | 80.2 | ATCGATCGGTGCCGTTTGTCAGCC | 24 | 24 | 33 | 12 | 9 | 36 |
| 1935 | 1805 | 21139 | 77.1 | ATCGAGGAACCTGCTTAGCCCACG | 24 | 25 | 23 | 17 | 36 | 30 |
| 1936 | 1806 | 7049 | 78.9 | ATCGAGGAATCGGTGCCTGTGCAA | 24 | 25 | 24 | 33 | 14 | 21 |
| 1937 | 1807 | 7056 | 76.3 | ATCGCCTATGATACGGCAGCCTCA | 24 | 26 | 2 | 35 | 31 | 13 |
| 1938 | 1808 | 15323 | 77.2 | ATCGCCTAAAAGCTCAAGCCACGG | 24 | 26 | 6 | 13 | 36 | 35 |

FIG. 25MM

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1939 | 1809 | 7059 | 79.4 | ATCGCCTATGTCCCATTGCGAGCC | 24 | 26 | 9 | 15 | 29 | 36 |
| 1940 | 1810 | 30428 | 76.7 | ATCGCCTACGTTTCGTCCATTCCC | 24 | 26 | 12 | 10 | 15 | 28 |
| 1941 | 1811 | 30429 | 75.9 | ATCGCCTAGCTTTCCCCTCATCGT | 24 | 26 | 17 | 28 | 13 | 10 |
| 1942 | 1812 | 30430 | 75.8 | ATCGCCTAAGGAATACACGGCACG | 24 | 26 | 25 | 5 | 35 | 30 |
| 1943 | 1814 | 21141 | 77.2 | ATCGCCTATGCGGGTATCGTTCGT | 24 | 26 | 29 | 18 | 10 | 10 |
| 1944 | 1815 | 15327 | 77.4 | ATCGCCTACACGGCTTCGTTTCGT | 24 | 26 | 30 | 17 | 12 | 10 |
| 1945 | 1816 | 7073 | 78.7 | ATCGGATGTTGAGCAAAGCCTGCG | 24 | 27 | 1 | 21 | 36 | 29 |
| 1946 | 1817 | 40389 | 80.2 | ATCGGATGTCGTGGACGACCAGCC | 24 | 27 | 10 | 34 | 32 | 36 |
| 1947 | 1818 | 30432 | 77.1 | ATCGGATGCTCAACGGAATCCGTT | 24 | 27 | 13 | 35 | 4 | 12 |
| 1948 | 1819 | 15330 | 76.5 | ATCGGATGCTGTCGTTACGGATCG | 24 | 27 | 14 | 12 | 35 | 24 |
| 1949 | 1820 | 15331 | 80.3 | ATCGGATGGTCTGTGCCAGCGGAC | 24 | 27 | 19 | 33 | 31 | 34 |
| 1950 | 1821 | 40390 | 78.5 | ATCGGATGATCGAGGAACGGGGAC | 24 | 27 | 24 | 25 | 35 | 34 |
| 1951 | 1822 | 30433 | 76.8 | ATCGGATGCCTAGTCTTCCCCACG | 24 | 27 | 26 | 19 | 28 | 30 |
| 1952 | 1823 | 7082 | 80.1 | ATCGGATGTGCGCTTGTGATTGCG | 24 | 27 | 29 | 11 | 2 | 29 |
| 1953 | 1824 | 30434 | 80.3 | ATCGGATGCACGCTTGGCTTGGAC | 24 | 27 | 30 | 11 | 17 | 34 |
| 1954 | 1825 | 7083 | 76.7 | ATCGGATGCAGCTTAGTGCGGATG | 24 | 27 | 31 | 3 | 29 | 27 |
| 1955 | 1826 | 30435 | 78.7 | ATCGGATGGGACAGCCTGATGCAA | 24 | 27 | 34 | 36 | 2 | 21 |
| 1956 | 1827 | 40391 | 80.1 | ATCGGATGACGGCTTGTCCCGATG | 24 | 27 | 35 | 11 | 28 | 27 |
| 1957 | 1828 | 15335 | 82.9 | ATCGTCCCTGTCCGAATGCGCACG | 24 | 28 | 9 | 16 | 29 | 30 |
| 1958 | 1829 | 30437 | 76.9 | ATCGTCCCAGGATCGTGCTTAGCC | 24 | 28 | 25 | 10 | 17 | 36 |
| 1959 | 1830 | 30438 | 78.5 | ATCGTCCCGATGCCTACGTTTCCC | 24 | 28 | 27 | 26 | 12 | 28 |
| 1960 | 1832 | 40393 | 76.5 | ATCGTGCGTTGATGTCCGTTAGCC | 24 | 29 | 1 | 9 | 12 | 36 |
| 1961 | 1833 | 15343 | 78.2 | ATCGTGCGTTAGTCCCTCCCCGTT | 24 | 29 | 3 | 28 | 28 | 12 |
| 1962 | 1834 | 7108 | 79.9 | ATCGTGCGCTTGCTTGCACGTGAT | 24 | 29 | 11 | 11 | 30 | 2 |
| 1963 | 1835 | 7109 | 76.7 | ATCGTGCGCTCATGTCTCCCAAAG | 24 | 29 | 13 | 9 | 28 | 6 |
| 1964 | 1836 | 30439 | 78.5 | ATCGTGCGCCATCCTAGCAAATCG | 24 | 29 | 15 | 26 | 21 | 24 |
| 1965 | 1837 | 7110 | 77.5 | ATCGTGCGGCTTCCATAATCGACC | 24 | 29 | 17 | 15 | 4 | 32 |
| 1966 | 1838 | 15345 | 78.6 | ATCGTGCGGAGTGCTTTCGTGACC | 24 | 29 | 20 | 17 | 10 | 32 |
| 1967 | 1839 | 7116 | 80 | ATCGTGCGTCCCCAGCAAAGAGGA | 24 | 29 | 28 | 31 | 6 | 25 |
| 1968 | 1840 | 7117 | 79 | ATCGTGCGCACGTACAAGCCACCT | 24 | 29 | 30 | 7 | 36 | 23 |
| 1969 | 1841 | 7119 | 80.5 | ATCGTGCGGTGCGGTACCATTCGT | 24 | 29 | 33 | 18 | 15 | 10 |
| 1970 | 1842 | 30440 | 78.5 | ATCGCACGAAAGGACCGCTTGATG | 24 | 30 | 6 | 32 | 17 | 27 |
| 1971 | 1843 | 30441 | 80.4 | ATCGCACGCTTGGTCTACGGACGG | 24 | 30 | 11 | 19 | 35 | 35 |
| 1972 | 1844 | 7127 | 79.2 | ATCGCACGCGAAGAGTCGTTCGAA | 24 | 30 | 16 | 20 | 12 | 16 |
| 1973 | 1845 | 40394 | 78 | ATCGCACGGCTTACCTCACGGGTA | 24 | 30 | 17 | 23 | 30 | 18 |
| 1974 | 1846 | 21150 | 77.3 | ATCGCACGAGTGTTAGTGCGCGTT | 24 | 30 | 22 | 3 | 29 | 12 |
| 1975 | 1847 | 40395 | 78.7 | ATCGCACGACCTGCAAAGGAGTGC | 24 | 30 | 23 | 21 | 25 | 33 |
| 1976 | 1848 | 7133 | 79.3 | ATCGCACGTCCCCTCACGAAGCTT | 24 | 30 | 28 | 13 | 16 | 17 |
| 1977 | 1849 | 7134 | 83.1 | ATCGCACGTGCGCTCAGTGCATCG | 24 | 30 | 29 | 13 | 33 | 24 |
| 1978 | 1850 | 7137 | 80.8 | ATCGCACGACGGCTGTGCAAACCT | 24 | 30 | 35 | 14 | 21 | 23 |
| 1979 | 1851 | 7138 | 79.2 | ATCGCACGAGCCATACGACCGATG | 24 | 30 | 36 | 5 | 32 | 27 |
| 1980 | 1852 | 7141 | 76.9 | ATCGCAGCTTAGCGAAGCAAGCAA | 24 | 31 | 3 | 16 | 21 | 21 |
| 1981 | 1853 | 15350 | 77.1 | ATCGCAGCTCTGTTGAGGACTGCG | 24 | 31 | 8 | 1 | 34 | 29 |
| 1982 | 1854 | 7146 | 81 | ATCGCAGCTGTCGAGTGTGCGCAA | 24 | 31 | 9 | 20 | 33 | 21 |
| 1983 | 1855 | 30443 | 78.1 | ATCGCAGCTCGTCCTACAGCGGAC | 24 | 31 | 10 | 26 | 31 | 34 |
| 1984 | 1856 | 30444 | 77.5 | ATCGCAGCGTCTCTTGGGACCCTA | 24 | 31 | 19 | 11 | 34 | 26 |
| 1985 | 1857 | 40397 | 77.1 | ATCGCAGCAGTGTGTCCGTTCGTT | 24 | 31 | 22 | 9 | 12 | 12 |
| 1986 | 1858 | 7153 | 77.1 | ATCGCAGCATCGATACGTGCACCT | 24 | 31 | 24 | 5 | 33 | 23 |
| 1987 | 1859 | 7155 | 79.1 | ATCGCAGCGGACATACTGCGAGGA | 24 | 31 | 34 | 5 | 29 | 25 |
| 1988 | 1860 | 7156 | 81.5 | ATCGCAGCACGGCTCACGAAGTGC | 24 | 31 | 35 | 13 | 16 | 33 |
| 1989 | 1861 | 7159 | 76.4 | ATCGGACCTACAAGCCGACCCTGT | 24 | 32 | 7 | 36 | 32 | 14 |

FIG. 25NN

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 1990 | 1862 | 30446 | 79.3 | ATCGGACCCGTTCCATTCTGGTGC | 24 | 32 | 12 | 15 | 8 | 33 |
| 1991 | 1863 | 7166 | 79.3 | ATCGGACCGCAAGATGTGTCGTGC | 24 | 32 | 21 | 27 | 9 | 33 |
| 1992 | 1864 | 30447 | 78.1 | ATCGGACCATCGAGTGGCTTCGAA | 24 | 32 | 24 | 22 | 17 | 16 |
| 1993 | 1865 | 7171 | 77.8 | ATCGGACCTGCGTGTCAATCCCAT | 24 | 32 | 29 | 9 | 4 | 15 |
| 1994 | 1866 | 21160 | 75.6 | ATCGGACCGGACTTGACGTTTGTC | 24 | 32 | 34 | 1 | 12 | 9 |
| 1995 | 1867 | 15358 | 79.8 | ATCGGACCACGGCCATAGGAGCAA | 24 | 32 | 35 | 15 | 25 | 21 |
| 1996 | 1868 | 40399 | 77 | ATCGGTGCTTGATGATCAGCCGAA | 24 | 33 | 1 | 2 | 31 | 16 |
| 1997 | 1869 | 40400 | 78.8 | ATCGGTGCTGTCACCTACGGGCAA | 24 | 33 | 9 | 23 | 35 | 21 |
| 1998 | 1870 | 15361 | 76.5 | ATCGGTGCCTCACGAACCTACACG | 24 | 33 | 13 | 16 | 26 | 30 |
| 1999 | 1871 | 7181 | 76.1 | ATCGGTGCGGTAGTCTGACCGGTA | 24 | 33 | 18 | 19 | 32 | 18 |
| 2000 | 1872 | 7185 | 76.6 | ATCGGTGCGATGTTAGGCAAGTGC | 24 | 33 | 27 | 3 | 21 | 33 |
| 2001 | 1873 | 30449 | 82.6 | ATCGGTGCCACGCTGTGGACGCTT | 24 | 33 | 30 | 14 | 34 | 17 |
| 2002 | 1874 | 21166 | 79.4 | ATCGGTGCGGACAGTGCACGAAAG | 24 | 33 | 34 | 22 | 30 | 6 |
| 2003 | 1875 | 7188 | 79.7 | ATCGGTGCAGCCGAGTCGTTAGCC | 24 | 33 | 36 | 20 | 12 | 36 |
| 2004 | 1876 | 40402 | 78.6 | ATCGGGACAAAGACGGCTGTTCCC | 24 | 34 | 6 | 35 | 14 | 28 |
| 2005 | 1878 | 7193 | 75.9 | ATCGGGACCGTTCCTATCCCTCTG | 24 | 34 | 12 | 26 | 28 | 8 |
| 2006 | 1879 | 15366 | 77.8 | ATCGGGACCGAAGAGTACGGGGAC | 24 | 34 | 16 | 20 | 35 | 34 |
| 2007 | 1880 | 7197 | 79.2 | ATCGGGACGCTTGATGTCGTCACG | 24 | 34 | 17 | 27 | 10 | 30 |
| 2008 | 1881 | 30450 | 75 | ATCGGGACGGTAGGTAAAAGCACG | 24 | 34 | 18 | 18 | 6 | 30 |
| 2009 | 1882 | 40404 | 76.7 | ATCGGGACGAGTAAAGTCCCCACG | 24 | 34 | 20 | 6 | 28 | 30 |
| 2010 | 1883 | 40405 | 77.9 | ATCGGGACACCTGGTATCCCCGTT | 24 | 34 | 23 | 18 | 28 | 12 |
| 2011 | 1884 | 7203 | 77.2 | ATCGGGACTCCCTTGACTTGGCAA | 24 | 34 | 28 | 1 | 11 | 21 |
| 2012 | 1885 | 7206 | 77.6 | ATCGGGACACGGAGGACGTTCTTG | 24 | 34 | 35 | 25 | 12 | 11 |
| 2013 | 1886 | 30452 | 79.4 | ATCGACGGTTGATCTGGTGCTGCG | 24 | 35 | 1 | 8 | 33 | 29 |
| 2014 | 1887 | 7210 | 80.6 | ATCGACGGATACACGGAGCCGCAA | 24 | 35 | 5 | 35 | 36 | 21 |
| 2015 | 1888 | 7211 | 79.2 | ATCGACGGTACAACGGGACCGGAC | 24 | 35 | 7 | 35 | 32 | 34 |
| 2016 | 1890 | 40406 | 76.9 | ATCGACGGCTTGTTAGCTTGCACG | 24 | 35 | 11 | 3 | 11 | 30 |
| 2017 | 1891 | 15370 | 77.8 | ATCGACGGCTGTTGATCGTTGCAA | 24 | 35 | 14 | 2 | 12 | 21 |
| 2018 | 1892 | 21169 | 76.4 | ATCGACGGCCATTACAGGTATGCG | 24 | 35 | 15 | 7 | 18 | 29 |
| 2019 | 1893 | 7219 | 76.3 | ATCGACGGATCGGGTACGAAACCT | 24 | 35 | 24 | 18 | 16 | 23 |
| 2020 | 1894 | 15371 | 75.8 | ATCGACGGAGGACGAACGAAAGTG | 24 | 35 | 25 | 16 | 16 | 22 |
| 2021 | 1895 | 30454 | 79.3 | ATCGACGGGATGAGTGTCCCGGAC | 24 | 35 | 27 | 22 | 28 | 34 |
| 2022 | 1896 | 21173 | 81.6 | ATCGACGGACGGAATCCAGCCGAA | 24 | 35 | 35 | 4 | 31 | 16 |
| 2023 | 1897 | 7225 | 79.4 | ATCGACGGAGCCCCATACCTCACG | 24 | 35 | 36 | 15 | 23 | 30 |
| 2024 | 1898 | 30455 | 76.5 | ATCGAGCCTGATGGTAAGCCCGTT | 24 | 36 | 2 | 18 | 36 | 12 |
| 2025 | 1899 | 7227 | 77.2 | ATCGAGCCTTAGGACCGCTTCACG | 24 | 36 | 3 | 32 | 17 | 30 |
| 2026 | 1900 | 15375 | 78.7 | ATCGAGCCTGTCTCCCATCGTCCC | 24 | 36 | 9 | 28 | 24 | 28 |
| 2027 | 1901 | 15376 | 76.6 | ATCGAGCCCTTGATCGACCTCGTT | 24 | 36 | 11 | 24 | 23 | 12 |
| 2028 | 1902 | 40407 | 77.4 | ATCGAGCCCTGTGTCTACGGCGTT | 24 | 36 | 14 | 19 | 35 | 12 |
| 2029 | 1903 | 40408 | 77 | ATCGAGCCGGTAACCTGCAAGGAC | 24 | 36 | 18 | 23 | 21 | 34 |
| 2030 | 1905 | 7236 | 79.4 | ATCGAGCCGCAATGTCCTGTCACG | 24 | 36 | 21 | 9 | 14 | 30 |
| 2031 | 1906 | 21178 | 75.6 | ATCGAGCCAGGAGGTATCTGCGAA | 24 | 36 | 25 | 18 | 8 | 16 |
| 2032 | 1907 | 40409 | 78.8 | ATCGAGCCTCCCCGTTTTAGTGCG | 24 | 36 | 28 | 12 | 3 | 29 |
| 2033 | 1908 | 7241 | 75.9 | ATCGAGCCGACCTTAGGACCGAGT | 24 | 36 | 32 | 3 | 32 | 20 |
| 2034 | 1909 | 7245 | 76.4 | AGGATGATCGAACCATTCCCGCTT | 25 | 2 | 16 | 15 | 28 | 17 |
| 2035 | 1910 | 15383 | 75 | AGGATTAGGCAATCCCGCAAGATG | 25 | 3 | 21 | 28 | 21 | 27 |
| 2036 | 1911 | 30457 | 76.6 | AGGAAATCGCAATCTGACGGGCTT | 25 | 4 | 21 | 8 | 35 | 17 |
| 2037 | 1912 | 30458 | 76.9 | AGGAAATCGGACTCGTCAGCGCTT | 25 | 4 | 34 | 10 | 31 | 17 |
| 2038 | 1913 | 7271 | 76.5 | AGGAAAAGCCATCCATGATGCACG | 25 | 6 | 15 | 15 | 27 | 30 |
| 2039 | 1914 | 15390 | 75.9 | AGGAAAAGGCTTTGCGCTTGTTGA | 25 | 6 | 17 | 29 | 11 | 1 |
| 2040 | 1915 | 21182 | 75.8 | AGGAAAAGTCCCTGATGTGCGTGC | 25 | 6 | 28 | 2 | 33 | 33 |

FIG. 25OO

| SEQ ID NO: | 4,633 ID# | HEX ID# | Tm | ZIPCODE (5'-3') | TETRAMER NUMBERS | | | | |
|---|---|---|---|---|---|---|---|---|---|
| 2041 | 1916 | 30459 | 75.7 | AGGAAAAGCACGATCGAAAGGCAA | 25 | 6 | 30 | 24 | 6 | 21 |
| 2042 | 1917 | 40411 | 76.9 | AGGATCTGCGTTCTGTCGTTTGCG | 25 | 8 | 12 | 14 | 12 | 29 |
| 2043 | 1918 | 21184 | 77.8 | AGGATCTGCGAAACCTCACGACGG | 25 | 8 | 16 | 23 | 30 | 35 |
| 2044 | 1920 | 15398 | 79.2 | AGGATCTGAGCCACGGCCATCGTT | 25 | 8 | 36 | 35 | 15 | 12 |
| 2045 | 1921 | 21188 | 81.4 | AGGATGTCCAGCTCGTTGCGTGCG | 25 | 9 | 31 | 10 | 29 | 29 |
| 2046 | 1922 | 30460 | 77.2 | AGGATCGTCGAAAGCCCTTGCTTG | 25 | 10 | 16 | 36 | 11 | 11 |
| 2047 | 1924 | 30461 | 80.3 | AGGATCGTACGGCAGCGACCGATG | 25 | 10 | 35 | 31 | 32 | 27 |
| 2048 | 1925 | 15408 | 75.3 | AGGACTTGGCTTAGCCGGACAGTG | 25 | 11 | 17 | 36 | 34 | 22 |
| 2049 | 1926 | 7309 | 75.2 | AGGACTTGGGTATGTCGTGCCGTT | 25 | 11 | 18 | 9 | 33 | 12 |
| 2050 | 1927 | 40412 | 76.7 | AGGACTTGGCAATGATTCCCGGAC | 25 | 11 | 21 | 2 | 28 | 34 |
| 2051 | 1928 | 7318 | 77.6 | AGGACGTTATCGATCGTCCCGTGC | 25 | 12 | 24 | 24 | 28 | 33 |
| 2052 | 1929 | 7321 | 78.5 | AGGACGTTCAGCGAGTTGCGCCTA | 25 | 12 | 31 | 20 | 29 | 26 |
| 2053 | 1930 | 40413 | 79.3 | AGGACGTTGTGCATCGCGTTGACC | 25 | 12 | 33 | 24 | 12 | 32 |
| 2054 | 1931 | 7324 | 80.6 | AGGACGTTGGACGTGCTCCCTCCC | 25 | 12 | 34 | 33 | 28 | 28 |
| 2055 | 1932 | 40414 | 78.3 | AGGACCATGCAATGTCAGCCGGAC | 25 | 15 | 21 | 9 | 36 | 34 |
| 2056 | 1933 | 21197 | 75.6 | AGGACCATAGTGGCAAGGACACGG | 25 | 15 | 22 | 21 | 34 | 35 |
| 2057 | 1934 | 7333 | 77 | AGGACCATCAGCAAAGCCATGCAA | 25 | 15 | 31 | 6 | 15 | 21 |
| 2058 | 1935 | 15417 | 81.6 | AGGACCATGTGCTCCCACGGCGTT | 25 | 15 | 33 | 28 | 35 | 12 |
| 2059 | 1936 | 7339 | 75.3 | AGGACGAACGTTTTAGCAGCGACC | 25 | 16 | 12 | 3 | 31 | 32 |
| 2060 | 1937 | 7343 | 76.3 | AGGACGAAACCTTCTGCCATGCAA | 25 | 16 | 23 | 8 | 15 | 21 |
| 2061 | 1938 | 15422 | 75.7 | AGGACGAAACGGGGTAAAAGCCAT | 25 | 16 | 35 | 18 | 6 | 15 |
| 2062 | 1939 | 7352 | 77.3 | AGGAGCTTTCTGAGCCCACGATCG | 25 | 17 | 8 | 36 | 30 | 24 |
| 2063 | 1941 | 15438 | 79.6 | AGGAGCAAGGACCGAACCATTGCG | 25 | 21 | 34 | 16 | 15 | 29 |
| 2064 | 1942 | 30463 | 77.5 | AGGAGCAAACGGACCTCAGCGGTA | 25 | 21 | 35 | 23 | 31 | 18 |
| 2065 | 1943 | 40415 | 77.5 | AGGAAGTGCCATCGTTTCCCATCG | 25 | 22 | 15 | 12 | 28 | 24 |
| 2066 | 1945 | 7390 | 78 | AGGAAGTGCCTACACGCACGAGCC | 25 | 22 | 26 | 30 | 30 | 36 |
| 2067 | 1946 | 7393 | 77.5 | AGGAAGTGCAGCATCGCTCAGCAA | 25 | 22 | 31 | 24 | 13 | 21 |
| 2068 | 1947 | 7396 | 78.1 | AGGAAGTGAGCCCCTAAGCCACGG | 25 | 22 | 36 | 26 | 36 | 35 |
| 2069 | 1948 | 15443 | 77.8 | AGGAACCTCAGCCCATAGCCGCTT | 25 | 23 | 31 | 15 | 36 | 17 |
| 2070 | 1949 | 7404 | 79.7 | AGGAACCTGACCGCTTGGACGTGC | 25 | 23 | 32 | 17 | 34 | 33 |
| 2071 | 1950 | 7408 | 76.4 | AGGAATCGCCATCTGTGCTTCGAA | 25 | 24 | 15 | 14 | 17 | 16 |
| 2072 | 1951 | 15446 | 80.2 | AGGAATCGACCTTCCCGTGCGCTT | 25 | 24 | 23 | 28 | 33 | 17 |
| 2073 | 1952 | 30465 | 79.2 | AGGAATCGCAGCGGTAGTGCCCAT | 25 | 24 | 31 | 18 | 33 | 15 |
| 2074 | 1953 | 40419 | 79.7 | AGGAAGGACACGATCGACGGCAGC | 25 | 25 | 30 | 24 | 35 | 31 |
| 2075 | 1954 | 40420 | 79.9 | AGGAGATGGCAAATCGCACGCCAT | 25 | 27 | 21 | 24 | 30 | 15 |
| 2076 | 1955 | 30466 | 78.4 | AGGATCCCCTTGGTCTAGCCGCAA | 25 | 28 | 11 | 19 | 36 | 21 |
| 2077 | 1956 | 15460 | 76.5 | AGGATCCCGAGTTCGTGATGGCTT | 25 | 28 | 20 | 10 | 27 | 17 |
| 2078 | 1957 | 7449 | 78.7 | AGGATGCGCGTTCTTGCTGTGGAC | 25 | 29 | 12 | 11 | 14 | 34 |
| 2079 | 1958 | 15467 | 80.3 | AGGATGCGAGTGCGTTGCAACACG | 25 | 29 | 22 | 12 | 21 | 30 |
| 2080 | 1959 | 7455 | 78.8 | AGGATGCGTGCGACGGTACACGTT | 25 | 29 | 29 | 35 | 7 | 12 |
| 2081 | 1960 | 15469 | 78.4 | AGGATGCGGTGCTACACAGCGCTT | 25 | 29 | 33 | 7 | 31 | 17 |
| 2082 | 1961 | 21221 | 77.6 | AGGACACGATACGATGCAGCTGCG | 25 | 30 | 5 | 27 | 31 | 29 |
| 2083 | 1962 | 21224 | 77.4 | AGGACACGGGTATTGAACGGACGG | 25 | 30 | 18 | 1 | 35 | 35 |
| 2084 | 1963 | 7463 | 76.1 | AGGACACGACCTAGCCTCTGTGCG | 25 | 30 | 23 | 36 | 8 | 29 |
| 2085 | 1964 | 30468 | 76 | AGGACACGCCTAAAAGGGACGCTT | 25 | 30 | 26 | 6 | 34 | 17 |
| 2086 | 1965 | 7470 | 80 | AGGACACGGGACGTCTTGCGTCGT | 25 | 30 | 34 | 19 | 29 | 10 |
| 2087 | 1966 | 7479 | 80.4 | AGGACAGCATCGGTGCAGTGCACG | 25 | 31 | 24 | 33 | 22 | 30 |
| 2088 | 1967 | 15479 | 79.5 | AGGACAGCAGGATGCGGATGTCCC | 25 | 31 | 25 | 29 | 27 | 28 |
| 2089 | 1968 | 40425 | 77.4 | AGGACAGCCCTATGTCCAGCCGAA | 25 | 31 | 26 | 9 | 31 | 16 |
| 2090 | 1969 | 30470 | 77.3 | AGGACAGCCACGTTAGTCCCCGAA | 25 | 31 | 30 | 3 | 28 | 16 |
| 2091 | 1970 | 21235 | 76.9 | AGGAGTGCATACGACCATCGGCAA | 25 | 33 | 5 | 32 | 24 | 21 |

FIG. 25PP

| SEQ ID NO: | 4,633 ID# | HEX ID# | Tm | ZIPCODE (5'-3') | TETRAMER NUMBERS | | | | |
|---|---|---|---|---|---|---|---|---|---|
| 2092 | 1971 | 7498 | 80.5 | AGGAGTGCAAAGTGCGGTGCGACC | 25 | 33 | 6 | 29 | 33 | 32 |
| 2093 | 1972 | 15487 | 76.4 | AGGAGTGCGTCTAAAGCAGCGTGC | 25 | 33 | 19 | 6 | 31 | 33 |
| 2094 | 1973 | 7506 | 76 | AGGAGTGCCCTACAGCAGTGGTGC | 25 | 33 | 26 | 31 | 22 | 33 |
| 2095 | 1974 | 15491 | 77.8 | AGGAGTGCGACCTCGTTGTCGGAC | 25 | 33 | 32 | 10 | 9 | 34 |
| 2096 | 1976 | 15493 | 80.5 | AGGAGGACCTTGTCCCGCAAACGG | 25 | 34 | 11 | 28 | 21 | 35 |
| 2097 | 1977 | 15495 | 78.2 | AGGAGGACCCATGGACTCCCCTCA | 25 | 34 | 15 | 34 | 28 | 13 |
| 2098 | 1978 | 7522 | 77.4 | AGGAGGACGATGACCTCACGCGTT | 25 | 34 | 27 | 23 | 30 | 12 |
| 2099 | 1979 | 7533 | 78 | AGGAACGGATCGCCTACCATGCAA | 25 | 35 | 24 | 26 | 15 | 21 |
| 2100 | 1980 | 15502 | 77.7 | AGGAACGGAGGACACGCTGTGACC | 25 | 35 | 25 | 30 | 14 | 32 |
| 2101 | 1981 | 7535 | 78 | AGGAACGGGATGGTCTCAGCTCCC | 25 | 35 | 27 | 19 | 31 | 28 |
| 2102 | 1983 | 7539 | 76.7 | AGGAAGCCAAAGGAGTTCCCCCAT | 25 | 36 | 6 | 20 | 28 | 15 |
| 2103 | 1984 | 40427 | 76.4 | AGGAAGCCCTCAATACCACGCCAT | 25 | 36 | 13 | 5 | 30 | 15 |
| 2104 | 1985 | 15506 | 79.2 | AGGAAGCCAGTGCAGCCCATCCAT | 25 | 36 | 22 | 31 | 15 | 15 |
| 2105 | 1986 | 15508 | 79 | AGGAAGCCCACGGCTTTTGACAGC | 25 | 36 | 30 | 17 | 1 | 31 |
| 2106 | 1987 | 7553 | 79.5 | AGGAAGCCCAGCCACGCTGTGAGT | 25 | 36 | 31 | 30 | 14 | 20 |
| 2107 | 1988 | 7554 | 78.8 | AGGAAGCCGTGCTGTCCTCACACG | 25 | 36 | 33 | 9 | 13 | 30 |
| 2108 | 1989 | 7558 | 76.5 | CCTATTGATGCGGCAATCGTCGTT | 26 | 1 | 29 | 21 | 10 | 12 |
| 2109 | 1990 | 15522 | 77.5 | CCTATGTCGCAATGTCGTGCGCTT | 26 | 9 | 21 | 9 | 33 | 17 |
| 2110 | 1991 | 7587 | 81.3 | CCTATGTCACGGGACCGCAATGCG | 26 | 9 | 35 | 32 | 21 | 29 |
| 2111 | 1992 | 7589 | 78 | CCTATCGTTCGTTGTCTGCGCACG | 26 | 10 | 10 | 9 | 29 | 30 |
| 2112 | 1993 | 15526 | 81.7 | CCTATCGTCACGGTGCCAGCTGCG | 26 | 10 | 30 | 33 | 31 | 29 |
| 2113 | 1994 | 7611 | 80.7 | CCTACGTTGACCGACCGGACTGCG | 26 | 12 | 32 | 32 | 34 | 29 |
| 2114 | 1995 | 15536 | 80.7 | CCTACTGTTGCGCACGACGGGACC | 26 | 14 | 29 | 30 | 35 | 32 |
| 2115 | 1996 | 7640 | 80 | CCTAGCTTGACCTCCCGTGCCACG | 26 | 17 | 32 | 28 | 33 | 30 |
| 2116 | 1997 | 40430 | 75.4 | CCTAGCAAGCAACACGCCTACACG | 26 | 21 | 21 | 30 | 26 | 30 |
| 2117 | 1998 | 30474 | 76 | CCTAATCGCCATAGTGTCCCCACG | 26 | 24 | 15 | 22 | 28 | 30 |
| 2118 | 1999 | 7700 | 77 | CCTATCCCTTGAAGCCACGGCTGT | 26 | 28 | 1 | 36 | 35 | 14 |
| 2119 | 2000 | 30475 | 79.4 | CCTATCCCCTCAGACCACGGCGAA | 26 | 28 | 13 | 32 | 35 | 16 |
| 2120 | 2001 | 30476 | 75.6 | CCTATCCCCACGTGATAGCCGGTA | 26 | 28 | 30 | 2 | 36 | 18 |
| 2121 | 2002 | 7731 | 78.5 | CCTACACGTCGTAGCCCACGCGTT | 26 | 30 | 10 | 36 | 30 | 12 |
| 2122 | 2003 | 7733 | 78.8 | CCTACACGCTGTCGTTGTGCGTGC | 26 | 30 | 14 | 12 | 33 | 33 |
| 2123 | 2004 | 7740 | 77.7 | CCTACACGCAGCAGTGTGCGACCT | 26 | 30 | 31 | 22 | 29 | 23 |
| 2124 | 2005 | 21261 | 77.6 | CCTACAGCGTCTTCGTCAGCTGCG | 26 | 31 | 19 | 10 | 31 | 29 |
| 2125 | 2006 | 7747 | 78.4 | CCTACAGCGAGTCACGGCAAAGCC | 26 | 31 | 20 | 30 | 21 | 36 |
| 2126 | 2008 | 30477 | 75.1 | CCTAGACCCGAACCATCCATACGG | 26 | 32 | 16 | 15 | 15 | 35 |
| 2127 | 2009 | 21266 | 75.5 | CCTAGTGCGTCTCGTTACGGGACC | 26 | 33 | 19 | 12 | 35 | 32 |
| 2128 | 2010 | 7780 | 75.2 | CCTAGTGCACGGTTGAGCAAATCG | 26 | 33 | 35 | 1 | 21 | 24 |
| 2129 | 2011 | 15616 | 79.6 | CCTAGGACCACGCAGCTCGTGCAA | 26 | 34 | 30 | 31 | 10 | 21 |
| 2130 | 2012 | 40433 | 75.6 | CCTAAGCCGAGTAGTGGTGCGACC | 26 | 36 | 20 | 22 | 33 | 32 |
| 2131 | 2013 | 40434 | 77.5 | CCTAAGCCACCTCTTGTCCCTGCG | 26 | 36 | 23 | 11 | 28 | 29 |
| 2132 | 2014 | 7825 | 80.1 | GATGTTGAAGCCGTGCGTGCGGTA | 27 | 1 | 36 | 33 | 33 | 18 |
| 2133 | 2015 | 7831 | 80.5 | GATGAATCGTGCACGGCGTTTCCC | 27 | 4 | 33 | 35 | 12 | 28 |
| 2134 | 2016 | 7832 | 78.5 | GATGAATCACGGTCGTTCCCCACG | 27 | 4 | 35 | 10 | 28 | 30 |
| 2135 | 2017 | 7834 | 79 | GATGAAAGCCATCAGCGGACGTGC | 27 | 6 | 15 | 31 | 34 | 33 |
| 2136 | 2018 | 15632 | 76.9 | GATGAAAGCGAAAGCCCCATCGTT | 27 | 6 | 16 | 36 | 15 | 12 |
| 2137 | 2019 | 15633 | 82.8 | GATGAAAGCACGCAGCTGCGTGCG | 27 | 6 | 30 | 31 | 29 | 29 |
| 2138 | 2020 | 7845 | 77.4 | GATGCTTGCGTTCCATGTGCACCT | 27 | 11 | 12 | 15 | 33 | 23 |
| 2139 | 2021 | 7854 | 80.6 | GATGCGTTTGTCCGAAAAGCCACGG | 27 | 12 | 9 | 16 | 36 | 35 |
| 2140 | 2022 | 15643 | 78.1 | GATGCGTTGGACAGCCCCTACAGC | 27 | 12 | 34 | 36 | 26 | 31 |
| 2141 | 2023 | 7867 | 80.7 | GATGCTCACACGCGAACACGGTGC | 27 | 13 | 30 | 16 | 30 | 33 |
| 2142 | 2024 | 7870 | 77 | GATGCTGTCGAACCTATGCGGTGC | 27 | 14 | 16 | 26 | 29 | 33 |

FIG. 25QQ

| SEQ ID NO: | 4,633 ID# | HEX ID# | Tm | ZIPCODE (5'-3') | TETRAMER NUMBERS | | | | |
|---|---|---|---|---|---|---|---|---|---|
| 2143 | 2025 | 7873 | 80 | GATGCTGTCAGCCACGGCTTGTGC | 27 | 14 | 31 | 30 | 17 | 33 |
| 2144 | 2026 | 7875 | 79.7 | GATGCTGTAGCCACGGGCAACACG | 27 | 14 | 36 | 35 | 21 | 30 |
| 2145 | 2027 | 7879 | 76.9 | GATGCCATCGTTTCGTGCTTGGAC | 27 | 15 | 12 | 10 | 17 | 34 |
| 2146 | 2028 | 30480 | 77.5 | GATGCCATCCATCAGCCGAAACCT | 27 | 15 | 15 | 31 | 16 | 23 |
| 2147 | 2030 | 7883 | 77.6 | GATGCCATAGGAGGACCAGCCGAA | 27 | 15 | 25 | 34 | 31 | 16 |
| 2148 | 2031 | 7884 | 77.2 | GATGCCATCCTACGAAAGCCGACC | 27 | 15 | 26 | 16 | 36 | 32 |
| 2149 | 2032 | 15648 | 79.1 | GATGCCATTCCCGGTACAGCCCAT | 27 | 15 | 28 | 18 | 31 | 15 |
| 2150 | 2033 | 7895 | 79.9 | GATGCGAACTCATGCGGGACTCCC | 27 | 16 | 13 | 29 | 34 | 28 |
| 2151 | 2034 | 30483 | 78 | GATGCGAAATCGCCTACAGCGCTT | 27 | 16 | 24 | 26 | 31 | 17 |
| 2152 | 2035 | 7908 | 78.7 | GATGCGAAACGGGCAATGTCCTTG | 27 | 16 | 35 | 21 | 9 | 11 |
| 2153 | 2036 | 15657 | 79.2 | GATGCGAAAGCCGCTTGCAACTTG | 27 | 16 | 36 | 17 | 21 | 11 |
| 2154 | 2037 | 7913 | 80.8 | GATGGCTTCTTGCACGGACCGTGC | 27 | 17 | 11 | 30 | 32 | 33 |
| 2155 | 2038 | 30484 | 77.5 | GATGGCTTGCAAAGGATCGTGCAA | 27 | 17 | 21 | 25 | 10 | 21 |
| 2156 | 2039 | 7923 | 79.3 | GATGGCTTGACCGTCTCAGCTGCG | 27 | 17 | 32 | 19 | 31 | 29 |
| 2157 | 2040 | 15665 | 76.8 | GATGGGTATGCGATCGCACGAATC | 27 | 18 | 29 | 24 | 30 | 4 |
| 2158 | 2041 | 7931 | 82.3 | GATGGGTAGTGCCACGTGCGCACG | 27 | 18 | 33 | 30 | 29 | 30 |
| 2159 | 2042 | 7933 | 78.4 | GATGGAGTTCCCGGTAGTGCGCAA | 27 | 20 | 28 | 18 | 33 | 21 |
| 2160 | 2043 | 7938 | 79.8 | GATGGCAATCTGCGAATCCCAGCC | 27 | 21 | 8 | 16 | 28 | 36 |
| 2161 | 2044 | 40438 | 75.8 | GATGGCAACGTTATACGCAATGCG | 27 | 21 | 12 | 5 | 21 | 29 |
| 2162 | 2045 | 30485 | 75.8 | GATGGCAAGCTTCAGCCCTAGTGC | 27 | 21 | 17 | 31 | 26 | 33 |
| 2163 | 2046 | 30486 | 76 | GATGGCAAACCTAAAGCAGCCGAA | 27 | 21 | 23 | 6 | 31 | 16 |
| 2164 | 2047 | 7947 | 80.2 | GATGGCAAGATGGACCAGCCCGAA | 27 | 21 | 27 | 32 | 36 | 16 |
| 2165 | 2048 | 7954 | 76 | GATGAGTGGCAACGTTCGTTTCCC | 27 | 22 | 21 | 12 | 12 | 28 |
| 2166 | 2049 | 40439 | 78.7 | GATGACCTTGCGCGTTGCTTCGTT | 27 | 23 | 29 | 12 | 17 | 12 |
| 2167 | 2050 | 30487 | 76.9 | GATGATCGCGTTCCATGCTTACGG | 27 | 24 | 12 | 15 | 17 | 35 |
| 2168 | 2051 | 7959 | 78.1 | GATGATCGCCATTGTCCACGCTCA | 27 | 24 | 15 | 9 | 30 | 13 |
| 2169 | 2052 | 40440 | 78.8 | GATGATCGGCTTCCATGGACTGCG | 27 | 24 | 17 | 15 | 34 | 29 |
| 2170 | 2053 | 30488 | 80.5 | GATGATCGCACGGATGCGTTCACG | 27 | 24 | 30 | 27 | 12 | 30 |
| 2171 | 2054 | 7980 | 77.4 | GATGCCTAAGCCGGTAGTGCGGAC | 27 | 26 | 36 | 18 | 33 | 34 |
| 2172 | 2055 | 7981 | 76.5 | GATGGATGCTCAGACCCGTTCGAA | 27 | 27 | 13 | 32 | 12 | 16 |
| 2173 | 2056 | 7985 | 80.8 | GATGGATGCCTATGCGAGCCTGCG | 27 | 27 | 26 | 29 | 36 | 29 |
| 2174 | 2057 | 15679 | 78.1 | GATGGATGGTGCTGATCACGCGAA | 27 | 27 | 33 | 2 | 30 | 16 |
| 2175 | 2058 | 7988 | 77.2 | GATGGATGAGCCAATCCAGCTCCC | 27 | 27 | 36 | 4 | 31 | 28 |
| 2176 | 2059 | 30489 | 75.1 | GATGTCCCGCTTAATCCTTGCGTT | 27 | 28 | 17 | 4 | 11 | 12 |
| 2177 | 2060 | 7993 | 77.3 | GATGTCCCGTCTCGTTGACCCCAT | 27 | 28 | 19 | 12 | 32 | 15 |
| 2178 | 2061 | 15686 | 79.6 | GATGTCCCCAGCGCTTCACGGTCT | 27 | 28 | 31 | 17 | 30 | 19 |
| 2179 | 2062 | 15687 | 78.2 | GATGTCCCGACCATACTCCCGCAA | 27 | 28 | 32 | 5 | 28 | 21 |
| 2180 | 2063 | 21306 | 76 | GATGTGCGTTAGCAGCGATGATCG | 27 | 29 | 3 | 31 | 27 | 24 |
| 2181 | 2064 | 15692 | 76.8 | GATGTGCGGGTAATCGGCTTGATG | 27 | 29 | 18 | 24 | 17 | 27 |
| 2182 | 2065 | 15696 | 80.2 | GATGTGCGCACGCGAATCGTAGGA | 27 | 29 | 30 | 16 | 10 | 25 |
| 2183 | 2066 | 30492 | 81.3 | GATGTGCGCAGCGCAAATCGACCT | 27 | 29 | 31 | 21 | 24 | 23 |
| 2184 | 2067 | 8021 | 82.6 | GATGCACGTGTCGTGCAGCCGGAC | 27 | 30 | 9 | 33 | 36 | 34 |
| 2185 | 2068 | 8024 | 78.2 | GATGCACGCCATCGTTCGTTCTCA | 27 | 30 | 15 | 12 | 12 | 13 |
| 2186 | 2069 | 8028 | 79.7 | GATGCACGAGTGACGGATCGGTGC | 27 | 30 | 22 | 35 | 24 | 33 |
| 2187 | 2070 | 15699 | 81.7 | GATGCACGTGCGGTCTGACCCAGC | 27 | 30 | 29 | 19 | 32 | 31 |
| 2188 | 2071 | 15700 | 80.1 | GATGCACGCACGCTTGATCGGGTA | 27 | 30 | 30 | 11 | 24 | 18 |
| 2189 | 2072 | 30494 | 81.5 | GATGCACGAGCCGACCAATCACGG | 27 | 30 | 36 | 32 | 4 | 35 |
| 2190 | 2073 | 8036 | 79 | GATGCAGCTGATTGCGATCGGGAC | 27 | 31 | 2 | 29 | 24 | 34 |
| 2191 | 2074 | 30495 | 79.8 | GATGCAGCTCGTCACGTCCCATCG | 27 | 31 | 10 | 30 | 28 | 24 |
| 2192 | 2075 | 15704 | 77.7 | GATGCAGCCTTGATCGCGAACTCA | 27 | 31 | 11 | 24 | 16 | 13 |
| 2193 | 2076 | 40443 | 76.7 | GATGCAGCCTCATGATGACCGCTT | 27 | 31 | 13 | 2 | 32 | 17 |

FIG. 25RR

| SEQ ID NO: | 4,633 ID# | HEX ID# | Tm | ZIPCODE (5'-3') | TETRAMER NUMBERS | | | | |
|---|---|---|---|---|---|---|---|---|---|
| 2194 | 2077 | 30496 | 76.1 | GATGCAGCGGTAGGTAACGGGATG | 27 | 31 | 18 | 18 | 35 | 27 |
| 2195 | 2078 | 8048 | 81 | GATGCAGCGTGCGCTTGTCTCACG | 27 | 31 | 33 | 17 | 19 | 30 |
| 2196 | 2079 | 15708 | 79.7 | GATGCAGCAGCCCTCATCCCGAGT | 27 | 31 | 36 | 13 | 28 | 20 |
| 2197 | 2080 | 40444 | 78.3 | GATGGACCCGTTGGACAAAGCGAA | 27 | 32 | 12 | 34 | 6 | 16 |
| 2198 | 2082 | 15712 | 77.2 | GATGGACCCACGACGGGGTAGGTA | 27 | 32 | 30 | 35 | 18 | 18 |
| 2199 | 2084 | 8088 | 79.4 | GATGACGGTTGAGCTTTGCGGCAA | 27 | 35 | 1 | 17 | 29 | 21 |
| 2200 | 2085 | 30499 | 77.5 | GATGACGGGGTAGACCCGAAGCAA | 27 | 35 | 18 | 32 | 16 | 21 |
| 2201 | 2086 | 40447 | 78.5 | GATGAGCCCTCACTCAAGCCTGCG | 27 | 36 | 13 | 13 | 36 | 29 |
| 2202 | 2087 | 21328 | 76.4 | GATGAGCCGTCTACGGCAGCAATC | 27 | 36 | 19 | 35 | 31 | 4 |
| 2203 | 2088 | 15729 | 78.1 | GATGAGCCATCGTCGTCCATGCAA | 27 | 36 | 24 | 10 | 15 | 21 |
| 2204 | 2089 | 8108 | 76.6 | GATGAGCCCAGCATACGCAACGTT | 27 | 36 | 31 | 5 | 21 | 12 |
| 2205 | 2090 | 8112 | 79.2 | TCCCTTGAAATCTGCGAGCCCGTT | 28 | 1 | 4 | 29 | 36 | 12 |
| 2206 | 2091 | 21331 | 77.9 | TCCCTTGAAGGAAGCCCTTGTCCC | 28 | 1 | 25 | 36 | 11 | 28 |
| 2207 | 2092 | 30500 | 76.5 | TCCCTTGATGCGTTAGGGTATGCG | 28 | 1 | 29 | 3 | 18 | 29 |
| 2208 | 2093 | 8118 | 77.6 | TCCCTTGACAGCAAAGATCGCACG | 28 | 1 | 31 | 6 | 24 | 30 |
| 2209 | 2094 | 15734 | 81.1 | TCCCTTGAGGACCACGGATGCACG | 28 | 1 | 34 | 30 | 27 | 30 |
| 2210 | 2095 | 8122 | 79.6 | TCCCTGATTCTGGGACCAGCAGCC | 28 | 2 | 8 | 34 | 31 | 36 |
| 2211 | 2096 | 21332 | 77.2 | TCCCTGATTCGTAATCACGGCACG | 28 | 2 | 10 | 4 | 35 | 30 |
| 2212 | 2097 | 40453 | 77.7 | TCCCTGATCGAATTGAAGCCAGCC | 28 | 2 | 16 | 1 | 36 | 36 |
| 2213 | 2099 | 15737 | 76.7 | TCCCTGATTGCGAGGACCTATCCC | 28 | 2 | 29 | 25 | 26 | 28 |
| 2214 | 2100 | 8131 | 79.1 | TCCCTGATGACCTGTCACGGACGG | 28 | 2 | 32 | 9 | 35 | 35 |
| 2215 | 2101 | 8136 | 77.3 | TCCCTTAGCTGTATCGTGCGCGAA | 28 | 3 | 14 | 24 | 29 | 16 |
| 2216 | 2102 | 30501 | 75.4 | TCCCTTAGGCAAGCTTGCAAGGAC | 28 | 3 | 21 | 17 | 21 | 34 |
| 2217 | 2103 | 8140 | 76.1 | TCCCTTAGAGGAAATCTGCGTGCG | 28 | 3 | 25 | 4 | 29 | 29 |
| 2218 | 2104 | 8143 | 77 | TCCCTTAGCACGCTTGAGGATCCC | 28 | 3 | 30 | 11 | 25 | 28 |
| 2219 | 2106 | 30502 | 79 | TCCCAATCCTGTGGACTCCCGCTT | 28 | 4 | 14 | 34 | 28 | 17 |
| 2220 | 2107 | 30503 | 76.4 | TCCCAATCGCTTCCTAGACCCCAT | 28 | 4 | 17 | 26 | 32 | 15 |
| 2221 | 2108 | 8155 | 75.5 | TCCCAATCGAGTACCTGACCGACC | 28 | 4 | 20 | 23 | 32 | 32 |
| 2222 | 2109 | 8157 | 80.2 | TCCCAATCAGTGGACCGACCAGCC | 28 | 4 | 22 | 32 | 32 | 36 |
| 2223 | 2110 | 30504 | 77.2 | TCCCAATCACCTCTTGAGCCCGTT | 28 | 4 | 23 | 11 | 36 | 12 |
| 2224 | 2111 | 15748 | 78.9 | TCCCAATCTCCCAGTGTGCGAGGA | 28 | 4 | 28 | 22 | 29 | 25 |
| 2225 | 2112 | 8162 | 76.7 | TCCCAATCGACCTCTGCACGAAAG | 28 | 4 | 32 | 8 | 30 | 6 |
| 2226 | 2113 | 8164 | 78.8 | TCCCAATCAGCCGATGCGTTAGGA | 28 | 4 | 36 | 27 | 12 | 25 |
| 2227 | 2114 | 8166 | 78.8 | TCCCATACCTTGGTGCACGGGATG | 28 | 5 | 11 | 33 | 35 | 27 |
| 2228 | 2115 | 30506 | 78 | TCCCATACCCATCAGCCAGCGAGT | 28 | 5 | 15 | 31 | 31 | 20 |
| 2229 | 2116 | 30507 | 76.3 | TCCCATACCGAAATACGTGCGGAC | 28 | 5 | 16 | 5 | 33 | 34 |
| 2230 | 2117 | 15753 | 78.4 | TCCCATACGTGCCGAACTCAAGCC | 28 | 5 | 33 | 16 | 13 | 36 |
| 2231 | 2118 | 30510 | 78 | TCCCAAAGCGTTTCGTCGTTCCAT | 28 | 6 | 12 | 10 | 12 | 15 |
| 2232 | 2119 | 40458 | 76.3 | TCCCAAGGGTACCATCGTTCACG | 28 | 6 | 18 | 15 | 12 | 30 |
| 2233 | 2120 | 40459 | 78.9 | TCCCAAGGTCTCGTTCACGGCAA | 28 | 6 | 19 | 12 | 30 | 21 |
| 2234 | 2121 | 30511 | 78.1 | TCCCAAAGACCTCACGATCGCGTT | 28 | 6 | 23 | 30 | 24 | 12 |
| 2235 | 2122 | 8183 | 76.4 | TCCCAAAGATCGCGAATTAGCGAA | 28 | 6 | 24 | 16 | 3 | 16 |
| 2236 | 2123 | 8184 | 76.2 | TCCCAAAGGATGACCTCTTGCGAA | 28 | 6 | 27 | 23 | 11 | 16 |
| 2237 | 2124 | 8186 | 76.8 | TCCCAAAGTGCGTGATCCATTCGT | 28 | 6 | 29 | 2 | 15 | 10 |
| 2238 | 2125 | 8188 | 77.6 | TCCCAAAGCAGCAATCTGTCGTGC | 28 | 6 | 31 | 4 | 9 | 33 |
| 2239 | 2126 | 8189 | 75.4 | TCCCAAAGGACCTCGTTCGTAGGA | 28 | 6 | 32 | 10 | 10 | 25 |
| 2240 | 2127 | 30512 | 79.2 | TCCCAAAGAGCCCTTGACGGCCTA | 28 | 6 | 36 | 11 | 35 | 26 |
| 2241 | 2129 | 15757 | 77.9 | TCCCTCTGCGTTTCCCTCGTTCTG | 28 | 8 | 12 | 28 | 10 | 8 |
| 2242 | 2130 | 40460 | 77.5 | TCCCTCTGCTCACCTAACGGCGTT | 28 | 8 | 13 | 26 | 35 | 12 |
| 2243 | 2131 | 15759 | 78.6 | TCCCTCTGGTCTGACCCGAATCCC | 28 | 8 | 19 | 32 | 16 | 28 |
| 2244 | 2132 | 30515 | 80.7 | TCCCTCTGATCGCAGCGCAAGACC | 28 | 8 | 24 | 31 | 21 | 32 |

FIG. 25SS

| SEQ ID NO: | 4,633 ID# | HEX ID# | Tm | ZIPCODE (5'-3') | TETRAMER NUMBERS | | | | |
|---|---|---|---|---|---|---|---|---|---|
| 2245 | 2133 | 8206 | 76.8 | TCCCTCTGAGGACGTTCTGTTGCG | 28 | 8 | 25 | 12 | 14 | 29 |
| 2246 | 2135 | 8208 | 77 | TCCCTCTGTCCCTTGATGTCGCAA | 28 | 8 | 28 | 1 | 9 | 21 |
| 2247 | 2136 | 40461 | 78.4 | TCCCTCTGGGACTGTCGACCATCG | 28 | 8 | 34 | 9 | 32 | 24 |
| 2248 | 2137 | 8213 | 78.6 | TCCCTGTCCTTGCGTTTCTGACGG | 28 | 9 | 11 | 12 | 8 | 35 |
| 2249 | 2138 | 40462 | 79.2 | TCCCTGTCATCGAATCGTGCGGAC | 28 | 9 | 24 | 4 | 33 | 34 |
| 2250 | 2139 | 15761 | 79.4 | TCCCTGTCAGGATGTCGACCTGCG | 28 | 9 | 25 | 9 | 32 | 29 |
| 2251 | 2140 | 40463 | 77 | TCCCTGTCGGACTACATCCCCGTT | 28 | 9 | 34 | 7 | 28 | 12 |
| 2252 | 2141 | 15766 | 78.7 | TCCCTCGTTGTCACCTCAGCAGCC | 28 | 10 | 9 | 23 | 31 | 36 |
| 2253 | 2142 | 30518 | 79.5 | TCCCTCGTCTCAGACCCAGCGCTT | 28 | 10 | 13 | 32 | 31 | 17 |
| 2254 | 2143 | 40464 | 77.4 | TCCCTCGTGGTATACATGCGCAGC | 28 | 10 | 18 | 7 | 29 | 31 |
| 2255 | 2144 | 8234 | 77.8 | TCCCTCGTGTCTTGTCAGCCTCCC | 28 | 10 | 19 | 9 | 36 | 28 |
| 2256 | 2145 | 40465 | 79.8 | TCCCTCGTGCAAAGTGGTGCAGGA | 28 | 10 | 21 | 22 | 33 | 25 |
| 2257 | 2146 | 40466 | 76.1 | TCCCTCGTACCTCCTAGTGCTGCG | 28 | 10 | 23 | 26 | 33 | 29 |
| 2258 | 2147 | 8237 | 79.8 | TCCCTCGTGATGCACGATCGAGGA | 28 | 10 | 27 | 30 | 24 | 25 |
| 2259 | 2148 | 8238 | 79.3 | TCCCTCGTTGCGCCATAGGAGCTT | 28 | 10 | 29 | 15 | 25 | 17 |
| 2260 | 2149 | 8240 | 76.6 | TCCCTCGTGACCTCGTGCAAAATC | 28 | 10 | 32 | 10 | 21 | 4 |
| 2261 | 2150 | 15769 | 76.4 | TCCCTCGTGTGCTTAGCCATGCTT | 28 | 10 | 33 | 3 | 15 | 17 |
| 2262 | 2151 | 21356 | 79.1 | TCCCTCGTGGACGCTTAGTGCGAA | 28 | 10 | 34 | 17 | 22 | 16 |
| 2263 | 2152 | 30519 | 78 | TCCCCTTGTGATTCGTTGCGACCT | 28 | 11 | 2 | 10 | 29 | 23 |
| 2264 | 2153 | 21357 | 76.8 | TCCCCTTGAAAGGGTAACCTTGCG | 28 | 11 | 6 | 18 | 23 | 29 |
| 2265 | 2154 | 30520 | 77.3 | TCCCCTTGTCTGACCTAGCCCGAA | 28 | 11 | 8 | 23 | 36 | 16 |
| 2266 | 2155 | 40469 | 78.3 | TCCCCTTGCTCAGGACTCTGGCAA | 28 | 11 | 13 | 34 | 8 | 21 |
| 2267 | 2156 | 30521 | 78.2 | TCCCCTTGGGTAAGTGTGCGGATG | 28 | 11 | 18 | 22 | 29 | 27 |
| 2268 | 2157 | 40470 | 77.5 | TCCCCTTGATCGTCTGTCCCCTTG | 28 | 11 | 24 | 8 | 28 | 11 |
| 2269 | 2159 | 15779 | 78.5 | TCCCCTTGAGCCAGGATTGATCCC | 28 | 11 | 36 | 25 | 1 | 28 |
| 2270 | 2160 | 30522 | 75.3 | TCCCCGTTTGATATCGTGATTCCC | 28 | 12 | 2 | 24 | 2 | 28 |
| 2271 | 2161 | 8266 | 77.9 | TCCCCGTTATACGTGCGATGGCTT | 28 | 12 | 5 | 33 | 27 | 17 |
| 2272 | 2162 | 40473 | 76.6 | TCCCCGTTTACATTGACACGCCAT | 28 | 12 | 7 | 1 | 30 | 15 |
| 2273 | 2163 | 40474 | 78 | TCCCCGTTTGTCTGTCGACCGAGT | 28 | 12 | 9 | 9 | 32 | 20 |
| 2274 | 2164 | 8267 | 78.4 | TCCCCGTTTCGTCAGCATCGAATC | 28 | 12 | 10 | 31 | 24 | 4 |
| 2275 | 2165 | 8268 | 78.3 | TCCCCGTTCTTGGAGTGGTATGCG | 28 | 12 | 11 | 20 | 18 | 29 |
| 2276 | 2166 | 8270 | 77 | TCCCCGTTCTCAGGTACACGCTCA | 28 | 12 | 13 | 18 | 30 | 13 |
| 2277 | 2167 | 8272 | 79 | TCCCCGTTCCATCACGGATGAGTG | 28 | 12 | 15 | 30 | 27 | 22 |
| 2278 | 2168 | 8274 | 77.6 | TCCCCGTTGCTTTCCCCTGTAGTG | 28 | 12 | 17 | 28 | 14 | 22 |
| 2279 | 2169 | 8276 | 78.8 | TCCCCGTTGCAATCTGACCTCGAA | 28 | 12 | 21 | 8 | 23 | 16 |
| 2280 | 2170 | 30523 | 76.3 | TCCCCGTTACCTTGATACGGGCTT | 28 | 12 | 23 | 2 | 35 | 17 |
| 2281 | 2171 | 8277 | 77.4 | TCCCCGTTATCGCCTATCCCAGTG | 28 | 12 | 24 | 26 | 28 | 22 |
| 2282 | 2172 | 8281 | 80.3 | TCCCCGTTTGCGTCGTAGGACAGC | 28 | 12 | 29 | 10 | 25 | 31 |
| 2283 | 2173 | 8283 | 80.6 | TCCCCGTTGTGCAGTGCGTTCTCA | 28 | 12 | 33 | 22 | 12 | 13 |
| 2284 | 2175 | 15780 | 81.6 | TCCCCTCATGATTGCGACGGGCTT | 28 | 13 | 2 | 29 | 35 | 17 |
| 2285 | 2176 | 8287 | 78.2 | TCCCCTCATTAGCTTGTGCGCGTT | 28 | 13 | 3 | 11 | 29 | 12 |
| 2286 | 2178 | 8290 | 75.7 | TCCCCTCATCTGGCTTTTAGCGAA | 28 | 13 | 8 | 17 | 3 | 16 |
| 2287 | 2180 | 8295 | 75.7 | TCCCCTCACCATCCTAAGCCAGTG | 28 | 13 | 15 | 26 | 36 | 22 |
| 2288 | 2181 | 30525 | 75.3 | TCCCCTCAGCTTAGGACGAACAGC | 28 | 13 | 17 | 25 | 16 | 31 |
| 2289 | 2182 | 8298 | 76.7 | TCCCCTCAACCTCCTACACGTCCC | 28 | 13 | 23 | 26 | 30 | 28 |
| 2290 | 2184 | 8302 | 79.2 | TCCCCTCACACGATCGTCGTGACC | 28 | 13 | 30 | 24 | 10 | 32 |
| 2291 | 2185 | 8303 | 79.1 | TCCCCTCACAGCCTGTTCCCACCT | 28 | 13 | 31 | 14 | 28 | 23 |
| 2292 | 2186 | 30527 | 79.2 | TCCCCTGTTGATGCTTGACCGTGC | 28 | 14 | 2 | 17 | 32 | 33 |
| 2293 | 2187 | 8308 | 80 | TCCCCTGTTCTGCCATGATGTGCG | 28 | 14 | 8 | 15 | 27 | 29 |
| 2294 | 2188 | 40477 | 80 | TCCCCTGTTGTCGCAAGACCGCTT | 28 | 14 | 9 | 21 | 32 | 17 |
| 2295 | 2189 | 30528 | 75.4 | TCCCCTGTTCGTACCTATCGCGTT | 28 | 14 | 10 | 23 | 24 | 12 |

FIG. 25TT

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 2296 | 2190 | 15784 | 75.6 | TCCCCTGTCGAAAAAGCGTTAGGA | 28 | 14 | 16 | 6 | 12 | 25 |
| 2297 | 2191 | 8315 | 78.8 | TCCCCTGTGCAAAGTGGACCCTCA | 28 | 14 | 21 | 22 | 32 | 13 |
| 2298 | 2192 | 30529 | 77 | TCCCCTGTAGGATCCCGCAATGAT | 28 | 14 | 25 | 28 | 21 | 2 |
| 2299 | 2193 | 40479 | 79.1 | TCCCCTGTCCTAAGCCTGCGGGTA | 28 | 14 | 26 | 36 | 29 | 18 |
| 2300 | 2194 | 30530 | 81.8 | TCCCCTGTGATGGGACACGGGACC | 28 | 14 | 27 | 34 | 35 | 32 |
| 2301 | 2195 | 8320 | 81.3 | TCCCCTGTTGCGCTTGTGTCAGCC | 28 | 14 | 29 | 11 | 9 | 36 |
| 2302 | 2196 | 8325 | 76 | TCCCCCATTTGATCGTAGTGCGTT | 28 | 15 | 1 | 10 | 22 | 12 |
| 2303 | 2198 | 8330 | 76.3 | TCCCCCATCTTGTGCGGATGTTAG | 28 | 15 | 11 | 29 | 27 | 3 |
| 2304 | 2199 | 8331 | 77.9 | TCCCCCATCGTTGTCTCGAACGTT | 28 | 15 | 12 | 19 | 16 | 12 |
| 2305 | 2200 | 30532 | 77.9 | TCCCCCATCTCAGACCATCGCCTA | 28 | 15 | 13 | 32 | 24 | 26 |
| 2306 | 2201 | 30533 | 78.1 | TCCCCCATGCTTCTTGCGAAGGTA | 28 | 15 | 17 | 11 | 16 | 18 |
| 2307 | 2202 | 40481 | 75.8 | TCCCCCATGGTATTGAAAAGGCAA | 28 | 15 | 18 | 1 | 6 | 21 |
| 2308 | 2203 | 8335 | 76.6 | TCCCCCATAGTGAGTGCGTTCAGC | 28 | 15 | 22 | 22 | 12 | 31 |
| 2309 | 2204 | 8336 | 80 | TCCCCCATTGCGAATCAGCCAATC | 28 | 15 | 29 | 4 | 36 | 4 |
| 2310 | 2205 | 15792 | 80.4 | TCCCCCATGTGCCAGCTTAGCAGC | 28 | 15 | 33 | 31 | 3 | 31 |
| 2311 | 2206 | 21375 | 75.3 | TCCCCCATGGACACCTATACAGCC | 28 | 15 | 34 | 23 | 5 | 36 |
| 2312 | 2208 | 40485 | 76.5 | TCCCCGAAATACAATCTCCCGGAC | 28 | 16 | 5 | 4 | 28 | 34 |
| 2313 | 2209 | 8346 | 77.6 | TCCCCGAAAAAGGCAAGGTACACG | 28 | 16 | 6 | 21 | 18 | 30 |
| 2314 | 2210 | 8347 | 77 | TCCCCGAATACAAGTGCAGCCTCA | 28 | 16 | 7 | 22 | 31 | 13 |
| 2315 | 2211 | 8350 | 78.5 | TCCCCGAACTTGGATGCAGCAAAG | 28 | 16 | 11 | 27 | 31 | 6 |
| 2316 | 2212 | 40486 | 78.5 | TCCCCGAAGCTTTTGACCATTCCC | 28 | 16 | 17 | 1 | 15 | 28 |
| 2317 | 2213 | 40487 | 78.7 | TCCCCGAAGTCTGGTAGTGCTGCG | 28 | 16 | 19 | 18 | 33 | 29 |
| 2318 | 2214 | 15795 | 79.5 | TCCCCGAAAGTGGGACGGACTCTG | 28 | 16 | 22 | 34 | 34 | 8 |
| 2319 | 2215 | 8359 | 79.3 | TCCCCGAATGCGATCGTTAGTCCC | 28 | 16 | 29 | 24 | 3 | 28 |
| 2320 | 2217 | 40490 | 78.4 | TCCCGCTTTTAGGACCGGACGTCT | 28 | 17 | 3 | 32 | 34 | 19 |
| 2321 | 2218 | 21380 | 75.7 | TCCCGCTTTACACTGTACGGGGAC | 28 | 17 | 7 | 14 | 35 | 34 |
| 2322 | 2219 | 8367 | 78.7 | TCCCGCTTCGAAATCGTCTGCTTG | 28 | 17 | 16 | 24 | 8 | 11 |
| 2323 | 2220 | 8368 | 78.4 | TCCCGCTTGCTTGTGCGGTAGAGT | 28 | 17 | 17 | 33 | 18 | 20 |
| 2324 | 2221 | 30536 | 76.2 | TCCCGCTTGTCTAGGACTTGCAGC | 28 | 17 | 19 | 25 | 11 | 31 |
| 2325 | 2222 | 40494 | 79.6 | TCCCGCTTAGTGCTTGGACCGACC | 28 | 17 | 22 | 11 | 32 | 32 |
| 2326 | 2223 | 8372 | 76.4 | TCCCGCTTATCGAGCCTTGATTGA | 28 | 17 | 24 | 36 | 1 | 1 |
| 2327 | 2224 | 8375 | 77.6 | TCCCGCTTCACGATCGCCTAGAGT | 28 | 17 | 30 | 24 | 26 | 20 |
| 2328 | 2225 | 8376 | 80.1 | TCCCGCTTCAGCCTCAGATGCCAT | 28 | 17 | 31 | 13 | 27 | 15 |
| 2329 | 2226 | 15801 | 77.7 | TCCCGCTTAGCCTCTGGCTTTTGA | 28 | 17 | 36 | 8 | 17 | 1 |
| 2330 | 2227 | 15802 | 77.2 | TCCCGGTATGATCGAAGATGTGCG | 28 | 18 | 2 | 16 | 27 | 29 |
| 2331 | 2228 | 30537 | 77.2 | TCCCGGTAAATCCACGGGTAATCG | 28 | 18 | 4 | 30 | 18 | 24 |
| 2332 | 2229 | 40498 | 80.2 | TCCCGGTATGTCCTTGGCTTTGCG | 28 | 18 | 9 | 11 | 17 | 29 |
| 2333 | 2230 | 40499 | 76.6 | TCCCGGTACTCAAATCTGCGATCG | 28 | 18 | 13 | 4 | 29 | 24 |
| 2334 | 2231 | 30539 | 78 | TCCCGGTACTGTAGGAACGGCGAA | 28 | 18 | 14 | 25 | 35 | 16 |
| 2335 | 2232 | 40500 | 76.2 | TCCCGGTAGGTACCTAGTGCGCAA | 28 | 18 | 18 | 26 | 33 | 21 |
| 2336 | 2233 | 8391 | 75.9 | TCCCGGTAAGGAGCTTCGTTGATG | 28 | 18 | 25 | 17 | 12 | 27 |
| 2337 | 2234 | 40503 | 76 | TCCCGGTACCTATTAGCAGCGTGC | 28 | 18 | 26 | 3 | 31 | 33 |
| 2338 | 2235 | 30541 | 76.5 | TCCCGGTAGATGTCGTTCTGACGG | 28 | 18 | 27 | 10 | 8 | 35 |
| 2339 | 2236 | 8393 | 78.8 | TCCCGGTATGCGGGTAAGGATCGT | 28 | 18 | 29 | 18 | 25 | 10 |
| 2340 | 2238 | 8398 | 79.7 | TCCCGGTAAGCCCCATCTGTCGAA | 28 | 18 | 36 | 15 | 14 | 16 |
| 2341 | 2239 | 15810 | 75.9 | TCCCGTCTTTGAGCTTGACCCTTG | 28 | 19 | 1 | 17 | 32 | 11 |
| 2342 | 2240 | 30542 | 81.9 | TCCCGTCTTGTCACGGTGCGGATG | 28 | 19 | 9 | 35 | 29 | 27 |
| 2343 | 2241 | 40504 | 77.6 | TCCCGTCTTCGTAGTGCTTGCACG | 28 | 19 | 10 | 22 | 11 | 30 |
| 2344 | 2242 | 40505 | 79.6 | TCCCGTCTCTCAACCTTGCGTCCC | 28 | 19 | 13 | 23 | 29 | 28 |
| 2345 | 2244 | 8406 | 79.5 | TCCCGTCTAGTGTCCCAGCCGACC | 28 | 19 | 22 | 28 | 36 | 32 |
| 2346 | 2245 | 8407 | 75.6 | TCCCGTCTACCTCCTATGCGCTGT | 28 | 19 | 23 | 26 | 29 | 14 |

FIG. 25UU

| SEQ ID NO: | 4,633 ID# | H3X ID# | Tm | ZIPCODE (5'-3') | TETRAMER NUMBERS | | | | | |
|---|---|---|---|---|---|---|---|---|---|---|
| 2347 | 2246 | 30544 | 79 | TCCCGTCTATCGCTCATGCGTCGT | 28 | 19 | 24 | 13 | 29 | 10 |
| 2348 | 2247 | 15812 | 75.6 | TCCCGTCTCCTAAGGAGACCCCAT | 28 | 19 | 26 | 25 | 32 | 15 |
| 2349 | 2248 | 8409 | 80.8 | TCCCGTCTTGCGCCATGAGTTCGT | 28 | 19 | 29 | 15 | 20 | 10 |
| 2350 | 2249 | 40506 | 79.3 | TCCCGTCTCACGACCTTGTCCACG | 28 | 19 | 30 | 23 | 9 | 30 |
| 2351 | 2250 | 40507 | 77.6 | TCCCGTCTGGACTCTGGCTTGCTT | 28 | 19 | 34 | 8 | 17 | 17 |
| 2352 | 2251 | 15814 | 78.5 | TCCCGTCTACGGCTTGAATCGTGC | 28 | 19 | 35 | 11 | 4 | 33 |
| 2353 | 2252 | 30545 | 80 | TCCCGTCTAGCCGAGTGACCCGAA | 28 | 19 | 36 | 20 | 32 | 16 |
| 2354 | 2253 | 8412 | 77.3 | TCCCGAGTTGATCCATCTTGCACG | 28 | 20 | 2 | 15 | 11 | 30 |
| 2355 | 2255 | 30546 | 77.6 | TCCCGAGTCTTGATCGGCTTGCTT | 28 | 20 | 11 | 24 | 17 | 17 |
| 2356 | 2256 | 15816 | 77.4 | TCCCGAGTCGAAGACCCTCAAGGA | 28 | 20 | 16 | 32 | 13 | 25 |
| 2357 | 2257 | 40510 | 77 | TCCCGAGTATCGTCTGATCGGCAA | 28 | 20 | 24 | 8 | 24 | 21 |
| 2358 | 2258 | 8420 | 81.4 | TCCCGAGTCAGCGACCACCTGTGC | 28 | 20 | 31 | 32 | 23 | 33 |
| 2359 | 2259 | 30548 | 77.5 | TCCCGAGTGACCACGGGCTTAATC | 28 | 20 | 32 | 35 | 17 | 4 |
| 2360 | 2260 | 40511 | 79.5 | TCCCGAGTGTGCTGTCGATGAGCC | 28 | 20 | 33 | 9 | 27 | 36 |
| 2361 | 2261 | 8424 | 77 | TCCCGAGTACGGGCAAAGGAAAAG | 28 | 20 | 35 | 21 | 25 | 6 |
| 2362 | 2262 | 40512 | 76.5 | TCCCGCAATTGACGTTAAAGGTGC | 28 | 21 | 1 | 12 | 6 | 33 |
| 2363 | 2263 | 40513 | 78.4 | TCCCGCAATTAGCCATCCTATGCG | 28 | 21 | 3 | 15 | 26 | 29 |
| 2364 | 2264 | 40514 | 79.8 | TCCCGCAAAATCGGACAATCGCTT | 28 | 21 | 4 | 34 | 4 | 17 |
| 2365 | 2265 | 8429 | 76.3 | TCCCGCAATACAATCGAGTGGACC | 28 | 21 | 7 | 24 | 22 | 32 |
| 2366 | 2266 | 8431 | 76.4 | TCCCGCAACTTGAAAGATCGCTGT | 28 | 21 | 11 | 6 | 24 | 14 |
| 2367 | 2267 | 8436 | 79 | TCCCGCAACGAAGTGCTGATTCGT | 28 | 21 | 16 | 33 | 2 | 10 |
| 2368 | 2268 | 8437 | 79.2 | TCCCGCAAGCTTTCTGGTGCTTGA | 28 | 21 | 17 | 8 | 33 | 1 |
| 2369 | 2269 | 30549 | 78.8 | TCCCGCAAGAGTCCATGCAACCAT | 28 | 21 | 20 | 15 | 21 | 15 |
| 2370 | 2270 | 40515 | 78.8 | TCCCGCAAAGTGAGTGGATGCCAT | 28 | 21 | 22 | 22 | 27 | 15 |
| 2371 | 2272 | 8442 | 80.4 | TCCCGCAACAGCGGACAGGAAAAG | 28 | 21 | 31 | 34 | 25 | 6 |
| 2372 | 2273 | 8444 | 79.5 | TCCCGCAAGGACCCTACTTGGTGC | 28 | 21 | 34 | 26 | 11 | 33 |
| 2373 | 2274 | 8445 | 82.2 | TCCCGCAAAGCCGGACATACCGAA | 28 | 21 | 36 | 34 | 5 | 16 |
| 2374 | 2275 | 8447 | 77.6 | TCCCAGTGCTCAGTGCCGAATCTG | 28 | 22 | 13 | 33 | 16 | 8 |
| 2375 | 2276 | 8448 | 76.7 | TCCCAGTGCTGTATCGCACGTTGA | 28 | 22 | 14 | 24 | 30 | 1 |
| 2376 | 2277 | 8449 | 75.7 | TCCCAGTGCCATTCCCGAGTTTAG | 28 | 22 | 15 | 28 | 20 | 3 |
| 2377 | 2278 | 40518 | 78.4 | TCCCAGTGGCAATCGTCGAAGGAC | 28 | 22 | 21 | 10 | 16 | 34 |
| 2378 | 2279 | 8454 | 75.6 | TCCCAGTGCCTAGGACGTCTGCTT | 28 | 22 | 26 | 34 | 19 | 17 |
| 2379 | 2280 | 40519 | 79.5 | TCCCAGTGTCCCCCTAGTGCCAGC | 28 | 22 | 28 | 26 | 33 | 31 |
| 2380 | 2281 | 8457 | 78.8 | TCCCAGTGCAGCGTCTCGTTAGCC | 28 | 22 | 31 | 19 | 12 | 36 |
| 2381 | 2282 | 15826 | 79.7 | TCCCAGTGGGACAGTGGCTTGCAA | 28 | 22 | 34 | 22 | 17 | 21 |
| 2382 | 2283 | 8459 | 78.6 | TCCCAGTGAGCCCGTTTCGTTCTG | 28 | 22 | 36 | 12 | 10 | 8 |
| 2383 | 2284 | 21397 | 77.7 | TCCCACCTTCTGAATCTCCCTGCG | 28 | 23 | 8 | 4 | 28 | 29 |
| 2384 | 2285 | 8463 | 77.2 | TCCCACCTTGTCATCGGTGCAAAG | 28 | 23 | 9 | 24 | 33 | 6 |
| 2385 | 2287 | 8470 | 78.1 | TCCCACCTGCAACACGTGTCCTTG | 28 | 23 | 21 | 30 | 9 | 11 |
| 2386 | 2288 | 8471 | 76.8 | TCCCACCTAGGACAGCTCTGCACG | 28 | 23 | 25 | 31 | 8 | 30 |
| 2387 | 2289 | 15831 | 80.1 | TCCCACCTGATGCTTGTCGTTGCG | 28 | 23 | 27 | 11 | 10 | 29 |
| 2388 | 2290 | 8474 | 80.2 | TCCCACCTTCCCCACGCTCATGTC | 28 | 23 | 28 | 30 | 13 | 9 |
| 2389 | 2291 | 21400 | 77.7 | TCCCACCTCAGCCTTGGAGTACGG | 28 | 23 | 31 | 11 | 20 | 35 |
| 2390 | 2292 | 8476 | 76.9 | TCCCACCTACGGTCGTCGAACTCA | 28 | 23 | 35 | 10 | 16 | 13 |
| 2391 | 2294 | 40523 | 78.9 | TCCCATCGCGTTGCTTAAAGGCAA | 28 | 24 | 12 | 17 | 6 | 21 |
| 2392 | 2295 | 8483 | 79.6 | TCCCATCGCCATCAGCCTCATTGA | 28 | 24 | 15 | 31 | 13 | 1 |
| 2393 | 2296 | 30553 | 76.5 | TCCCATCGGATGTTAGACCTTGCG | 28 | 24 | 27 | 3 | 23 | 29 |
| 2394 | 2297 | 8489 | 79.2 | TCCCATCGTGCGAGGAGGTACACG | 28 | 24 | 29 | 25 | 18 | 30 |
| 2395 | 2298 | 8490 | 79 | TCCCATCGCACGTCGTTCCCATAC | 28 | 24 | 30 | 10 | 28 | 5 |
| 2396 | 2299 | 8491 | 80.8 | TCCCATCGCAGCCAGCAATCCTGT | 28 | 24 | 31 | 31 | 4 | 14 |
| 2397 | 2300 | 15834 | 79.2 | TCCCATCGGACCTTGACAGCATCG | 28 | 24 | 32 | 1 | 31 | 24 |

FIG. 25VV

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 2398 | 2301 | 8493 | 80 | TCCCATCGGGACCTCAATCGGATG | 28 | 24 | 34 | 13 | 24 | 27 |
| 2399 | 2302 | 30554 | 79.7 | TCCCATCGAGCCATCGCCATACCT | 28 | 24 | 36 | 24 | 15 | 23 |
| 2400 | 2303 | 40528 | 80.9 | TCCCAGGACTTGGTGCGTGCTCGT | 28 | 25 | 11 | 33 | 33 | 10 |
| 2401 | 2305 | 15836 | 75.1 | TCCCAGGAGCTTACGGAGCCATAC | 28 | 25 | 17 | 35 | 36 | 5 |
| 2402 | 2306 | 40529 | 76.6 | TCCCAGGAGGTATTAGTGCGTGCG | 28 | 25 | 18 | 3 | 29 | 29 |
| 2403 | 2307 | 8506 | 78.9 | TCCCAGGAGAGTGGACTCCCAGCC | 28 | 25 | 20 | 34 | 28 | 36 |
| 2404 | 2308 | 15837 | 75.5 | TCCCAGGAACCTCGAAGCAACCTA | 28 | 25 | 23 | 16 | 21 | 26 |
| 2405 | 2309 | 40531 | 82.2 | TCCCAGGAGATGTGCGTGCGCTTG | 28 | 25 | 27 | 29 | 29 | 11 |
| 2406 | 2310 | 8510 | 76.8 | TCCCAGGATCCCCTAAGGAGCTT | 28 | 25 | 28 | 26 | 25 | 17 |
| 2407 | 2311 | 8511 | 76.6 | TCCCAGGATGCGAATCGCAATTAG | 28 | 25 | 29 | 4 | 21 | 3 |
| 2408 | 2312 | 30559 | 76.4 | TCCCCCTATGATCGAAAGCCCCTA | 28 | 26 | 2 | 16 | 36 | 26 |
| 2409 | 2313 | 30560 | 76.7 | TCCCCCTACGTTCCTAATCGGTGC | 28 | 26 | 12 | 26 | 24 | 33 |
| 2410 | 2314 | 40535 | 77.9 | TCCCCCTACTCAGTGCACGGGTA | 28 | 26 | 13 | 33 | 35 | 18 |
| 2411 | 2315 | 30561 | 77.6 | TCCCCCTAGCTTCACGGGTACACG | 28 | 26 | 17 | 30 | 18 | 30 |
| 2412 | 2316 | 30562 | 77 | TCCCCCTAGGTAGAGTTGCGGTGC | 28 | 26 | 18 | 20 | 29 | 33 |
| 2413 | 2317 | 8528 | 81 | TCCCCCTATGCGGATGTGCGAGTG | 28 | 26 | 29 | 27 | 29 | 22 |
| 2414 | 2318 | 8531 | 75.6 | TCCCCCTAGACCATACACGGCTTG | 28 | 26 | 32 | 5 | 35 | 11 |
| 2415 | 2319 | 40538 | 77.5 | TCCCCCTAGGACAATCCTCATGCG | 28 | 26 | 34 | 4 | 13 | 29 |
| 2416 | 2320 | 8532 | 79.7 | TCCCCCTAACGGCTGTGGACGGTA | 28 | 26 | 35 | 14 | 34 | 18 |
| 2417 | 2321 | 30563 | 76.1 | TCCCGATGTTGATCCCCTAACCT | 28 | 27 | 1 | 28 | 26 | 23 |
| 2418 | 2322 | 21415 | 76.9 | TCCCGATGTTAGCTGTAGCCTGCG | 28 | 27 | 3 | 14 | 36 | 29 |
| 2419 | 2323 | 15848 | 80 | TCCCGATGTGTCACGGTGTCAGCC | 28 | 27 | 9 | 35 | 9 | 36 |
| 2420 | 2324 | 8539 | 75.3 | TCCCGATGCTGTAAAGGGACCTGT | 28 | 27 | 14 | 6 | 34 | 14 |
| 2421 | 2325 | 8541 | 77.7 | TCCCGATGGGTAAGTGTCCCCTCA | 28 | 27 | 18 | 22 | 28 | 13 |
| 2422 | 2326 | 15849 | 78.3 | TCCCGATGGAGTTGTCCTTGACGG | 28 | 27 | 20 | 9 | 11 | 35 |
| 2423 | 2327 | 30564 | 79 | TCCCGATGGCAAGCAAAAAGCTCA | 28 | 27 | 21 | 21 | 6 | 13 |
| 2424 | 2328 | 8545 | 81 | TCCCGATGATCGGGACAGTGGTGC | 28 | 27 | 24 | 34 | 22 | 33 |
| 2425 | 2329 | 8548 | 78.2 | TCCCGATGTGCGATACCCATAGCC | 28 | 27 | 29 | 5 | 15 | 36 |
| 2426 | 2330 | 8549 | 81.4 | TCCCGATGCACGGGACCTTGTTGA | 28 | 27 | 30 | 34 | 11 | 1 |
| 2427 | 2331 | 15852 | 80.5 | TCCCGATGGACCGCAACGTTCCTA | 28 | 27 | 32 | 21 | 12 | 26 |
| 2428 | 2332 | 8552 | 79.8 | TCCCGATGGGACCCTACAGCCTCA | 28 | 27 | 34 | 26 | 31 | 13 |
| 2429 | 2333 | 8553 | 81.2 | TCCCGATGACGGCTCACTTGGTGC | 28 | 27 | 35 | 13 | 11 | 33 |
| 2430 | 2334 | 15853 | 77.5 | TCCCGATGAGCCTGCGTTAGACCT | 28 | 27 | 36 | 29 | 3 | 23 |
| 2431 | 2335 | 40540 | 77.8 | TCCCTCCCTGATACCTCAGCGTGC | 28 | 28 | 2 | 23 | 31 | 33 |
| 2432 | 2336 | 30565 | 80.3 | TCCCTCCCTACAGTGCGCAAACGG | 28 | 28 | 7 | 33 | 21 | 35 |
| 2433 | 2337 | 8558 | 76.8 | TCCCTCCCTGTCCCTACGAAATCG | 28 | 28 | 9 | 26 | 16 | 24 |
| 2434 | 2338 | 40541 | 77.2 | TCCCTCCCCTTGTTAGGGACCCAT | 28 | 28 | 11 | 3 | 34 | 15 |
| 2435 | 2339 | 8560 | 77.1 | TCCCTCCCCTCACGTTCCATGAGT | 28 | 28 | 13 | 12 | 15 | 20 |
| 2436 | 2340 | 8561 | 79 | TCCCTCCCCTGTGTGCGAGTCTCA | 28 | 28 | 14 | 33 | 20 | 13 |
| 2437 | 2341 | 30566 | 79.5 | TCCCTCCCCGAATTAGCTGTTGCG | 28 | 28 | 16 | 3 | 14 | 29 |
| 2438 | 2342 | 8566 | 78.2 | TCCCTCCCATCGCCTAATCGGAGT | 28 | 28 | 24 | 26 | 24 | 20 |
| 2439 | 2343 | 30567 | 78.2 | TCCCTCCCAGGATTGAACGGGTCT | 28 | 28 | 25 | 1 | 35 | 19 |
| 2440 | 2344 | 8568 | 76.6 | TCCCTCCCGATGAAAGACCTGCTT | 28 | 28 | 27 | 6 | 23 | 17 |
| 2441 | 2345 | 21423 | 79.5 | TCCCTCCCACGGAATCAGGACAGC | 28 | 28 | 35 | 4 | 25 | 31 |
| 2442 | 2346 | 40543 | 76.2 | TCCCTGCGTGATAGTGGCAAACCT | 28 | 29 | 2 | 22 | 21 | 23 |
| 2443 | 2347 | 30568 | 80.5 | TCCCTGCGATACGTGCAATCGCAA | 28 | 29 | 5 | 33 | 4 | 21 |
| 2444 | 2348 | 30569 | 78.2 | TCCCTGCGAAAGAGTGCGAACCAT | 28 | 29 | 6 | 22 | 16 | 15 |
| 2445 | 2349 | 40544 | 78 | TCCCTGCGTACACCATATCGTGCG | 28 | 29 | 7 | 15 | 24 | 29 |
| 2446 | 2350 | 40545 | 80.3 | TCCCTGCGTGTCAGTGCTTGGTGC | 28 | 29 | 9 | 22 | 11 | 33 |
| 2447 | 2351 | 8575 | 77.4 | TCCCTGCGCTTGAGGAATACCGTT | 28 | 29 | 11 | 25 | 5 | 12 |
| 2448 | 2352 | 8578 | 82.9 | TCCCTGCGCGAACACGTGATCACG | 28 | 29 | 16 | 30 | 2 | 30 |

FIG. 25WW

| SEQ ID NO: | 4,633 ID# | HEX ID# Tm | ZIPCODE (5'-3') | TETRAMER NUMBERS | | | | | |
|---|---|---|---|---|---|---|---|---|---|
| 2449 | 2353 | 8579 79.8 | TCCCTGCGGCTTTTGAAGTGAGCC | 28 | 29 | 17 | 1 | 22 | 36 |
| 2450 | 2354 | 8581 82.1 | TCCCTGCGGCAACGTTGTCTCACG | 28 | 29 | 21 | 12 | 19 | 30 |
| 2451 | 2355 | 8582 79.3 | TCCCTGCGACCTGCAAATCGTGTC | 28 | 29 | 23 | 21 | 24 | 9 |
| 2452 | 2356 | 40547 80.7 | TCCCTGCGAGGAGAGTGTGCGGAC | 28 | 29 | 25 | 20 | 33 | 34 |
| 2453 | 2357 | 15859 83.6 | TCCCTGCGTCCCGAGTGCAAGCAA | 28 | 29 | 28 | 20 | 21 | 21 |
| 2454 | 2358 | 8585 82.8 | TCCCTGCGCACGGGTACGTTGACC | 28 | 29 | 30 | 18 | 12 | 32 |
| 2455 | 2359 | 8586 81.6 | TCCCTGCGCAGCCTGTAGGAAGCC | 28 | 29 | 31 | 14 | 25 | 36 |
| 2456 | 2360 | 8587 82.8 | TCCCTGCGGACCCTGTCAGCCTCA | 28 | 29 | 32 | 14 | 31 | 13 |
| 2457 | 2361 | 8588 82.9 | TCCCTGCGGTGCGCTTGCAAGAGT | 28 | 29 | 33 | 17 | 21 | 20 |
| 2458 | 2362 | 30570 78.3 | TCCCCACGTTGACAGCTCCCAATC | 28 | 30 | 1 | 31 | 28 | 4 |
| 2459 | 2363 | 30571 77.1 | TCCCCACGTTAGTCGTCTTGCGAA | 28 | 30 | 3 | 10 | 11 | 16 |
| 2460 | 2366 | 8593 81 | TCCCCACGTCTGGGACACGGTGTC | 28 | 30 | 8 | 34 | 35 | 9 |
| 2461 | 2367 | 8594 79 | TCCCCACGTCGTGTGCATACTCCC | 28 | 30 | 10 | 33 | 5 | 28 |
| 2462 | 2368 | 8596 79.5 | TCCCCACGCTGTTCTGAGCCAGTG | 28 | 30 | 14 | 8 | 36 | 22 |
| 2463 | 2370 | 21430 80.3 | TCCCCACGGGTATCCCCTGTCCAT | 28 | 30 | 18 | 28 | 14 | 15 |
| 2464 | 2371 | 8598 79.4 | TCCCCACGGTCTCAGCATCGAGTG | 28 | 30 | 19 | 31 | 24 | 22 |
| 2465 | 2372 | 8599 81.1 | TCCCCACGGCAAAATCGTGCTCTG | 28 | 30 | 21 | 4 | 33 | 8 |
| 2466 | 2373 | 8600 76.9 | TCCCCACGACCTAATCGATGCTCA | 28 | 30 | 23 | 4 | 27 | 13 |
| 2467 | 2374 | 8601 80.4 | TCCCCACGATCGCGAATGATCCAT | 28 | 30 | 24 | 16 | 2 | 15 |
| 2468 | 2375 | 8602 78.4 | TCCCCACGCCTAGTGCAGCCATAC | 28 | 30 | 26 | 33 | 36 | 5 |
| 2469 | 2376 | 8604 81.4 | TCCCCACGTGCGTGATTCGTCGTT | 28 | 30 | 29 | 2 | 10 | 12 |
| 2470 | 2377 | 8605 81.8 | TCCCCACGCAGCCGTTCTTGACCT | 28 | 30 | 31 | 12 | 11 | 23 |
| 2471 | 2378 | 8606 80.3 | TCCCCACGGACCAGCCTACACAGC | 28 | 30 | 32 | 36 | 7 | 31 |
| 2472 | 2379 | 8607 81.6 | TCCCCACGGTGCTGTCTGCGTGAT | 28 | 30 | 33 | 9 | 29 | 2 |
| 2473 | 2380 | 8608 81.4 | TCCCCACGGGACCCATCGTTGAGT | 28 | 30 | 34 | 15 | 12 | 20 |
| 2474 | 2381 | 30572 77.3 | TCCCCAGCTTGAAAAGGACCCTCA | 28 | 31 | 1 | 6 | 32 | 13 |
| 2475 | 2382 | 8611 79.3 | TCCCCAGCAATCGGACGGTAGACC | 28 | 31 | 4 | 34 | 18 | 32 |
| 2476 | 2383 | 30573 76.3 | TCCCCAGCTACAGCAAAAAGCAGC | 28 | 31 | 7 | 21 | 6 | 31 |
| 2477 | 2384 | 8615 77.8 | TCCCCAGCTCTGATCGGTCTGGAC | 28 | 31 | 8 | 24 | 19 | 34 |
| 2478 | 2385 | 8616 78.2 | TCCCCAGCTCGTCTGTGATGGCTT | 28 | 31 | 10 | 14 | 27 | 17 |
| 2479 | 2386 | 8617 79.5 | TCCCCAGCCTTGCTGTATCGGGAC | 28 | 31 | 11 | 14 | 24 | 34 |
| 2480 | 2387 | 8619 80.5 | TCCCCAGCCGAAGTGCCTCACTTG | 28 | 31 | 16 | 33 | 13 | 11 |
| 2481 | 2388 | 8621 77.8 | TCCCCAGCGGTAAGGACAGCAAAG | 28 | 31 | 18 | 25 | 31 | 6 |
| 2482 | 2389 | 15863 77.1 | TCCCCAGCACCTAATCACGGGAGT | 28 | 31 | 23 | 4 | 35 | 20 |
| 2483 | 2390 | 8623 81.1 | TCCCCAGCATCGGATGCTTGATCG | 28 | 31 | 24 | 27 | 11 | 24 |
| 2484 | 2391 | 30574 78.4 | TCCCCAGCAGGAGAGTAGCCCCAT | 28 | 31 | 25 | 20 | 36 | 15 |
| 2485 | 2392 | 8627 81.4 | TCCCCAGCCAGCTCTGTGTCACGG | 28 | 31 | 31 | 8 | 9 | 35 |
| 2486 | 2393 | 21442 80.3 | TCCCCAGCGGACCGAATGTCTGTC | 28 | 31 | 34 | 16 | 9 | 9 |
| 2487 | 2394 | 8629 81 | TCCCCAGCAGCCGGTAGCTTCCAT | 28 | 31 | 36 | 18 | 17 | 15 |
| 2488 | 2395 | 8631 77.3 | TCCCGACCTGATTGATTGTCTGCG | 28 | 32 | 2 | 2 | 9 | 29 |
| 2489 | 2396 | 15865 75.4 | TCCCGACCTTAGAATCGTGCCCTA | 28 | 32 | 3 | 4 | 33 | 26 |
| 2490 | 2397 | 40549 78.4 | TCCCGACCAATCTTGAGACCGTGC | 28 | 32 | 4 | 1 | 32 | 33 |
| 2491 | 2398 | 8634 75.2 | TCCCGACCTACATTGAACGGACCT | 28 | 32 | 7 | 1 | 35 | 23 |
| 2492 | 2399 | 8635 75.1 | TCCCGACCTGTCTCCCGAGTAAAG | 28 | 32 | 9 | 28 | 20 | 6 |
| 2493 | 2400 | 40550 79 | TCCCGACCGTTTTAGCGTTTCGT | 28 | 32 | 12 | 3 | 12 | 10 |
| 2494 | 2401 | 21445 78.5 | TCCCGACCCTCAGGTAGCAACACG | 28 | 32 | 13 | 18 | 21 | 30 |
| 2495 | 2402 | 15866 76.9 | TCCCGACCCTGTAGGACTTGAGCC | 28 | 32 | 14 | 25 | 11 | 36 |
| 2496 | 2404 | 40551 77.5 | TCCCGACCGTCTAAAGGACCGATG | 28 | 32 | 19 | 6 | 32 | 27 |
| 2497 | 2405 | 8641 79.5 | TCCCGACCGAGTGTCTTGCGTCTG | 28 | 32 | 20 | 19 | 29 | 8 |
| 2498 | 2406 | 8642 79.9 | TCCCGACCGCAAAGGAGATGCCTA | 28 | 32 | 21 | 25 | 27 | 26 |
| 2499 | 2407 | 8646 76.7 | TCCCGACCCCTAATACGATGAGCC | 28 | 32 | 26 | 5 | 27 | 36 |

FIG. 25XX

| SEQ ID NO: | 4,633 ID# | HEX ID# | Tm | ZIPCODE (5'-3') | TETRAMER NUMBERS | | | | |
|---|---|---|---|---|---|---|---|---|---|
| 2500 | 2408 | 15867 | 83.3 | TCCCGACCCACGGTGCAGCCTACA | 28 | 32 | 30 | 33 | 36 | 7 |
| 2501 | 2409 | 8648 | 77.7 | TCCCGTGCTTGATCTGAGTGCAGC | 28 | 33 | 1 | 8 | 22 | 31 |
| 2502 | 2410 | 40555 | 75.5 | TCCCGTGCTTAGTGATAGCCCGTT | 28 | 33 | 3 | 2 | 36 | 12 |
| 2503 | 2411 | 30576 | 80.5 | TCCCGTGCTGTCCCATCGTTCCAT | 28 | 33 | 9 | 15 | 12 | 15 |
| 2504 | 2412 | 8651 | 80.1 | TCCCGTGCCTCAAATCGTGCAGTG | 28 | 33 | 13 | 4 | 33 | 22 |
| 2505 | 2413 | 8652 | 79.9 | TCCCGTGCCGAACGAACTCAACCT | 28 | 33 | 16 | 16 | 13 | 23 |
| 2506 | 2414 | 40558 | 80.3 | TCCCGTGCGTCTCTGTACGGTCCC | 28 | 33 | 19 | 14 | 35 | 28 |
| 2507 | 2415 | 8655 | 80.5 | TCCCGTGCACCTGTCTGATGGCAA | 28 | 33 | 23 | 19 | 27 | 21 |
| 2508 | 2416 | 8659 | 83.3 | TCCCGTGCTCCCGCTTGTGCTCTG | 28 | 33 | 28 | 17 | 33 | 8 |
| 2509 | 2417 | 8661 | 80.3 | TCCCGTGCGACCTTGAAGTGGGAC | 28 | 33 | 32 | 1 | 22 | 34 |
| 2510 | 2418 | 15868 | 80.9 | TCCCGTGCGTGCTTAGGTGCGAGT | 28 | 33 | 33 | 3 | 33 | 20 |
| 2511 | 2419 | 8663 | 79.6 | TCCCGTGCACGGAAAGCCTAGGAC | 28 | 33 | 35 | 6 | 26 | 34 |
| 2512 | 2420 | 8664 | 80.3 | TCCCGTGCAGCCAGGATTAGACGG | 28 | 33 | 36 | 25 | 3 | 35 |
| 2513 | 2423 | 8667 | 77.5 | TCCCGGACAATCATCGAGGAGACC | 28 | 34 | 4 | 24 | 25 | 32 |
| 2514 | 2424 | 30577 | 79.2 | TCCCGGACATACTGTCGGACTGCG | 28 | 34 | 5 | 9 | 34 | 29 |
| 2515 | 2425 | 21453 | 76.8 | TCCCGGACAAAGTCCCTTAGACGG | 28 | 34 | 6 | 28 | 3 | 35 |
| 2516 | 2426 | 8669 | 75.3 | TCCCGGACTACACTTGACGGGTCT | 28 | 34 | 7 | 11 | 35 | 19 |
| 2517 | 2427 | 40559 | 79.3 | TCCCGGACTCGTCGAAGACCTCGT | 28 | 34 | 10 | 16 | 32 | 10 |
| 2518 | 2428 | 8672 | 80.2 | TCCCGGACCTTGCCATCTCAATCG | 28 | 34 | 11 | 15 | 13 | 24 |
| 2519 | 2429 | 8673 | 81.2 | TCCCGGACCGTTCACGCTCAGATG | 28 | 34 | 12 | 30 | 13 | 27 |
| 2520 | 2430 | 40561 | 77.1 | TCCCGGACGTCTATACTCCCCGAA | 28 | 34 | 19 | 5 | 28 | 16 |
| 2521 | 2431 | 8678 | 81.2 | TCCCGGACATCGGAGTCTCATGCG | 28 | 34 | 24 | 20 | 13 | 29 |
| 2522 | 2432 | 30578 | 80.9 | TCCCGGACGATGCCATATCGCTTG | 28 | 34 | 27 | 15 | 24 | 11 |
| 2523 | 2433 | 8682 | 79.8 | TCCCGGACTGCGAATCCCTACGAA | 28 | 34 | 29 | 4 | 26 | 16 |
| 2524 | 2434 | 8683 | 80.2 | TCCCGGACCACGTTGACGAAGACC | 28 | 34 | 30 | 1 | 16 | 32 |
| 2525 | 2435 | 8684 | 81.4 | TCCCGGACGACCGGACAAAGGGTA | 28 | 34 | 32 | 34 | 6 | 18 |
| 2526 | 2436 | 8685 | 81.2 | TCCCGGACGTGCAAAGTCTGACGG | 28 | 34 | 33 | 6 | 8 | 35 |
| 2527 | 2437 | 8686 | 82 | TCCCGGACGGACGCAAAGGATGTC | 28 | 34 | 34 | 21 | 25 | 9 |
| 2528 | 2438 | 8687 | 80.4 | TCCCGGACAGCCACCTAGCCAGTG | 28 | 34 | 36 | 23 | 36 | 22 |
| 2529 | 2439 | 15871 | 77.3 | TCCCACGGTTGACTGTAGGATGCG | 28 | 35 | 1 | 14 | 25 | 29 |
| 2530 | 2441 | 8696 | 80 | TCCCACGGGCTTTCTGCGTTGAGT | 28 | 35 | 17 | 8 | 12 | 20 |
| 2531 | 2442 | 8697 | 78.5 | TCCCACGGGTCTGGTAGCTTGTGC | 28 | 35 | 19 | 18 | 17 | 33 |
| 2532 | 2443 | 40565 | 78.3 | TCCCACGGCCTATCCCATACTCCC | 28 | 35 | 26 | 28 | 5 | 28 |
| 2533 | 2445 | 8704 | 81.3 | TCCCACGGTGCGCCTAATACGCAA | 28 | 35 | 29 | 26 | 5 | 21 |
| 2534 | 2446 | 21461 | 80.8 | TCCCACGGGACCATACCTGTTGCG | 28 | 35 | 32 | 5 | 14 | 29 |
| 2535 | 2447 | 8708 | 80.9 | TCCCACGGGTGCATCGTTAGACGG | 28 | 35 | 33 | 24 | 3 | 35 |
| 2536 | 2448 | 40566 | 77.4 | TCCCAGCCTTGATCTGATCGGCTT | 28 | 36 | 1 | 8 | 24 | 17 |
| 2537 | 2449 | 30579 | 80.7 | TCCCAGCCTGATGATGTGCGCTCA | 28 | 36 | 2 | 27 | 29 | 13 |
| 2538 | 2450 | 8709 | 75.1 | TCCCAGCCTTAGAGTGCTTGGCTT | 28 | 36 | 3 | 22 | 11 | 17 |
| 2539 | 2451 | 40567 | 79 | TCCCAGCCATACAATCACGGGTGC | 28 | 36 | 5 | 4 | 35 | 33 |
| 2540 | 2453 | 30580 | 78.7 | TCCCAGCCTCTGTTGAGTGCGACC | 28 | 36 | 8 | 1 | 33 | 32 |
| 2541 | 2454 | 8711 | 78.6 | TCCCAGCCTCGTGTCTACGGATCG | 28 | 36 | 10 | 19 | 35 | 24 |
| 2542 | 2455 | 15874 | 77.1 | TCCCAGCCCTCATTAGTCCCGGTA | 28 | 36 | 13 | 3 | 28 | 18 |
| 2543 | 2456 | 8716 | 78.5 | TCCCAGCCGCTTCCTAACCTTCGT | 28 | 36 | 17 | 26 | 23 | 10 |
| 2544 | 2457 | 30581 | 77.9 | TCCCAGCCGGTATTAGGACCCCAT | 28 | 36 | 18 | 3 | 32 | 15 |
| 2545 | 2458 | 30583 | 76.8 | TCCCAGCCAGTGTTAGCCTATGCG | 28 | 36 | 22 | 3 | 26 | 29 |
| 2546 | 2459 | 8718 | 75.4 | TCCCAGCCACCTATACTGCGGAGT | 28 | 36 | 23 | 5 | 29 | 20 |
| 2547 | 2460 | 8719 | 80.3 | TCCCAGCCATCGGTGCTGATAGCC | 28 | 36 | 24 | 33 | 2 | 36 |
| 2548 | 2462 | 8721 | 79.9 | TCCCAGCCTCCCACCTTGATCGAA | 28 | 36 | 28 | 23 | 2 | 16 |
| 2549 | 2463 | 8722 | 81.3 | TCCCAGCCCACGGGTAAGCCTCTG | 28 | 36 | 30 | 18 | 36 | 8 |
| 2550 | 2464 | 8723 | 82.1 | TCCCAGCCCAGCCTTGGATGATCG | 28 | 36 | 31 | 11 | 27 | 24 |

FIG. 25YY

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 2551 | 2465 | 8724 | 81 | TCCCAGCCGTGCAAAGAGGAGCAA | 28 | 36 | 33 | 6 | 25 | 21 |
| 2552 | 2466 | 21468 | 75.2 | TGCGTTGATTGAGAGTACGGCGTT | 29 | 1 | 1 | 20 | 35 | 12 |
| 2553 | 2467 | 40569 | 79.8 | TGCGTTGAAAAGATCGTGCGCGTT | 29 | 1 | 6 | 24 | 29 | 12 |
| 2554 | 2469 | 8729 | 76.4 | TGCGTTGACGTTCTGTCCTATGCG | 29 | 1 | 12 | 14 | 26 | 29 |
| 2555 | 2470 | 40571 | 78.6 | TGCGTTGACCATTCGTATCGCGAA | 29 | 1 | 15 | 10 | 24 | 16 |
| 2556 | 2472 | 15879 | 79.5 | TGCGTTGACACGCGTTTTGACGAA | 29 | 1 | 30 | 12 | 1 | 16 |
| 2557 | 2473 | 15881 | 80.5 | TGCGTTGAGGACGATGTCCCCCAT | 29 | 1 | 34 | 27 | 28 | 15 |
| 2558 | 2474 | 8740 | 78.5 | TGCGTTGAAGCCAGTGCGAAGATG | 29 | 1 | 36 | 22 | 16 | 27 |
| 2559 | 2475 | 15882 | 80.1 | TGCGTGATTGTCCAGCCTTGGTGC | 29 | 2 | 9 | 31 | 11 | 33 |
| 2560 | 2476 | 15883 | 79.8 | TGCGTGATCTTGGGACTCCCCGTT | 29 | 2 | 11 | 34 | 28 | 12 |
| 2561 | 2478 | 30585 | 80.1 | TGCGTGATGCTTTCCCACCTGTGC | 29 | 2 | 17 | 28 | 23 | 33 |
| 2562 | 2480 | 8750 | 81.3 | TGCGTGATGAGTCAGCCAGCCACG | 29 | 2 | 20 | 31 | 31 | 30 |
| 2563 | 2481 | 40575 | 79.9 | TGCGTGATGCAACTGTCCATTGCG | 29 | 2 | 21 | 14 | 15 | 29 |
| 2564 | 2483 | 30586 | 79.5 | TGCGTGATTCCCACCTCTTGCAGC | 29 | 2 | 28 | 23 | 11 | 31 |
| 2565 | 2484 | 40576 | 80.6 | TGCGTGATGGACCCATATCGCACG | 29 | 2 | 34 | 15 | 24 | 30 |
| 2566 | 2485 | 40577 | 80.6 | TGCGTGATAGCCCAGCAATCGCAA | 29 | 2 | 36 | 31 | 4 | 21 |
| 2567 | 2486 | 21481 | 75 | TGCGTTAGTTGAGACCGCTTACGG | 29 | 3 | 1 | 32 | 17 | 35 |
| 2568 | 2487 | 8756 | 78.1 | TGCGTTAGAAAGGACCCACGCGTT | 29 | 3 | 6 | 32 | 30 | 12 |
| 2569 | 2488 | 8758 | 76.1 | TGCGTTAGCGAATGTCGGACTTGA | 29 | 3 | 16 | 9 | 34 | 1 |
| 2570 | 2489 | 40578 | 77.7 | TGCGTTAGGCTTTCCCAGTGGACC | 29 | 3 | 17 | 28 | 22 | 32 |
| 2571 | 2490 | 30588 | 78.5 | TGCGTTAGTGCGCGAAATACTGCG | 29 | 3 | 29 | 16 | 5 | 29 |
| 2572 | 2491 | 8765 | 75.9 | TGCGTTAGGTGCTTGAGCAACAGC | 29 | 3 | 33 | 1 | 21 | 31 |
| 2573 | 2492 | 30589 | 80 | TGCGTTAGACGGGATGTGCGGATG | 29 | 3 | 35 | 27 | 29 | 27 |
| 2574 | 2493 | 8768 | 78.9 | TGCGTTAGAGCCGCTTGATGAGCC | 29 | 3 | 36 | 17 | 27 | 36 |
| 2575 | 2494 | 30590 | 79.2 | TGCGAATCAAAGATCGTCCCCACG | 29 | 4 | 6 | 24 | 28 | 30 |
| 2576 | 2495 | 30591 | 79 | TGCGAATCTCGTTCGTCACGCTCA | 29 | 4 | 10 | 10 | 30 | 13 |
| 2577 | 2496 | 40581 | 78.7 | TGCGAATCCTCAGACCCGAACAGC | 29 | 4 | 13 | 32 | 16 | 31 |
| 2578 | 2498 | 30592 | 78.4 | TGCGAATCCCATTCCCGTCTCTTG | 29 | 4 | 15 | 28 | 19 | 11 |
| 2579 | 2499 | 40582 | 77.3 | TGCGAATCGAGTAGCCGTGCTGAT | 29 | 4 | 20 | 36 | 33 | 2 |
| 2580 | 2500 | 8780 | 78.7 | TGCGAATCAGTGCAGCTGCGAAAG | 29 | 4 | 22 | 31 | 29 | 6 |
| 2581 | 2501 | 8782 | 79.9 | TGCGAATCCACGCGAACTCAAGGA | 29 | 4 | 30 | 16 | 13 | 25 |
| 2582 | 2502 | 40583 | 75.9 | TGCGATACGGTATGATAGCCGCAA | 29 | 5 | 18 | 2 | 36 | 21 |
| 2583 | 2504 | 30593 | 78.1 | TGCGATACGCAACTGTGCAATCCC | 29 | 5 | 21 | 14 | 21 | 28 |
| 2584 | 2505 | 40584 | 78 | TGCGATACCCTAGCTTGTGCGCAA | 29 | 5 | 26 | 17 | 33 | 21 |
| 2585 | 2506 | 8794 | 76.6 | TGCGATACGATGGCTTTCCCAAAG | 29 | 5 | 27 | 17 | 28 | 6 |
| 2586 | 2508 | 30594 | 76.5 | TGCGAAAGAAAGTCCCGCTTTTGA | 29 | 6 | 6 | 28 | 17 | 1 |
| 2587 | 2509 | 40586 | 78.2 | TGCGAAAGTCGTCTTGTGCGAGGA | 29 | 6 | 10 | 11 | 29 | 25 |
| 2588 | 2510 | 15896 | 79 | TGCGAAAGCGTTGGACATCGGTCT | 29 | 6 | 12 | 34 | 24 | 19 |
| 2589 | 2511 | 40587 | 77.2 | TGCGAAAGGGTATCGTCACGGATG | 29 | 6 | 18 | 10 | 30 | 27 |
| 2590 | 2512 | 30595 | 77.8 | TGCGAAAGGAGTGATGCACGGGTA | 29 | 6 | 20 | 27 | 30 | 18 |
| 2591 | 2513 | 40588 | 75 | TGCGAAAGACCTTTAGACGGGCTT | 29 | 6 | 23 | 3 | 35 | 17 |
| 2592 | 2514 | 8806 | 78.3 | TGCGAAAGTCCCCGTTGAGTGCTT | 29 | 6 | 28 | 12 | 20 | 17 |
| 2593 | 2516 | 8809 | 77.4 | TGCGTACAAAAGTGCGCTTGGCTT | 29 | 7 | 6 | 29 | 11 | 17 |
| 2594 | 2518 | 8811 | 76 | TGCGTACAACCTACGGTCCCCTGT | 29 | 7 | 23 | 35 | 28 | 14 |
| 2595 | 2519 | 8816 | 79.5 | TGCGTACAGACCACGGACGGGTA | 29 | 7 | 32 | 35 | 35 | 18 |
| 2596 | 2521 | 8819 | 78.3 | TGCGTCTGTTGATCCCGAGTCACG | 29 | 8 | 1 | 28 | 20 | 30 |
| 2597 | 2522 | 8820 | 80.7 | TGCGTCTGTGATGTGCACGGGCTT | 29 | 8 | 2 | 33 | 35 | 17 |
| 2598 | 2523 | 8824 | 78.9 | TGCGTCTGTGTCTGCGATCGTCGT | 29 | 8 | 9 | 29 | 24 | 10 |
| 2599 | 2524 | 40589 | 78.8 | TGCGTCTGTCGTCCTACACGGCAA | 29 | 8 | 10 | 26 | 30 | 21 |
| 2600 | 2525 | 40590 | 78.5 | TGCGTCTGCTTGAAAGGTGCATCG | 29 | 8 | 11 | 6 | 33 | 24 |
| 2601 | 2526 | 30597 | 80.1 | TGCGTCTGCTCAAGGATGCGAGGA | 29 | 8 | 13 | 25 | 29 | 25 |

FIG. 25ZZ

| SEQ ID NO: | 4,633 ID# | HEX ID# | Tm | ZIPCODE (5'-3') | TETRAMER NUMBERS | | | | |
|---|---|---|---|---|---|---|---|---|---|
| 2602 | 2527 | 8828 | 77.3 | TGCGTCTGGCTTCACGATACGCTT | 29 | 8 | 17 | 30 | 5 | 17 |
| 2603 | 2528 | 40591 | 78.4 | TGCGTCTGGTCTAGTGACGGTGCG | 29 | 8 | 19 | 22 | 35 | 29 |
| 2604 | 2529 | 8831 | 79.1 | TGCGTCTGGCAAATCGTTGACACG | 29 | 8 | 21 | 24 | 1 | 30 |
| 2605 | 2530 | 8832 | 81.1 | TGCGTCTGAGTGTCCCTGCGCTCA | 29 | 8 | 22 | 28 | 29 | 13 |
| 2606 | 2531 | 40594 | 78.3 | TGCGTCTGATCGAAAGCAGCCTCA | 29 | 8 | 24 | 6 | 31 | 13 |
| 2607 | 2532 | 40595 | 77.2 | TGCGTCTGCCTATTGACACGGCTT | 29 | 8 | 26 | 1 | 30 | 17 |
| 2608 | 2533 | 8837 | 76.1 | TGCGTCTGCAGCTTAGCGTTTCTG | 29 | 8 | 31 | 3 | 12 | 8 |
| 2609 | 2534 | 8841 | 82.8 | TGCGTGTCTGATTGCGTCCCCACG | 29 | 9 | 2 | 29 | 28 | 30 |
| 2610 | 2535 | 8843 | 81 | TGCGTGTCTCTGCACGGTGCTCGT | 29 | 9 | 8 | 30 | 33 | 10 |
| 2611 | 2536 | 8844 | 82.7 | TGCGTGTCTGTCGTGCGGACGCTT | 29 | 9 | 9 | 33 | 34 | 17 |
| 2612 | 2537 | 40596 | 77.6 | TGCGTGTCGCTTATACAGCCAGCC | 29 | 9 | 17 | 5 | 36 | 36 |
| 2613 | 2538 | 40597 | 79.3 | TGCGTGTCGAGTTCCCAGCCAATC | 29 | 9 | 20 | 28 | 36 | 4 |
| 2614 | 2539 | 8852 | 75.9 | TGCGTGTCACCTATCGATCGCCTA | 29 | 9 | 23 | 24 | 24 | 26 |
| 2615 | 2540 | 30599 | 76.8 | TGCGTGTCAGGAGGTATCCCGGTA | 29 | 9 | 25 | 18 | 28 | 18 |
| 2616 | 2541 | 8853 | 80 | TGCGTGTCGATGGACCCTGTGACC | 29 | 9 | 27 | 32 | 14 | 32 |
| 2617 | 2542 | 40599 | 80.6 | TGCGTGTCTCCCCGAATCGTCCAT | 29 | 9 | 28 | 16 | 10 | 15 |
| 2618 | 2543 | 8856 | 78.9 | TGCGTGTCGACCTCGTCGTTCTCA | 29 | 9 | 32 | 10 | 12 | 13 |
| 2619 | 2544 | 8862 | 77.3 | TGCGTCGTCTCAACCTTCGTGCTT | 29 | 10 | 13 | 23 | 10 | 17 |
| 2620 | 2545 | 15908 | 75.8 | TGCGTCGTCTGTTTAGGTCTTGCG | 29 | 10 | 14 | 3 | 19 | 29 |
| 2621 | 2547 | 40601 | 78.4 | TGCGTCGTGTCTAGTGAGCCCACG | 29 | 10 | 19 | 22 | 36 | 30 |
| 2622 | 2548 | 30602 | 76.7 | TGCGTCGTCCTATGCGAGGAAATC | 29 | 10 | 26 | 29 | 25 | 4 |
| 2623 | 2549 | 8866 | 80.5 | TGCGTCGTGATGCGTTCTGTGCAA | 29 | 10 | 27 | 12 | 14 | 21 |
| 2624 | 2550 | 8867 | 78.4 | TGCGTCGTTCCCCCTATTAGCACG | 29 | 10 | 28 | 26 | 3 | 30 |
| 2625 | 2551 | 8868 | 82 | TGCGTCGTTGCGGGACTCGTATCG | 29 | 10 | 29 | 34 | 10 | 24 |
| 2626 | 2552 | 8869 | 81.6 | TGCGTCGTCACGCACGCTGTTGAT | 29 | 10 | 30 | 30 | 14 | 2 |
| 2627 | 2553 | 8870 | 78.5 | TGCGTCGTGACCCCTAGACCCTTG | 29 | 10 | 32 | 26 | 32 | 11 |
| 2628 | 2554 | 8872 | 79.6 | TGCGTCGTGGACTCGTCACGTTGA | 29 | 10 | 34 | 10 | 30 | 1 |
| 2629 | 2555 | 8873 | 75.2 | TGCGCTTGTTAGAGCCTTGAATCG | 29 | 11 | 3 | 36 | 1 | 24 |
| 2630 | 2557 | 8874 | 76.5 | TGCGCTTGTACAATACCAGCGTGC | 29 | 11 | 7 | 5 | 31 | 33 |
| 2631 | 2558 | 8875 | 78.2 | TGCGCTTGTCTGCGAACGTTAGGA | 29 | 11 | 8 | 16 | 12 | 25 |
| 2632 | 2559 | 8877 | 80.2 | TGCGCTTGCGTTTCGTTGATGACC | 29 | 11 | 12 | 10 | 2 | 32 |
| 2633 | 2560 | 8878 | 76.5 | TGCGCTTGCTCAATACCGAAACCT | 29 | 11 | 13 | 5 | 16 | 23 |
| 2634 | 2561 | 15909 | 78.5 | TGCGCTTGCTGTCGAACCATTCTG | 29 | 11 | 14 | 16 | 15 | 8 |
| 2635 | 2562 | 30604 | 76.1 | TGCGCTTGGAGTATCGAATCCCAT | 29 | 11 | 20 | 24 | 4 | 15 |
| 2636 | 2563 | 40604 | 77.1 | TGCGCTTGAGTGAATCCTTGCCAT | 29 | 11 | 22 | 4 | 11 | 15 |
| 2637 | 2564 | 8885 | 78.6 | TGCGCTTGATCGATCGAGTGCTTG | 29 | 11 | 24 | 24 | 22 | 11 |
| 2638 | 2565 | 8887 | 77.8 | TGCGCTTGGATGACGGGAGTTACA | 29 | 11 | 27 | 35 | 20 | 7 |
| 2639 | 2566 | 8888 | 82.4 | TGCGCTTGCAGCCACGGAGTCTTG | 29 | 11 | 31 | 30 | 20 | 11 |
| 2640 | 2567 | 40605 | 81.7 | TGCGCTTGGTGCACCTCGTTTCGT | 29 | 11 | 33 | 23 | 12 | 10 |
| 2641 | 2568 | 8890 | 81.3 | TGCGCTTGAGCCGACCACCTATCG | 29 | 11 | 36 | 32 | 23 | 24 |
| 2642 | 2569 | 21509 | 76.9 | TGCGCGTTAATCCCTACCATCGAA | 29 | 12 | 4 | 26 | 15 | 16 |
| 2643 | 2570 | 40607 | 75.8 | TGCGCGTTATACTCTGAGCCGATG | 29 | 12 | 5 | 8 | 36 | 27 |
| 2644 | 2571 | 30606 | 75.2 | TGCGCGTTAAAGAATCGCAAAAAG | 29 | 12 | 6 | 4 | 21 | 6 |
| 2645 | 2572 | 8893 | 80 | TGCGCGTTTCTGCTTGATCGTCGT | 29 | 12 | 8 | 11 | 24 | 10 |
| 2646 | 2573 | 8894 | 79.2 | TGCGCGTTTCGTCGAACGAAGTCT | 29 | 12 | 10 | 16 | 16 | 19 |
| 2647 | 2574 | 8895 | 79.1 | TGCGCGTTCGTTAGTGCTTGCTCA | 29 | 12 | 12 | 22 | 11 | 13 |
| 2648 | 2575 | 30607 | 77.8 | TGCGCGTTGGTACCATTTAGCGAA | 29 | 12 | 18 | 15 | 3 | 16 |
| 2649 | 2576 | 8899 | 77.5 | TGCGCGTTGTCTGGTAGACCCTTG | 29 | 12 | 19 | 18 | 32 | 11 |
| 2650 | 2577 | 21511 | 78.1 | TGCGCGTTATCGTTGATTGAACGG | 29 | 12 | 24 | 1 | 1 | 35 |
| 2651 | 2579 | 8902 | 78.3 | TGCGCGTTGATGTCCCTTGAAGTG | 29 | 12 | 27 | 28 | 1 | 22 |
| 2652 | 2580 | 8903 | 82.1 | TGCGCGTTTCCCGCTTACCTGGAC | 29 | 12 | 28 | 17 | 23 | 34 |

FIG. 25AAA

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 2653 | 2581 | 8904 | 82.6 | TGCGCGTTCACGGAGTCACGCCTA | 29 | 12 | 30 | 20 | 30 | 26 |
| 2654 | 2582 | 40609 | 80 | TGCGCGTTCAGCTTAGAGCCTCCC | 29 | 12 | 31 | 3 | 36 | 28 |
| 2655 | 2583 | 8906 | 78.9 | TGCGCGTTGACCTCCCATACGAGT | 29 | 12 | 32 | 28 | 5 | 20 |
| 2656 | 2584 | 8908 | 80.9 | TGCGCGTTACGGGGTAGATGGTGC | 29 | 12 | 35 | 18 | 27 | 33 |
| 2657 | 2585 | 40611 | 77.4 | TGCGCTCATGATAATCAGCCGGAC | 29 | 13 | 2 | 4 | 36 | 34 |
| 2658 | 2586 | 40612 | 80 | TGCGCTCATTAGCACGCACGGAGT | 29 | 13 | 3 | 30 | 30 | 20 |
| 2659 | 2588 | 40614 | 78.7 | TGCGCTCAAAAGCTCAATCGTCCC | 29 | 13 | 6 | 13 | 24 | 28 |
| 2660 | 2589 | 8910 | 75.7 | TGCGCTCATACATGCGGGTATGAT | 29 | 13 | 7 | 29 | 18 | 2 |
| 2661 | 2590 | 8911 | 77.9 | TGCGCTCATCTGATCGTGTCCGTT | 29 | 13 | 8 | 24 | 9 | 12 |
| 2662 | 2591 | 40615 | 78.1 | TGCGCTCACGTTATCGCTTGAGGA | 29 | 13 | 12 | 24 | 11 | 25 |
| 2663 | 2593 | 8915 | 78.4 | TGCGCTCACTGTTCCCGTCTGATG | 29 | 13 | 14 | 28 | 19 | 27 |
| 2664 | 2596 | 8918 | 79.3 | TGCGCTCAGCAAAGTGCTCAGCAA | 29 | 13 | 21 | 22 | 13 | 21 |
| 2665 | 2597 | 30610 | 76 | TGCGCTCACCTACGAAAAAGGGAC | 29 | 13 | 26 | 16 | 6 | 34 |
| 2666 | 2598 | 8921 | 80.4 | TGCGCTCAGATGGTGCGAGTGGAC | 29 | 13 | 27 | 33 | 20 | 34 |
| 2667 | 2601 | 40617 | 77.5 | TGCGCTGTTGATAAAGTGCGGACC | 29 | 14 | 2 | 6 | 29 | 32 |
| 2668 | 2602 | 8925 | 78.6 | TGCGCTGTAATCGCTTGTCTTGCG | 29 | 14 | 4 | 17 | 19 | 29 |
| 2669 | 2603 | 8926 | 79.1 | TGCGCTGTATACGACCACGGTCCC | 29 | 14 | 5 | 32 | 35 | 28 |
| 2670 | 2604 | 8928 | 75.2 | TGCGCTGTTACACCTAACGGAGGA | 29 | 14 | 7 | 26 | 35 | 25 |
| 2671 | 2605 | 40618 | 78.5 | TGCGCTGTTCTGTGATAGCCGTGC | 29 | 14 | 8 | 2 | 36 | 33 |
| 2672 | 2606 | 8929 | 78.4 | TGCGCTGTTGTCAATCGCAAGACC | 29 | 14 | 9 | 4 | 21 | 32 |
| 2673 | 2607 | 8931 | 79.8 | TGCGCTGTCTTGGACCAGTGCCAT | 29 | 14 | 11 | 32 | 22 | 15 |
| 2674 | 2609 | 40619 | 78.1 | TGCGCTGTCTCACCATTCTGCGTT | 29 | 14 | 13 | 15 | 8 | 12 |
| 2675 | 2610 | 40620 | 78.6 | TGCGCTGTCTGTTCTGCGAAATCG | 29 | 14 | 14 | 8 | 16 | 24 |
| 2676 | 2611 | 30611 | 76.5 | TGCGCTGTCCATCCTAAAAGCGTT | 29 | 14 | 15 | 26 | 6 | 12 |
| 2677 | 2612 | 8933 | 77 | TGCGCTGTCGAAAATCCCATCCTA | 29 | 14 | 16 | 4 | 15 | 26 |
| 2678 | 2613 | 30612 | 78.6 | TGCGCTGTGGTAGAGTTCCCGGAC | 29 | 14 | 18 | 20 | 28 | 34 |
| 2679 | 2615 | 15915 | 79 | TGCGCTGTAGTGGGACCGTTGCTT | 29 | 14 | 22 | 34 | 12 | 17 |
| 2680 | 2616 | 30614 | 78.9 | TGCGCTGTCAGCTTAGCTCATGCG | 29 | 14 | 31 | 3 | 13 | 29 |
| 2681 | 2617 | 8938 | 80.6 | TGCGCTGTGACCGGACCCATACCT | 29 | 14 | 32 | 34 | 15 | 23 |
| 2682 | 2618 | 8940 | 81 | TGCGCTGTACGGGTGCTCTGCTCA | 29 | 14 | 35 | 33 | 8 | 13 |
| 2683 | 2619 | 8941 | 79.4 | TGCGCTGTAGCCGAGTCTTGCGTT | 29 | 14 | 36 | 20 | 11 | 12 |
| 2684 | 2620 | 40621 | 78.1 | TGCGCCATTTGAACCTATCGGCTT | 29 | 15 | 1 | 23 | 24 | 17 |
| 2685 | 2621 | 8943 | 76.5 | TGCGCCATTTAGGAGTCGTTGCTT | 29 | 15 | 3 | 20 | 12 | 17 |
| 2686 | 2622 | 40622 | 78.9 | TGCGCCATAATCTCTGTGCGCTCA | 29 | 15 | 4 | 8 | 29 | 13 |
| 2687 | 2625 | 8946 | 79.4 | TGCGCCATCGAAGTCTTTGAACGG | 29 | 15 | 16 | 19 | 1 | 35 |
| 2688 | 2626 | 8947 | 80.5 | TGCGCCATGTCTGATGGACCCTCA | 29 | 15 | 19 | 27 | 32 | 13 |
| 2689 | 2627 | 30616 | 80.9 | TGCGCCATATCGGTCTCAGCGCTT | 29 | 15 | 24 | 19 | 31 | 17 |
| 2690 | 2628 | 8951 | 80 | TGCGCCATTCCCTCGTTACATCCC | 29 | 15 | 28 | 10 | 7 | 28 |
| 2691 | 2629 | 8952 | 80.1 | TGCGCCATGACCTGATCTTGACGG | 29 | 15 | 32 | 2 | 11 | 35 |
| 2692 | 2630 | 8954 | 81.8 | TGCGCCATGGACCCATCGAAGATG | 29 | 15 | 34 | 15 | 16 | 27 |
| 2693 | 2631 | 8955 | 82.9 | TGCGCCATACGGCTGTCTCATGCG | 29 | 15 | 35 | 14 | 13 | 29 |
| 2694 | 2632 | 40624 | 79.3 | TGCGCGAATGATCGTTCTTGGGAC | 29 | 16 | 2 | 12 | 11 | 34 |
| 2695 | 2633 | 8956 | 77.8 | TGCGCGAAAATCAAAGCAGCTGTC | 29 | 16 | 4 | 6 | 31 | 9 |
| 2696 | 2634 | 21535 | 80.4 | TGCGCGAACTCAGACCAGGACACG | 29 | 16 | 13 | 32 | 25 | 30 |
| 2697 | 2635 | 8959 | 80.5 | TGCGCGAACCATCTGTTGTCCGAA | 29 | 16 | 15 | 14 | 9 | 16 |
| 2698 | 2636 | 8960 | 78.7 | TGCGCGAACGAAAGCCAAAGAATC | 29 | 16 | 16 | 36 | 6 | 4 |
| 2699 | 2637 | 8962 | 80.8 | TGCGCGAAGCAACTCACCATCGAA | 29 | 16 | 21 | 13 | 15 | 16 |
| 2700 | 2638 | 8963 | 80.2 | TGCGCGAAATCGTGATCCATCAGC | 29 | 16 | 24 | 2 | 15 | 31 |
| 2701 | 2639 | 30619 | 80.8 | TGCGCGAAAGGAGATGGTGCCCTA | 29 | 16 | 25 | 27 | 33 | 26 |
| 2702 | 2640 | 15917 | 82.1 | TGCGCGAATCCCCCTACAGCCTTG | 29 | 16 | 28 | 26 | 31 | 11 |
| 2703 | 2644 | 40625 | 76.1 | TGCGGCTTATACAATCGCTTGCAA | 29 | 17 | 5 | 4 | 17 | 21 |

FIG. 25BBB

| SEQ ID NO: | 4,633 ID# | HEX ID# | Tm | ZIPCODE (5'-3') | TETRAMER NUMBERS | | | | |
|---|---|---|---|---|---|---|---|---|---|
| 2704 | 2645 | 30620 | 81.6 | TGCGGCTTTCTGCAGCTCGTGACC | 29 | 17 | 8 | 31 | 10 | 32 |
| 2705 | 2646 | 8975 | 80.4 | TGCGGCTTCTTGCTGTGACCGATG | 29 | 17 | 11 | 14 | 32 | 27 |
| 2706 | 2647 | 8976 | 78.3 | TGCGGCTTCTCAAGTGAGTGCGAA | 29 | 17 | 13 | 22 | 22 | 16 |
| 2707 | 2648 | 8978 | 79.4 | TGCGGCTTCGAATTGATCTGACGG | 29 | 17 | 16 | 1 | 8 | 35 |
| 2708 | 2649 | 8980 | 78.9 | TGCGGCTTGCAATCTGAAAGAGCC | 29 | 17 | 21 | 8 | 6 | 36 |
| 2709 | 2650 | 8984 | 80.3 | TGCGGCTTTCCCCAGCCCTAGAGT | 29 | 17 | 28 | 31 | 26 | 20 |
| 2710 | 2651 | 30622 | 83.5 | TGCGGCTTCACGGGACCGAACTCA | 29 | 17 | 30 | 34 | 16 | 13 |
| 2711 | 2652 | 8988 | 79.6 | TGCGGCTTAGCCGACCCGAATTAG | 29 | 17 | 36 | 32 | 16 | 3 |
| 2712 | 2653 | 30623 | 76.6 | TGCGGGTAAAAGAGGAGGACCGTT | 29 | 18 | 6 | 25 | 34 | 12 |
| 2713 | 2654 | 8990 | 75.1 | TGCGGGTATACACCATACGGATCG | 29 | 18 | 7 | 15 | 35 | 24 |
| 2714 | 2656 | 30624 | 80 | TGCGGGTATGTCCACGAAAGCACG | 29 | 18 | 9 | 30 | 6 | 30 |
| 2715 | 2657 | 30625 | 78.2 | TGCGGGTACGTTCAGCCTTGGTCT | 29 | 18 | 12 | 31 | 11 | 19 |
| 2716 | 2658 | 21547 | 77.1 | TGCGGGTACTCAGCAACGTTTCGT | 29 | 18 | 13 | 21 | 12 | 10 |
| 2717 | 2659 | 8994 | 77.3 | TGCGGGTACTGTGCAACTTGTCCC | 29 | 18 | 14 | 21 | 11 | 28 |
| 2718 | 2660 | 30626 | 75.9 | TGCGGGTAGCTTAGCCGAGTAGGA | 29 | 18 | 17 | 36 | 20 | 25 |
| 2719 | 2661 | 8998 | 76.3 | TGCGGGTAGAGTGGACCTTGCCTA | 29 | 18 | 20 | 34 | 11 | 26 |
| 2720 | 2662 | 9003 | 76 | TGCGGGTACCTAGACCCAGCTCTG | 29 | 18 | 26 | 32 | 31 | 8 |
| 2721 | 2664 | 9005 | 78.9 | TGCGGGTACACGTGTCACGGAGTG | 29 | 18 | 30 | 9 | 35 | 22 |
| 2722 | 2665 | 9008 | 77.3 | TGCGGGTAGTGCTGTCTGTCGCTT | 29 | 18 | 33 | 9 | 9 | 17 |
| 2723 | 2666 | 9009 | 77.8 | TGCGGGTAGGACCCTAGAGTTGCG | 29 | 18 | 34 | 26 | 20 | 29 |
| 2724 | 2667 | 9010 | 82 | TGCGGGTAAGCCGTCTGCAACACG | 29 | 18 | 36 | 19 | 21 | 30 |
| 2725 | 2668 | 30627 | 77.4 | TGCGGTCTTGATCGAATCGTACGG | 29 | 19 | 2 | 16 | 10 | 35 |
| 2726 | 2669 | 21553 | 77.8 | TGCGGTCTTTAGCTGTTCGTTGCG | 29 | 19 | 3 | 14 | 10 | 29 |
| 2727 | 2670 | 40630 | 78.4 | TGCGGTCTAAAGGATGCAGCGCTT | 29 | 19 | 6 | 27 | 31 | 17 |
| 2728 | 2671 | 40631 | 76.9 | TGCGGTCTTCTGTCCCTTAGTGCG | 29 | 19 | 8 | 28 | 3 | 29 |
| 2729 | 2672 | 9014 | 76.8 | TGCGGTCTTGTCCAGCCGTTAAAG | 29 | 19 | 9 | 31 | 12 | 6 |
| 2730 | 2673 | 40632 | 79.5 | TGCGGTCTCTTGGGTATCCCCAGC | 29 | 19 | 11 | 18 | 28 | 31 |
| 2731 | 2674 | 9017 | 77.5 | TGCGGTCTCTGTTTGAATCGACGG | 29 | 19 | 14 | 1 | 24 | 35 |
| 2732 | 2675 | 40634 | 78.4 | TGCGGTCTCGAAAGGAGCAAAGGA | 29 | 19 | 16 | 25 | 21 | 25 |
| 2733 | 2676 | 21556 | 81.3 | TGCGGTCTGGTATCCCGACCCCAT | 29 | 19 | 18 | 28 | 32 | 15 |
| 2734 | 2677 | 40635 | 77.5 | TGCGGTCTGAGTAGTGTGCGTCCC | 29 | 19 | 20 | 22 | 29 | 28 |
| 2735 | 2678 | 30629 | 77.2 | TGCGGTCTACCTGCAAAAGGCAA | 29 | 19 | 23 | 21 | 6 | 21 |
| 2736 | 2679 | 30630 | 78.8 | TGCGGTCTATCGGACCGATGCCTA | 29 | 19 | 24 | 32 | 27 | 26 |
| 2737 | 2680 | 30631 | 77.3 | TGCGGTCTAGGAAAAGGACCCGAA | 29 | 19 | 25 | 6 | 32 | 16 |
| 2738 | 2681 | 30632 | 78.5 | TGCGGTCTGATGAAAGCTTGTGCG | 29 | 19 | 27 | 6 | 11 | 29 |
| 2739 | 2682 | 9025 | 79.2 | TGCGGTCTCAGCCGAACTTGAGGA | 29 | 19 | 31 | 16 | 11 | 25 |
| 2740 | 2683 | 30633 | 75.1 | TGCGGAGTTGATAGCCTTAGCACG | 29 | 20 | 2 | 36 | 3 | 30 |
| 2741 | 2684 | 21559 | 77.3 | TGCGGAGTATACGTGCGGTAACGG | 29 | 20 | 5 | 33 | 18 | 35 |
| 2742 | 2685 | 21560 | 76.4 | TGCGGAGTTCTGATACGCAACACG | 29 | 20 | 8 | 5 | 21 | 30 |
| 2743 | 2686 | 40636 | 78.1 | TGCGGAGTTCGTTCTGGACCCCTA | 29 | 20 | 10 | 8 | 32 | 26 |
| 2744 | 2688 | 9036 | 77.8 | TGCGGAGTGCAAGACCCGAATACA | 29 | 20 | 21 | 32 | 15 | 7 |
| 2745 | 2689 | 9039 | 78.9 | TGCGGAGTTCCCTGTCGATGTCGT | 29 | 20 | 28 | 9 | 27 | 10 |
| 2746 | 2692 | 9041 | 81.3 | TGCGGAGTGTGCGTGCACCTTCTG | 29 | 20 | 33 | 33 | 23 | 8 |
| 2747 | 2693 | 40638 | 80.3 | TGCGGAGTGGACCGTTGAGTTCCC | 29 | 20 | 34 | 12 | 20 | 28 |
| 2748 | 2694 | 9042 | 77.8 | TGCGGCAATTGAGATGCGTTTGAT | 29 | 21 | 1 | 27 | 12 | 2 |
| 2749 | 2695 | 15926 | 76.5 | TGCGGCAATTAGCGTTACCTGCTT | 29 | 21 | 3 | 12 | 23 | 17 |
| 2750 | 2696 | 30635 | 77.3 | TGCGGCAAAATCTTAGCAGCGGTA | 29 | 21 | 4 | 3 | 31 | 18 |
| 2751 | 2697 | 30636 | 77.8 | TGCGGCAAAAAGTTAGGGACCAGC | 29 | 21 | 6 | 3 | 34 | 31 |
| 2752 | 2698 | 9045 | 77.4 | TGCGGCAATCTGATACCTTGACGG | 29 | 21 | 8 | 5 | 11 | 35 |
| 2753 | 2699 | 9046 | 79.3 | TGCGGCAACGAATGATTCCCTCTG | 29 | 21 | 16 | 2 | 28 | 8 |
| 2754 | 2700 | 9047 | 76 | TGCGGCAAGCTTAAAGGAGTGCTT | 29 | 21 | 17 | 6 | 20 | 17 |

FIG. 25CCC

| SEQ ID NO: | 4,633 ID# | HEX ID# | Tm | ZIPCODE (5'-3') | TETRAMER NUMBERS | | | | |
|---|---|---|---|---|---|---|---|---|---|
| 2755 | 2701 | 21570 | 82.7 | TGCGGCAAGTCTGACCCACGCTCA | 29 | 21 | 19 | 32 | 30 | 13 |
| 2756 | 2702 | 9048 | 76.4 | TGCGGCAAGAGTATCGATCGGTCT | 29 | 21 | 20 | 24 | 24 | 19 |
| 2757 | 2703 | 40641 | 78.6 | TGCGGCAAGATGAGGAAAAGGTGC | 29 | 21 | 27 | 25 | 6 | 33 |
| 2758 | 2704 | 9049 | 80.5 | TGCGGCAATCCCGCTTATACCGAA | 29 | 21 | 28 | 17 | 5 | 16 |
| 2759 | 2705 | 9050 | 79.1 | TGCGGCAACAGCAAAGACCTCGTT | 29 | 21 | 31 | 6 | 23 | 12 |
| 2760 | 2706 | 9051 | 79.5 | TGCGGCAAGACCCCTAACCTGGAC | 29 | 21 | 32 | 26 | 23 | 34 |
| 2761 | 2707 | 15927 | 79.9 | TGCGGCAAGTGCAAAGCGAAGGTA | 29 | 21 | 33 | 6 | 16 | 18 |
| 2762 | 2709 | 9056 | 82.9 | TGCGAGTGTCTGAGCCCAGCGCAA | 29 | 22 | 8 | 36 | 31 | 21 |
| 2763 | 2710 | 40642 | 78.8 | TGCGAGTGTCGTTGCGAGGATTGA | 29 | 22 | 10 | 29 | 25 | 1 |
| 2764 | 2711 | 9058 | 78.6 | TGCGAGTGCTTGCAGCATACAGCC | 29 | 22 | 11 | 31 | 5 | 36 |
| 2765 | 2712 | 15928 | 76.7 | TGCGAGTGGCTTCCATTGATAGCC | 29 | 22 | 17 | 15 | 2 | 36 |
| 2766 | 2713 | 30637 | 77.9 | TGCGAGTGGGTACTTGTCCCCGTT | 29 | 22 | 18 | 11 | 28 | 12 |
| 2767 | 2714 | 40643 | 81.7 | TGCGAGTGACCTCGAATCCCGCAA | 29 | 22 | 23 | 16 | 28 | 21 |
| 2768 | 2715 | 9063 | 77.1 | TGCGAGTGAGGAGATGCGTTCCAT | 29 | 22 | 25 | 27 | 12 | 15 |
| 2769 | 2716 | 9066 | 81.3 | TGCGAGTGTGCGGTGCCTTGAGTG | 29 | 22 | 29 | 33 | 11 | 22 |
| 2770 | 2717 | 9067 | 79.5 | TGCGAGTGCAGCACCTAGTGTGCG | 29 | 22 | 31 | 23 | 22 | 29 |
| 2771 | 2718 | 30638 | 78.5 | TGCGACCTTGATCAGCGTGCAAAG | 29 | 23 | 2 | 31 | 33 | 6 |
| 2772 | 2719 | 30639 | 79.1 | TGCGACCTAAAGGTGCTGCGTCGT | 29 | 23 | 6 | 33 | 29 | 10 |
| 2773 | 2720 | 9069 | 76.6 | TGCGACCTTACAGGACAGGAACGG | 29 | 23 | 7 | 34 | 25 | 35 |
| 2774 | 2722 | 40645 | 80.4 | TGCGACCTTCGTGTCTGACCTGCG | 29 | 23 | 10 | 19 | 32 | 29 |
| 2775 | 2723 | 40646 | 80 | TGCGACCTCTTGCGTTTCCCCTGT | 29 | 23 | 11 | 12 | 28 | 14 |
| 2776 | 2724 | 9071 | 75.9 | TGCGACCTCTCATTAGGACCAGCC | 29 | 23 | 13 | 3 | 32 | 36 |
| 2777 | 2725 | 21582 | 80.3 | TGCGACCTCTGTCAGCCCATGTGC | 29 | 23 | 14 | 31 | 15 | 33 |
| 2778 | 2726 | 9072 | 77 | TGCGACCTCCATGCAACTTGGTCT | 29 | 23 | 15 | 21 | 11 | 19 |
| 2779 | 2727 | 30640 | 76.8 | TGCGACCTCGAAGCTTAAAGCGAA | 29 | 23 | 16 | 17 | 6 | 16 |
| 2780 | 2728 | 9074 | 75.9 | TGCGACCTGGTAAAAGCTTGTCCC | 29 | 23 | 18 | 6 | 11 | 28 |
| 2781 | 2729 | 9077 | 76.4 | TGCGACCTAGTGACCTTGCGACCT | 29 | 23 | 22 | 23 | 29 | 23 |
| 2782 | 2730 | 9078 | 75.4 | TGCGACCTACCTCCTAACGGGGTA | 29 | 23 | 23 | 26 | 35 | 18 |
| 2783 | 2731 | 9079 | 78.3 | TGCGACCTATCGCAGCATACACGG | 29 | 23 | 24 | 31 | 5 | 35 |
| 2784 | 2732 | 9081 | 80.2 | TGCGACCTTCCCCGAACACGAATC | 29 | 23 | 28 | 16 | 30 | 4 |
| 2785 | 2733 | 9082 | 82.5 | TGCGACCTTGCGGTGCAGGATTGA | 29 | 23 | 29 | 33 | 25 | 1 |
| 2786 | 2734 | 30642 | 80.1 | TGCGACCTCACGTTGACACGGACC | 29 | 23 | 30 | 1 | 30 | 32 |
| 2787 | 2735 | 9085 | 78.9 | TGCGACCTGGACCGTTCGAACCTA | 29 | 23 | 34 | 12 | 16 | 26 |
| 2788 | 2736 | 30643 | 76.7 | TGCGATCGTTGATCCCCAGCTTAG | 29 | 24 | 1 | 28 | 31 | 3 |
| 2789 | 2737 | 9087 | 75.6 | TGCGATCGTGATAATCGATGCCAT | 29 | 24 | 2 | 4 | 27 | 15 |
| 2790 | 2738 | 9091 | 80.8 | TGCGATCGTGTCGCTTCACGAGGA | 29 | 24 | 9 | 17 | 30 | 25 |
| 2791 | 2739 | 21588 | 79.2 | TGCGATCGCTTGTCGTGGACAGTG | 29 | 24 | 11 | 10 | 34 | 22 |
| 2792 | 2740 | 9094 | 80.5 | TGCGATCGCCATGGTACACGCTGT | 29 | 24 | 15 | 18 | 30 | 14 |
| 2793 | 2742 | 9097 | 77 | TGCGATCGGGTAAATCCTTGCTCA | 29 | 24 | 18 | 4 | 11 | 13 |
| 2794 | 2743 | 9099 | 79.5 | TGCGATCGAGTGGCAACCATCCAT | 29 | 24 | 22 | 21 | 15 | 15 |
| 2795 | 2744 | 40650 | 80.1 | TGCGATCGATCGTGTCCTTGGTGC | 29 | 24 | 24 | 9 | 11 | 33 |
| 2796 | 2745 | 9100 | 76.2 | TGCGATCGCCTACCTACGAACCAT | 29 | 24 | 26 | 26 | 16 | 15 |
| 2797 | 2746 | 9101 | 81 | TGCGATCGTCCCGTCTCCATACGG | 29 | 24 | 28 | 19 | 15 | 35 |
| 2798 | 2747 | 9103 | 80.5 | TGCGATCGCAGCAAAGTGTCAGCC | 29 | 24 | 31 | 6 | 9 | 36 |
| 2799 | 2749 | 9105 | 80.2 | TGCGATCGACGGACCTGCAAAGTG | 29 | 24 | 35 | 23 | 21 | 22 |
| 2800 | 2750 | 9106 | 79.1 | TGCGATCGAGCCATACAGCCGTCT | 29 | 24 | 36 | 5 | 36 | 19 |
| 2801 | 2751 | 9107 | 78.9 | TGCGAGGATTAGCACGATCGCCAT | 29 | 25 | 3 | 30 | 24 | 15 |
| 2802 | 2752 | 15931 | 77.6 | TGCGAGGATGTCTCCCTCCCAATC | 29 | 25 | 9 | 28 | 28 | 4 |
| 2803 | 2753 | 9111 | 79.2 | TGCGAGGACTTGCACGTACATGCG | 29 | 25 | 11 | 30 | 7 | 29 |
| 2804 | 2754 | 40652 | 79.3 | TGCGAGGACTGTAGCCCCATCACG | 29 | 25 | 14 | 36 | 15 | 30 |
| 2805 | 2756 | 15933 | 77.5 | TGCGAGGAGCAAAAAGGACCACCT | 29 | 25 | 21 | 6 | 32 | 23 |

FIG. 25DDD

| SEQ ID NO: | 4,633 ID# | HEX ID# | Tm | ZIPCODE (5'-3') | TETRAMER NUMBERS | | | | |
|---|---|---|---|---|---|---|---|---|---|
| 2806 | 2757 | 40654 | 79.4 | TGCGAGGAAGTGAGTGGGACCACG | 29 | 25 | 22 | 22 | 34 | 30 |
| 2807 | 2758 | 9119 | 76.5 | TGCGAGGAAGGATGCGTTAGAGGA | 29 | 25 | 25 | 29 | 3 | 25 |
| 2808 | 2759 | 9122 | 80.1 | TGCGAGGACAGCCGTTCAGCTTGA | 29 | 25 | 31 | 12 | 31 | 1 |
| 2809 | 2760 | 9125 | 81.4 | TGCGAGGAACGGGAGTCACGCTTG | 29 | 25 | 35 | 20 | 30 | 11 |
| 2810 | 2761 | 40656 | 77.2 | TGCGCCTATTGACGAATGTCGCTT | 29 | 26 | 1 | 16 | 9 | 17 |
| 2811 | 2764 | 30646 | 78.5 | TGCGCCTATACAAGCCGGACCTTG | 29 | 26 | 7 | 36 | 34 | 11 |
| 2812 | 2765 | 15936 | 76.7 | TGCGCCTATGTCAGGAAGCCAATC | 29 | 26 | 9 | 25 | 36 | 4 |
| 2813 | 2766 | 9133 | 75.7 | TGCGCCTACTTGTGCGTTGAAATC | 29 | 26 | 11 | 29 | 1 | 4 |
| 2814 | 2767 | 9136 | 76.4 | TGCGCCTACGAAATACCAGCACCT | 29 | 26 | 16 | 5 | 31 | 23 |
| 2815 | 2768 | 40661 | 75.3 | TGCGCCTAGGTAAATCCGTTAGCC | 29 | 26 | 18 | 4 | 12 | 36 |
| 2816 | 2769 | 9137 | 76.4 | TGCGCCTAGTCTCACGCAGCTACA | 29 | 26 | 19 | 30 | 31 | 7 |
| 2817 | 2771 | 9141 | 80.7 | TGCGCCTATCCCGCAATGTCGAGT | 29 | 26 | 28 | 21 | 9 | 20 |
| 2818 | 2772 | 9142 | 79.2 | TGCGCCTATGCGAGTGCCTAAGGA | 29 | 26 | 29 | 22 | 26 | 25 |
| 2819 | 2773 | 9143 | 79.3 | TGCGCCTACACGGATGAAAGACGG | 29 | 26 | 30 | 27 | 6 | 35 |
| 2820 | 2774 | 15937 | 78 | TGCGCCTAGGACACCTTGCGTACA | 29 | 26 | 34 | 23 | 29 | 7 |
| 2821 | 2775 | 9146 | 80.4 | TGCGCCTAACGGCCTAACCTGTGC | 29 | 26 | 35 | 26 | 23 | 33 |
| 2822 | 2776 | 9147 | 79.4 | TGCGCCTAAGCCCTCAAGGAAGGA | 29 | 26 | 36 | 13 | 25 | 25 |
| 2823 | 2777 | 40663 | 78.4 | TGCGGATGTTGAGTGCGCTTTGTC | 29 | 27 | 1 | 33 | 17 | 9 |
| 2824 | 2778 | 30647 | 77.8 | TGCGGATGTGATGCTTCCATGCTT | 29 | 27 | 2 | 17 | 15 | 17 |
| 2825 | 2779 | 40666 | 77.8 | TGCGGATGTGTCCGTTAAAGCGAA | 29 | 27 | 9 | 12 | 6 | 16 |
| 2826 | 2780 | 9150 | 81.3 | TGCGGATGCGTTGATGCAGCTCTG | 29 | 27 | 12 | 27 | 31 | 8 |
| 2827 | 2781 | 9151 | 76.6 | TGCGGATGCTCAATACGTCTTCCC | 29 | 27 | 13 | 5 | 19 | 28 |
| 2828 | 2782 | 9152 | 79.5 | TGCGGATGCTGTGATGGCAACTCA | 29 | 27 | 14 | 27 | 21 | 13 |
| 2829 | 2783 | 30648 | 82 | TGCGGATGGCAAAGTGAGGATGCG | 29 | 27 | 21 | 22 | 25 | 29 |
| 2830 | 2785 | 40667 | 79.2 | TGCGGATGCCTATCGTCGTTGGAC | 29 | 27 | 26 | 10 | 12 | 34 |
| 2831 | 2786 | 9158 | 83.7 | TGCGGATGCACGCGTTGGACAGTG | 29 | 27 | 30 | 12 | 34 | 22 |
| 2832 | 2787 | 9160 | 80.7 | TGCGGATGGTGCCGAACTTGACCT | 29 | 27 | 33 | 16 | 11 | 23 |
| 2833 | 2788 | 40668 | 80.6 | TGCGGATGGGACTTGACAGCCCAT | 29 | 27 | 34 | 1 | 31 | 15 |
| 2834 | 2789 | 15940 | 79.7 | TGCGGATGACGGTGTCAATCGCTT | 29 | 27 | 35 | 9 | 4 | 17 |
| 2835 | 2790 | 9165 | 77.6 | TGCGTCCCAATCTCTGACCTTCCC | 29 | 28 | 4 | 8 | 23 | 28 |
| 2836 | 2792 | 9167 | 79 | TGCGTCCCAAAGCTTGGCAACTGT | 29 | 28 | 6 | 11 | 21 | 14 |
| 2837 | 2794 | 9169 | 76.4 | TGCGTCCCTCGTAAAGGTCTCGAA | 29 | 28 | 10 | 6 | 19 | 16 |
| 2838 | 2795 | 9170 | 80.4 | TGCGTCCCCTTGCTTGAATCAGCC | 29 | 28 | 11 | 11 | 4 | 36 |
| 2839 | 2796 | 30650 | 82.8 | TGCGTCCCCGTTGATGGCTTGGAC | 29 | 28 | 12 | 27 | 17 | 34 |
| 2840 | 2797 | 9171 | 78.1 | TGCGTCCCCATAATCAATCCAGC | 29 | 28 | 15 | 4 | 4 | 31 |
| 2841 | 2798 | 9172 | 80.2 | TGCGTCCCGAACCATACCTCAGC | 29 | 28 | 16 | 15 | 23 | 31 |
| 2842 | 2799 | 21616 | 77.6 | TGCGTCCGGTAATACAGGAAGCC | 29 | 28 | 18 | 5 | 25 | 36 |
| 2843 | 2800 | 9173 | 79.2 | TGCGTCCCGTCTGAGTTGTCGCTT | 29 | 28 | 19 | 20 | 9 | 17 |
| 2844 | 2801 | 40670 | 78.9 | TGCGTCCCACCTATCGCTGTCGTT | 29 | 28 | 23 | 24 | 14 | 12 |
| 2845 | 2803 | 40671 | 82.2 | TGCGTCCCTCCCTCCCAGTGATCG | 29 | 28 | 28 | 28 | 22 | 24 |
| 2846 | 2804 | 9178 | 83 | TGCGTCCCGGACCTCAAGTGACGG | 29 | 28 | 34 | 13 | 22 | 35 |
| 2847 | 2805 | 9179 | 79.7 | TGCGTCCCACGGAGGAAATCCCTA | 29 | 28 | 35 | 25 | 4 | 26 |
| 2848 | 2806 | 9181 | 76.4 | TGCGTGCGATACCTTGCCTAACCT | 29 | 29 | 5 | 11 | 26 | 23 |
| 2849 | 2807 | 40672 | 80.2 | TGCGTGCGTCTGATACGGACGGAC | 29 | 29 | 8 | 5 | 34 | 34 |
| 2850 | 2808 | 9183 | 80.8 | TGCGTGCGTGTCCTCACAGCCCTA | 29 | 29 | 9 | 13 | 31 | 26 |
| 2851 | 2809 | 9184 | 81.9 | TGCGTGCGTCGTCAGCTGTCAGGA | 29 | 29 | 10 | 31 | 9 | 25 |
| 2852 | 2810 | 30651 | 81.7 | TGCGTGCGGCTTAGTGGCAAAGGA | 29 | 29 | 17 | 22 | 21 | 25 |
| 2853 | 2811 | 9186 | 79.4 | TGCGTGCGGAGTCCTACGTTGGAC | 29 | 29 | 20 | 26 | 12 | 34 |
| 2854 | 2812 | 9187 | 82.5 | TGCGTGCGATCGCGTTTGTCCTGT | 29 | 29 | 24 | 12 | 9 | 14 |
| 2855 | 2813 | 9188 | 79.9 | TGCGTGCGCCTACCATCTTGCTGT | 29 | 29 | 26 | 15 | 11 | 14 |
| 2856 | 2814 | 9189 | 83.6 | TGCGTGCGTCCCGCTTTGTCTCGT | 29 | 29 | 28 | 17 | 9 | 10 |

FIG. 25EEE

| SEQ ID NO: | 4,633 ID# | HEX ID# | Tm | ZIPCODE (5'-3') | TETRAMER NUMBERS | | | | |
|---|---|---|---|---|---|---|---|---|---|
| 2857 | 2815 | 21629 | 78.8 | TGCGCACGTTGAAAAGAGGAAGCC | 29 | 30 | 1 | 6 | 25 | 36 |
| 2858 | 2816 | 9191 | 77.9 | TGCGCACGTTAGCGTTACGGTGAT | 29 | 30 | 3 | 12 | 35 | 2 |
| 2859 | 2817 | 40673 | 78.5 | TGCGCACGAAAGACCTAGCCGTCT | 29 | 30 | 6 | 23 | 36 | 19 |
| 2860 | 2818 | 9193 | 80.9 | TGCGCACGTCGTCACGGACCATAC | 29 | 30 | 10 | 30 | 32 | 5 |
| 2861 | 2819 | 40674 | 83.5 | TGCGCACGCTGTCCATCACGAGGA | 29 | 30 | 14 | 15 | 30 | 25 |
| 2862 | 2820 | 9198 | 78.4 | TGCGCACGGTCTAATCGTGCTGTC | 29 | 30 | 19 | 4 | 33 | 9 |
| 2863 | 2822 | 21632 | 76.2 | TGCGCACGCCTATTAGGAGTAGCC | 29 | 30 | 26 | 3 | 20 | 36 |
| 2864 | 2823 | 9201 | 83 | TGCGCACGGATGCTGTTCTGGTGC | 29 | 30 | 27 | 14 | 8 | 33 |
| 2865 | 2824 | 9202 | 82.8 | TGCGCACGTCCCACCTTCGTGATG | 29 | 30 | 28 | 23 | 10 | 27 |
| 2866 | 2825 | 9203 | 83.4 | TGCGCACGGACCAGTGTCGTCGAA | 29 | 30 | 32 | 22 | 10 | 16 |
| 2867 | 2826 | 9204 | 81.2 | TGCGCACGGGACTCGTGGTAGGAC | 29 | 30 | 34 | 10 | 18 | 34 |
| 2868 | 2827 | 9205 | 83.1 | TGCGCACGAGCCGTCTAGGAACGG | 29 | 30 | 36 | 19 | 25 | 35 |
| 2869 | 2828 | 40675 | 79.6 | TGCGCAGCTTGACAGCAGGAGCTT | 29 | 31 | 1 | 31 | 25 | 17 |
| 2870 | 2829 | 40676 | 76.9 | TGCGCAGCTGATTTAGCGAAGCTT | 29 | 31 | 2 | 3 | 16 | 17 |
| 2871 | 2830 | 40677 | 77.5 | TGCGCAGCTTAGGCTTAATCGCAA | 29 | 31 | 3 | 17 | 4 | 21 |
| 2872 | 2831 | 30652 | 79.2 | TGCGCAGCATACTCTGCAGCCTCA | 29 | 31 | 5 | 8 | 31 | 13 |
| 2873 | 2832 | 9210 | 80.3 | TGCGCAGCTCGTGTCTCAGCCCTA | 29 | 31 | 10 | 19 | 31 | 26 |
| 2874 | 2833 | 9211 | 78.6 | TGCGCAGCCCATTTAGGCTTATCG | 29 | 31 | 15 | 3 | 17 | 24 |
| 2875 | 2834 | 9212 | 80.4 | TGCGCAGCGGTACTCAACGGAGTG | 29 | 31 | 18 | 13 | 35 | 22 |
| 2876 | 2835 | 30653 | 81.1 | TGCGCAGCGAGTGCAAATACACGG | 29 | 31 | 20 | 21 | 5 | 35 |
| 2877 | 2836 | 9214 | 78.4 | TGCGCAGCATCGTTAGGGTATCCC | 29 | 31 | 24 | 3 | 18 | 28 |
| 2878 | 2837 | 9215 | 78.8 | TGCGCAGCCCTAGATGTCGTAGCC | 29 | 31 | 26 | 27 | 10 | 36 |
| 2879 | 2838 | 9216 | 80.7 | TGCGCAGCGATGATACCACGAGGA | 29 | 31 | 27 | 5 | 30 | 25 |
| 2880 | 2839 | 9217 | 83.8 | TGCGCAGCCAGCCAGCCCTACTCA | 29 | 31 | 31 | 31 | 26 | 13 |
| 2881 | 2840 | 15942 | 81.8 | TGCGCAGCGACCAAAGAAAGGCAA | 29 | 31 | 32 | 6 | 6 | 21 |
| 2882 | 2841 | 9219 | 82.1 | TGCGCAGCAGCCTCGTTCTGTCGT | 29 | 31 | 36 | 10 | 8 | 10 |
| 2883 | 2842 | 15943 | 77.7 | TGCGGACCTGATCGAATGTCGGTA | 29 | 32 | 2 | 16 | 9 | 18 |
| 2884 | 2844 | 9223 | 79.2 | TGCGGACCAATCAGGAGACCGATG | 29 | 32 | 4 | 25 | 32 | 27 |
| 2885 | 2845 | 9224 | 76.9 | TGCGGACCATACAATCTGCGGTCT | 29 | 32 | 5 | 4 | 29 | 19 |
| 2886 | 2846 | 21640 | 78.4 | TGCGGACCTACACTGTTCCCGGAC | 29 | 32 | 7 | 14 | 28 | 34 |
| 2887 | 2847 | 40680 | 78.3 | TGCGGACCTGTCTGATACGGGACC | 29 | 32 | 9 | 2 | 35 | 32 |
| 2888 | 2848 | 9226 | 80.1 | TGCGGACCCGTTGCAATTAGGGAC | 29 | 32 | 12 | 21 | 3 | 34 |
| 2889 | 2849 | 9229 | 79.9 | TGCGGACCCCATCTGTTCTGGCTT | 29 | 32 | 15 | 14 | 8 | 17 |
| 2890 | 2850 | 9230 | 81 | TGCGGACCCGAACTTGATCGGATG | 29 | 32 | 16 | 11 | 24 | 27 |
| 2891 | 2851 | 9231 | 80.2 | TGCGGACCGAGTCCATGTGCTGTC | 29 | 32 | 20 | 15 | 33 | 9 |
| 2892 | 2852 | 9232 | 77.4 | TGCGGACCAGGAAAAGGTCTTCGT | 29 | 32 | 25 | 6 | 19 | 10 |
| 2893 | 2853 | 9234 | 80.9 | TGCGGACCGATGTGTCAGTGACGG | 29 | 32 | 27 | 9 | 22 | 35 |
| 2894 | 2854 | 9235 | 81.1 | TGCGGACCCAGCTCGTCTTGCTGT | 29 | 32 | 31 | 10 | 11 | 14 |
| 2895 | 2855 | 9236 | 82.3 | TGCGGACCGACCGGTAGCAACCAT | 29 | 32 | 32 | 18 | 21 | 15 |
| 2896 | 2856 | 9237 | 80.7 | TGCGGACCACGGAAAGCCATGTCT | 29 | 32 | 35 | 6 | 15 | 19 |
| 2897 | 2857 | 30654 | 79 | TGCGGTGCAATCACGGCCTAGTCT | 29 | 33 | 4 | 35 | 26 | 19 |
| 2898 | 2858 | 9240 | 81.2 | TGCGGTGCAAAGCGTTCACGTCTG | 29 | 33 | 6 | 12 | 30 | 8 |
| 2899 | 2859 | 40685 | 79.9 | TGCGGTGCTGTCCCTATCCCGTCT | 29 | 33 | 9 | 26 | 28 | 19 |
| 2900 | 2860 | 21649 | 80.2 | TGCGGTGCCGTTATCGAAAGGACC | 29 | 33 | 12 | 24 | 6 | 32 |
| 2901 | 2862 | 9248 | 80 | TGCGGTGCACCTCCATCCATCTTG | 29 | 33 | 23 | 15 | 15 | 11 |
| 2902 | 2863 | 9251 | 82.6 | TGCGGTGCTCCCCTGTACGGAGGA | 29 | 33 | 28 | 14 | 35 | 25 |
| 2903 | 2864 | 9252 | 82.5 | TGCGGTGCAGCCCCTACCATGCTT | 29 | 33 | 36 | 26 | 15 | 17 |
| 2904 | 2865 | 9253 | 78 | TGCGGGACTTGAGTCTGTGCGGTA | 29 | 34 | 1 | 19 | 33 | 18 |
| 2905 | 2866 | 9254 | 77 | TGCGGGACTGATTTGACAGCCCTA | 29 | 34 | 2 | 1 | 31 | 26 |
| 2906 | 2867 | 40686 | 79 | TGCGGGACATACGCTTAGCCAGGA | 29 | 34 | 5 | 17 | 36 | 25 |
| 2907 | 2868 | 30655 | 77.5 | TGCGGGACAAAGTTAGCGTTGTGC | 29 | 34 | 6 | 3 | 12 | 33 |

FIG. 25FFF

| SEQ ID NO: | 4,633 ID# | HEX ID# | Tm | ZIPCODE (5'-3') | TETRAMER NUMBERS | | | | |
|---|---|---|---|---|---|---|---|---|---|
| 2908 | 2869 | 30656 | 78.3 | TGCGGGACTGTCTCTGAGCCCCTA | 29 | 34 | 9 | 8 | 36 | 26 |
| 2909 | 2870 | 30657 | 78.6 | TGCGGGACCTTGTTAGGAGTTGCG | 29 | 34 | 11 | 3 | 20 | 29 |
| 2910 | 2871 | 9259 | 79.8 | TGCGGGACCGTTGGTATCCCAATC | 29 | 34 | 12 | 18 | 28 | 4 |
| 2911 | 2872 | 40688 | 80.1 | TGCGGGACCTCAGACCACCTGCTT | 29 | 34 | 13 | 32 | 23 | 17 |
| 2912 | 2873 | 30658 | 78.4 | TGCGGGACCTGTAATCCGTTCAGC | 29 | 34 | 14 | 4 | 12 | 31 |
| 2913 | 2874 | 9262 | 81.3 | TGCGGGACCGAACGTTCTCAGTGC | 29 | 34 | 16 | 12 | 13 | 33 |
| 2914 | 2875 | 9263 | 79.5 | TGCGGGACGCTTGCTTATACTGCG | 29 | 34 | 17 | 17 | 5 | 29 |
| 2915 | 2877 | 9265 | 77.5 | TGCGGGACGTCTACCTGCTTGATG | 29 | 34 | 19 | 23 | 17 | 27 |
| 2916 | 2878 | 9266 | 78 | TGCGGGACAGTGACGGACCTACCT | 29 | 34 | 22 | 35 | 23 | 23 |
| 2917 | 2879 | 9267 | 82.5 | TGCGGGACATCGCTCATCGTCGAA | 29 | 34 | 24 | 13 | 10 | 16 |
| 2918 | 2880 | 15946 | 77.4 | TGCGGGACCCTATACAGCAATCCC | 29 | 34 | 26 | 7 | 21 | 28 |
| 2919 | 2881 | 9270 | 82.8 | TGCGGGACGATGGTGCGATGAGTG | 29 | 34 | 27 | 33 | 27 | 22 |
| 2920 | 2882 | 9271 | 82 | TGCGGGACTGCGTGTCCCATTCTG | 29 | 34 | 29 | 9 | 15 | 8 |
| 2921 | 2883 | 15947 | 80.8 | TGCGGGACAGCCATACGCAAGCTT | 29 | 34 | 36 | 5 | 21 | 17 |
| 2922 | 2884 | 30659 | 77.6 | TGCGACGGTTAGGCTTTCTGGCTT | 29 | 35 | 3 | 17 | 8 | 17 |
| 2923 | 2885 | 30660 | 79.9 | TGCGACGGAATCAATCATCGACGG | 29 | 35 | 4 | 4 | 24 | 35 |
| 2924 | 2887 | 40691 | 79.1 | TGCGACGGTCTGCGAATTAGCGTT | 29 | 35 | 8 | 16 | 3 | 12 |
| 2925 | 2888 | 9277 | 80.3 | TGCGACGGCTCATTGAAGTGGTGC | 29 | 35 | 13 | 1 | 22 | 33 |
| 2926 | 2889 | 9278 | 80.2 | TGCGACGGCTGTCCATACCTGTGC | 29 | 35 | 14 | 15 | 23 | 33 |
| 2927 | 2890 | 9279 | 77.9 | TGCGACGGGTCTCTTGGAGTAGCC | 29 | 35 | 19 | 11 | 20 | 36 |
| 2928 | 2891 | 30661 | 77.5 | TGCGACGGGAGTCGTTAAAGGCTT | 29 | 35 | 20 | 12 | 6 | 17 |
| 2929 | 2892 | 40692 | 79.9 | TGCGACGGAGTGACCTCACGCCTA | 29 | 35 | 22 | 23 | 30 | 26 |
| 2930 | 2893 | 40693 | 80.9 | TGCGACGGAGGATGTCGGACTCGT | 29 | 35 | 25 | 9 | 34 | 10 |
| 2931 | 2894 | 9282 | 82.8 | TGCGACGGGATGGTGCTGTCATCG | 29 | 35 | 27 | 33 | 9 | 24 |
| 2932 | 2895 | 9284 | 83 | TGCGACGGGTGCGGTAAGGAGTGC | 29 | 35 | 33 | 18 | 25 | 33 |
| 2933 | 2896 | 9285 | 81.8 | TGCGACGGGGACGCTTAGCCTGAT | 29 | 35 | 34 | 17 | 36 | 2 |
| 2934 | 2897 | 9286 | 78.6 | TGCGAGCCTTGATGTCTCTGTGCG | 29 | 36 | 1 | 9 | 8 | 29 |
| 2935 | 2898 | 40694 | 78.8 | TGCGAGCCTGATTCTGGCAAGACC | 29 | 36 | 2 | 8 | 21 | 32 |
| 2936 | 2899 | 9288 | 77.1 | TGCGAGCCTTAGGCAATCTGCTTG | 29 | 36 | 3 | 21 | 8 | 11 |
| 2937 | 2900 | 9289 | 78.5 | TGCGAGCCAAAGGGACATACCAGC | 29 | 36 | 6 | 34 | 5 | 31 |
| 2938 | 2901 | 40696 | 76.5 | TGCGAGCCTACAAAAGGTGCCTGT | 29 | 36 | 7 | 6 | 33 | 14 |
| 2939 | 2902 | 9290 | 79.5 | TGCGAGCCTGTCGACCTACAACGG | 29 | 36 | 9 | 32 | 7 | 35 |
| 2940 | 2903 | 40697 | 80.1 | TGCGAGCCCTCAGGTAGGACCGAA | 29 | 36 | 13 | 18 | 34 | 16 |
| 2941 | 2905 | 9293 | 80.2 | TGCGAGCCCCATGGTAAGCCAATC | 29 | 36 | 15 | 18 | 36 | 4 |
| 2942 | 2906 | 21669 | 80.9 | TGCGAGCCGGTATGTCAGCCTCGT | 29 | 36 | 18 | 9 | 36 | 10 |
| 2943 | 2907 | 40701 | 80.7 | TGCGAGCCAGGAGATGCGAAGACC | 29 | 36 | 25 | 27 | 16 | 32 |
| 2944 | 2908 | 9296 | 78.4 | TGCGAGCCCCTATCTGAGCCTTGA | 29 | 36 | 26 | 8 | 36 | 1 |
| 2945 | 2909 | 9297 | 82.9 | TGCGAGCCTCCCGCTTGATGCTGT | 29 | 36 | 28 | 17 | 27 | 14 |
| 2946 | 2910 | 9298 | 81.9 | TGCGAGCCCACGTGTCGCTTCTGT | 29 | 36 | 30 | 9 | 17 | 14 |
| 2947 | 2911 | 15948 | 83.7 | TGCGAGCCCAGCCAGCGTCTTTGA | 29 | 36 | 31 | 31 | 19 | 1 |
| 2948 | 2912 | 9300 | 81.2 | TGCGAGCCGGACTCGTGCTTGAGT | 29 | 36 | 34 | 10 | 17 | 20 |
| 2949 | 2913 | 9301 | 83.7 | TGCGAGCCACGGCAGCTGATCGTT | 29 | 36 | 35 | 31 | 2 | 12 |
| 2950 | 2914 | 9302 | 83.7 | TGCGAGCCAGCCGATGGGTACACG | 29 | 36 | 36 | 27 | 18 | 30 |
| 2951 | 2915 | 9304 | 79.9 | CACGTTGACCATTGCGCCATTCGT | 30 | 1 | 15 | 29 | 15 | 10 |
| 2952 | 2916 | 9305 | 78 | CACGTTGAGCAAACGGAAAGTGCG | 30 | 1 | 21 | 35 | 6 | 29 |
| 2953 | 2917 | 9307 | 80 | CACGTTGAATCGCACGGACCCTCA | 30 | 1 | 24 | 30 | 32 | 13 |
| 2954 | 2918 | 9311 | 79 | CACGTTGATTCGTGTGCCGTTCGAA | 30 | 2 | 10 | 33 | 12 | 16 |
| 2955 | 2919 | 30662 | 78.1 | CACGTTGATTCCCAATCGCAAGCAA | 30 | 2 | 28 | 4 | 21 | 21 |
| 2956 | 2920 | 9314 | 81.6 | CACGTTGATGTGCCCATTCCCCGAA | 30 | 2 | 33 | 15 | 28 | 16 |
| 2957 | 2921 | 15953 | 76.8 | CACGTTAGCACGGCAAAGTGGCTT | 30 | 3 | 30 | 21 | 22 | 17 |
| 2958 | 2922 | 9332 | 79.5 | CACGAATCCACGGACCACGGAGTG | 30 | 4 | 30 | 32 | 35 | 22 |

FIG. 25GGG

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 2959 | 2923 | 30663 | 77.4 | CACGATACGCAAAAAGACGGGCAA | 30 | 5 | 21 | 6 | 35 | 21 |
| 2960 | 2924 | 40704 | 78.4 | CACGATACTGCGTCTGACGGCGAA | 30 | 5 | 29 | 8 | 35 | 16 |
| 2961 | 2925 | 15961 | 78 | CACGATACACGGACGGAGGAAGCC | 30 | 5 | 35 | 35 | 25 | 36 |
| 2962 | 2926 | 9345 | 77.2 | CACGAAAGCTGTGGACCGAAGTGC | 30 | 6 | 14 | 34 | 16 | 33 |
| 2963 | 2927 | 15965 | 77.1 | CACGAAAGGGTAATCGCTTGTGCG | 30 | 6 | 18 | 24 | 11 | 29 |
| 2964 | 2928 | 30664 | 77.5 | CACGAAAGCCTAAGTGCACGCAGC | 30 | 6 | 26 | 22 | 30 | 31 |
| 2965 | 2929 | 9354 | 76 | CACGAAAGTGCGATACACCTTGCG | 30 | 6 | 29 | 5 | 23 | 29 |
| 2966 | 2930 | 9355 | 76.8 | CACGAAAGGTGCAAAGAGCCCTCA | 30 | 6 | 33 | 6 | 36 | 13 |
| 2967 | 2931 | 30665 | 79.8 | CACGAAAGGGACACCTGTGCTGCG | 30 | 6 | 34 | 23 | 33 | 29 |
| 2968 | 2932 | 30666 | 75 | CACGTCTGCGTTATACTGCGGCTT | 30 | 8 | 12 | 5 | 29 | 17 |
| 2969 | 2933 | 15972 | 78.6 | CACGTCTGTGCGTGATACGGGTGC | 30 | 8 | 29 | 2 | 35 | 33 |
| 2970 | 2934 | 9366 | 78.1 | CACGTCTGCACGGCTTAAAGCACG | 30 | 8 | 30 | 17 | 6 | 30 |
| 2971 | 2935 | 9367 | 77.6 | CACGTCTGCAGCATCGACCTTCGT | 30 | 8 | 31 | 24 | 23 | 10 |
| 2972 | 2936 | 40705 | 80.8 | CACGTCTGGACCCTTGGACCTGCG | 30 | 8 | 32 | 11 | 32 | 29 |
| 2973 | 2937 | 30667 | 76.1 | CACGTGTCCGTTAGGAGCAATCCC | 30 | 9 | 12 | 25 | 21 | 28 |
| 2974 | 2938 | 9376 | 81.4 | CACGTGTCGACCGATGGACCGGAC | 30 | 9 | 32 | 27 | 32 | 34 |
| 2975 | 2939 | 9379 | 80.9 | CACGTGTCAGCCGATGGCAACGAA | 30 | 9 | 36 | 27 | 21 | 16 |
| 2976 | 2940 | 9382 | 79.7 | CACGTCGTTCTGCGTTACGGACGG | 30 | 10 | 8 | 12 | 35 | 35 |
| 2977 | 2941 | 15975 | 77.8 | CACGTCGTTCGTCCATCGAAGTGC | 30 | 10 | 10 | 15 | 16 | 33 |
| 2978 | 2942 | 40706 | 77 | CACGTCGTCCATAAAGAGCCCACG | 30 | 10 | 15 | 6 | 36 | 30 |
| 2979 | 2943 | 9387 | 77.2 | CACGTCGTACCTGTCTTGCGAGCC | 30 | 10 | 23 | 19 | 29 | 36 |
| 2980 | 2944 | 9394 | 81.5 | CACGTCGTGGACGCAAGATGCACG | 30 | 10 | 34 | 21 | 27 | 30 |
| 2981 | 2945 | 9397 | 81.5 | CACGCTTGTGTCGGACCGAAACGG | 30 | 11 | 9 | 34 | 16 | 35 |
| 2982 | 2946 | 9404 | 78 | CACGCTTGAGTGAGTGGTGCGGAC | 30 | 11 | 22 | 22 | 33 | 34 |
| 2983 | 2947 | 30668 | 77.7 | CACGCTTGACCTCGTTAGCCCCAT | 30 | 11 | 23 | 12 | 36 | 15 |
| 2984 | 2948 | 21698 | 78.3 | CACGCTTGTCCCTCGTTGATGCAA | 30 | 11 | 28 | 10 | 2 | 21 |
| 2985 | 2949 | 9409 | 77.9 | CACGCTTGAGCCTCTGACCTGCAA | 30 | 11 | 36 | 8 | 23 | 21 |
| 2986 | 2950 | 30669 | 78.7 | CACGCGTTTACAAGGACACGCACG | 30 | 12 | 7 | 25 | 30 | 30 |
| 2987 | 2951 | 9414 | 78 | CACGCGTTTGTCGCTTAATCGTGC | 30 | 12 | 9 | 17 | 4 | 33 |
| 2988 | 2952 | 15981 | 79 | CACGCGTTTCGTGATGCGAATTGA | 30 | 12 | 10 | 27 | 16 | 1 |
| 2989 | 2953 | 9416 | 77.5 | CACGCGTTCTTGCGTTCGTTTGAT | 30 | 12 | 11 | 12 | 12 | 2 |
| 2990 | 2954 | 9418 | 76.9 | CACGCGTTCGAAGTGCGTCTACCT | 30 | 12 | 16 | 33 | 19 | 23 |
| 2991 | 2955 | 9420 | 76.7 | CACGCGTTGTCTTTAGTGCGCTCA | 30 | 12 | 19 | 3 | 29 | 13 |
| 2992 | 2956 | 9421 | 79.2 | CACGCGTTGCAAGCAATGTCCTCA | 30 | 12 | 21 | 21 | 9 | 13 |
| 2993 | 2957 | 40710 | 76.9 | CACGCGTTCCTATGATGACCCAGC | 30 | 12 | 26 | 2 | 32 | 31 |
| 2994 | 2958 | 9425 | 78.9 | CACGCGTTGATGCTCAAGGATCCC | 30 | 12 | 27 | 13 | 25 | 28 |
| 2995 | 2959 | 15985 | 78.1 | CACGCGTTTCCCTGATAGCCCTTG | 30 | 12 | 28 | 2 | 36 | 11 |
| 2996 | 2960 | 30670 | 80.3 | CACGCGTTAGCCCACGTCCCTGAT | 30 | 12 | 36 | 30 | 28 | 2 |
| 2997 | 2961 | 21702 | 81.6 | CACGCTCAAATCAGCCCACGGTGC | 30 | 13 | 4 | 36 | 30 | 33 |
| 2998 | 2962 | 40712 | 78 | CACGCTCACGAAAAGCCATGTGC | 30 | 13 | 16 | 6 | 15 | 33 |
| 2999 | 2963 | 9436 | 77.9 | CACGCTCAGGTAATCGATCGCACG | 30 | 13 | 18 | 24 | 24 | 30 |
| 3000 | 2964 | 9439 | 78 | CACGCTCATCCCCATCCATTGAT | 30 | 13 | 28 | 15 | 15 | 2 |
| 3001 | 2965 | 40714 | 77.3 | CACGCTGTATCGACCTCAGCCAGC | 30 | 14 | 24 | 23 | 31 | 31 |
| 3002 | 2966 | 9454 | 80.5 | CACGCTGTTGCGCTCAAGGACGAA | 30 | 14 | 29 | 13 | 25 | 16 |
| 3003 | 2967 | 30672 | 78 | CACGCCATTACAACCTCAGCTGCG | 30 | 15 | 7 | 23 | 31 | 29 |
| 3004 | 2968 | 30673 | 80.2 | CACGCCATTCTGCTTGGTGCAGGA | 30 | 15 | 8 | 11 | 33 | 25 |
| 3005 | 2969 | 9462 | 79.2 | CACGCCATTCGTTCTGGGACAGGA | 30 | 15 | 10 | 8 | 34 | 25 |
| 3006 | 2970 | 15993 | 77.4 | CACGCCATCTTGAATCCACGCCTA | 30 | 15 | 11 | 4 | 30 | 26 |
| 3007 | 2971 | 15994 | 77.1 | CACGCCATCCATCGTTGGTACGTT | 30 | 15 | 15 | 12 | 18 | 12 |
| 3008 | 2972 | 30674 | 77.5 | CACGCCATGGTAAGGAACGGACCT | 30 | 15 | 18 | 25 | 35 | 23 |
| 3009 | 2973 | 15996 | 79.3 | CACGCCATGTCTCAGCTGTCGCAA | 30 | 15 | 19 | 31 | 9 | 21 |

FIG. 25HHH

```
SEQ    4,633  HEX             ZIPCODE (5'-3')         TETRAMER NUMBERS
ID NO: ID#    ID#    Tm
3010   2974   9468   78.5  CACGCCATGAGTGTGCGCTTCTGT  30  15  20  33  17  14
3011   2975   9469   76.8  CACGCCATAGTGTGTCTCCCGACC  30  15  22   9  28  32
3012   2976   15997  76.5  CACGCCATAGGACGTTACGGTCGT  30  15  25  12  35  10
3013   2977   9473   81.8  CACGCCATTGCGGCTTCAGCTGTC  30  15  29  17  31   9
3014   2978   15999  80.9  CACGCCATCACGCTCAGGACTCCC  30  15  30  13  34  28
3015   2979   30675  78.1  CACGCCATGACCTACATGCGCCTA  30  15  32   7  29  26
3016   2980   9477   77.1  CACGCCATACGGAGTGAGCCAAAG  30  15  35  22  36   6
3017   2981   40717  78.1  CACGCGAATTGACGTTGCTTCAGC  30  16   1  12  17  31
3018   2982   16001  78.7  CACGCGAAAATCGAGTCACGGCTT  30  16   4  20  30  17
3019   2983   40720  77.3  CACGCGAATCTGAATCCTTGCAGC  30  16   8   4  11  31
3020   2984   40722  76.9  CACGCGAACTTGTTGAGGACGCTT  30  16  11   1  34  17
3021   2985   30677  78.1  CACGCGAACTGTCAGCCCTATCCC  30  16  14  31  26  28
3022   2986   9483   76.9  CACGCGAAGCTTCCATTCGTCTGT  30  16  17  15  10  14
3023   2987   9484   75.9  CACGCGAAGGTACTCATCCCGTCT  30  16  18  13  28  19
3024   2988   9485   77.2  CACGCGAAGTCTTCCCGATGTCTG  30  16  19  28  27   8
3025   2989   16003  76.6  CACGCGAAGCAACGAAATACCCAT  30  16  21  16   5  15
3026   2990   40723  76.4  CACGCGAAGATGTTAGAGCCGACC  30  16  27   3  36  32
3027   2991   9490   80.1  CACGCGAATCCCGGTACGAACGTT  30  16  28  18  16  12
3028   2992   9491   82.3  CACGCGAATGCGGATGCTTGGATG  30  16  29  27  11  27
3029   2993   9495   75.2  CACGGCTTTTAGTGATGGACTGCG  30  17   3   2  34  29
3030   2994   9498   78.1  CACGGCTTTCGTGTCTGCTTCACG  30  17  10  19  17  30
3031   2995   9503   78.9  CACGGCTTGCAAGCAACTGTGTGC  30  17  21  21  14  33
3032   2996   40725  79.1  CACGGCTTATCGGTGCGCTTTCTG  30  17  24  33  17   8
3033   2997   9510   80.8  CACGGCTTTCCCGTGCCTGTCTTG  30  17  28  33  14  11
3034   2998   9513   78.6  CACGGCTTGGACCTGTTGTCGCTT  30  17  34  14   9  17
3035   2999   40726  78.1  CACGGCTTAGCCCCATAGGATCCC  30  17  36  15  25  28
3036   3000   9516   78.5  CACGGGTATGATCAGCGATGCACG  30  18   2  31  27  30
3037   3001   40727  77.4  CACGGGTATCGTGCTTCAGCGGTA  30  18  10  17  31  18
3038   3002   16011  78.4  CACGGGTACCATGTCTGTGCGTGC  30  18  15  19  33  33
3039   3003   40728  75.5  CACGGGTAGCTTAAAGTCCCGTGC  30  18  17   6  28  33
3040   3004   9527   76.1  CACGGGTAGCAAAGTGATCGTCCC  30  18  21  22  24  28
3041   3005   30679  76.4  CACGGGTAAGGACACGTCGTCGTT  30  18  25  30  10  12
3042   3006   9530   81.5  CACGGGTAGATGTGCGTCCCTGCG  30  18  27  29  28  29
3043   3007   30680  80.3  CACGGGTAGACCAGCCGCAATCGT  30  18  32  36  21  10
3044   3008   9532   75.6  CACGGGTAGGACAAAGGGACGGTA  30  18  34   6  34  18
3045   3009   9533   77.8  CACGGTCTTGATCACGGCAAGTGC  30  19   2  30  21  33
3046   3010   9534   77.8  CACGGTCTTCTGTGCGCCATTGTC  30  19   8  29  15   9
3047   3011   30681  78    CACGGTCTGCAAGGTATCCCAGCC  30  19  21  18  28  36
3048   3012   9540   79.5  CACGGTCTTGCGCACGACCTCCTA  30  19  29  30  23  26
3049   3013   9542   75.8  CACGGTCTACGGTTGAAGCCCTGT  30  19  35   1  36  14
3050   3014   9545   80.4  CACGGAGTTGATCAGCTGCGGCAA  30  20   2  31  29  21
3051   3015   9546   75.9  CACGGAGTTCGTTTAGCAGCCCAT  30  20  10   3  31  15
3052   3016   9549   75.1  CACGGAGTGCTTACGGCACGATAC  30  20  17  35  30   5
3053   3017   9550   78    CACGGAGTAGGAGACCGTGCGCTT  30  20  25  32  33  17
3054   3019   21741  79.8  CACGGAGTAGCCGGACCAGCGAGT  30  20  36  34  31  20
3055   3020   9554   75.8  CACGGCAATTGATCTGCCTACACG  30  21   1   8  26  30
3056   3022   21742  77.3  CACGGCAATGTCACGGAAAGTCGT  30  21   9  35   6  10
3057   3023   16021  76.8  CACGGCAACTTGAATCATCGGACC  30  21  11   4  24  32
3058   3024   9561   75.4  CACGGCAAGGTACTCAGACCTCCC  30  21  18  13  32  28
3059   3025   30684  76.7  CACGGCAACCTAAGGAATCGCTCA  30  21  26  25  24  13
3060   3026   40732  77.4  CACGGCAAGATGTTGAGACCCGAA  30  21  27   1  32  16
```

FIG. 25III

| SEQ ID NO: | 4,633 ID# | HEX ID# | Tm | ZIPCODE (5'-3') | T3TRAMER NUMBERS | | | | | |
|---|---|---|---|---|---|---|---|---|---|---|
| 3061 | 3027 | 9568 | 78.5 | CACGGCAATCCCCCTACGAAACCT | 30 | 21 | 28 | 26 | 16 | 23 |
| 3062 | 3028 | 9569 | 81 | CACGGCAATGCGTCTGCACGTGAT | 30 | 21 | 29 | 8 | 30 | 2 |
| 3063 | 3029 | 9570 | 81.4 | CACGGCAACACGGTGCATCGTCTG | 30 | 21 | 30 | 33 | 24 | 8 |
| 3064 | 3030 | 30685 | 76.5 | CACGAGTGGCTTATCGCGTTAGCC | 30 | 22 | 17 | 24 | 12 | 36 |
| 3065 | 3031 | 9578 | 79.9 | CACGAGTGGATGAGGATGCGCAGC | 30 | 22 | 27 | 25 | 29 | 31 |
| 3066 | 3032 | 16024 | 80.5 | CACGAGTGTCCCGCAACCATTCCC | 30 | 22 | 28 | 21 | 15 | 28 |
| 3067 | 3033 | 40735 | 79.6 | CACGAGTGGACCAATCCAGCCACG | 30 | 22 | 32 | 4 | 31 | 30 |
| 3068 | 3034 | 9585 | 77.7 | CACGACCTTGATGGACCGAATCCC | 30 | 23 | 2 | 34 | 16 | 28 |
| 3069 | 3035 | 9586 | 81 | CACGACCTTCTGCGAAACGGCAGC | 30 | 23 | 8 | 16 | 35 | 31 |
| 3070 | 3036 | 9587 | 78 | CACGACCTTCGTGCAAAGCCAGTG | 30 | 23 | 10 | 21 | 36 | 22 |
| 3071 | 3037 | 30686 | 78.7 | CACGACCTCCATATCGGACCGTGC | 30 | 23 | 15 | 24 | 32 | 33 |
| 3072 | 3038 | 16026 | 81.5 | CACGACCTATCGTGCGTGCGGGAC | 30 | 23 | 24 | 29 | 29 | 34 |
| 3073 | 3039 | 9593 | 79.6 | CACGACCTGATGTGCGGACCCTTG | 30 | 23 | 27 | 29 | 32 | 11 |
| 3074 | 3040 | 9597 | 79.8 | CACGACCTGGACGGTACACGCAGC | 30 | 23 | 34 | 18 | 30 | 31 |
| 3075 | 3041 | 9600 | 78.3 | CACGATCGAATCACGGGACCGTCT | 30 | 24 | 4 | 35 | 32 | 19 |
| 3076 | 3042 | 9604 | 75.5 | CACGATCGCTGTAGTGATCGCCAT | 30 | 24 | 14 | 22 | 24 | 15 |
| 3077 | 3043 | 30687 | 75.7 | CACGATCGGGTATACAACGGTCCC | 30 | 24 | 18 | 7 | 35 | 28 |
| 3078 | 3044 | 40739 | 78.4 | CACGATCGGTCTCTTGTCCCCGAA | 30 | 24 | 19 | 11 | 28 | 16 |
| 3079 | 3046 | 9609 | 81.2 | CACGATCGAGTGCCATCAGCGCAA | 30 | 24 | 22 | 15 | 31 | 21 |
| 3080 | 3047 | 9610 | 76.9 | CACGATCGACCTCGAAACGGTGTC | 30 | 24 | 23 | 16 | 35 | 9 |
| 3081 | 3048 | 16031 | 80.5 | CACGATCGAGCCGATGAGCCACCT | 30 | 24 | 36 | 27 | 36 | 23 |
| 3082 | 3049 | 9619 | 76.9 | CACGAGGAAAAGGCAATCCCGAGT | 30 | 25 | 6 | 21 | 28 | 20 |
| 3083 | 3050 | 9620 | 76.7 | CACGAGGATCGTCTTGACGGCTGT | 30 | 25 | 10 | 11 | 35 | 14 |
| 3084 | 3051 | 9621 | 77.3 | CACGAGGACTTGTGCGCTCAGACC | 30 | 25 | 11 | 29 | 13 | 32 |
| 3085 | 3052 | 30688 | 81.6 | CACGAGGACCATTCCCCAGCGACC | 30 | 25 | 15 | 28 | 31 | 32 |
| 3086 | 3054 | 9627 | 76.1 | CACGAGGAACCTTGCGAAAGCTGT | 30 | 25 | 23 | 29 | 6 | 14 |
| 3087 | 3055 | 9631 | 78.4 | CACGAGGACACGGCTTCTCAAGCC | 30 | 25 | 30 | 17 | 13 | 36 |
| 3088 | 3056 | 16035 | 80.4 | CACGAGGACAGCGCTTCAGCTCCC | 30 | 25 | 31 | 17 | 31 | 28 |
| 3089 | 3058 | 9634 | 77.6 | CACGAGGAGGACAGTGGACCCGTT | 30 | 25 | 34 | 22 | 32 | 12 |
| 3090 | 3059 | 30689 | 77.8 | CACGAGGAAGCCTTGAACGGTCGT | 30 | 25 | 36 | 1 | 35 | 10 |
| 3091 | 3060 | 9640 | 78.7 | CACGCCTAAATCGACCATCGGTGC | 30 | 26 | 4 | 32 | 24 | 33 |
| 3092 | 3061 | 30691 | 75.6 | CACGCCTAGCTTCGTTAGCCTCGT | 30 | 26 | 17 | 12 | 36 | 10 |
| 3093 | 3062 | 30692 | 77.7 | CACGCCTAATCGTGCGTCTGCTGT | 30 | 26 | 24 | 29 | 8 | 14 |
| 3094 | 3063 | 9650 | 77.1 | CACGCCTAGATGGGTACAGCGTGC | 30 | 26 | 27 | 18 | 31 | 33 |
| 3095 | 3064 | 30693 | 78.5 | CACGGATGTCGTCTTGGGACGCTT | 30 | 27 | 10 | 11 | 34 | 17 |
| 3096 | 3065 | 40744 | 78.1 | CACGGATGCTTGTCCCCCATTGAT | 30 | 27 | 11 | 28 | 15 | 2 |
| 3097 | 3066 | 9660 | 76.6 | CACGGATGCTCAGCTTTGTCCCAT | 30 | 27 | 13 | 17 | 9 | 15 |
| 3098 | 3067 | 9663 | 75.5 | CACGGATGGGTATCGTAGCCCTGT | 30 | 27 | 18 | 10 | 36 | 14 |
| 3099 | 3068 | 30694 | 77.4 | CACGGATGGAGTCAGCCCTAAGCC | 30 | 27 | 20 | 31 | 26 | 36 |
| 3100 | 3069 | 9671 | 81.6 | CACGGATGCAGCGACCAGTGGGAC | 30 | 27 | 31 | 32 | 22 | 34 |
| 3101 | 3070 | 9672 | 80.3 | CACGGATGGTGCCGTTCACGTGTC | 30 | 27 | 33 | 12 | 30 | 9 |
| 3102 | 3071 | 9676 | 80.4 | CACGTCCCAATCGTGCGCAATCTG | 30 | 28 | 4 | 33 | 21 | 8 |
| 3103 | 3072 | 16048 | 80.5 | CACGTCCCTCTGGTGCAGCCACCT | 30 | 28 | 8 | 33 | 36 | 23 |
| 3104 | 3073 | 21776 | 75.4 | CACGTCCCGCTTGGTAGGTAGCC | 30 | 28 | 17 | 18 | 18 | 32 |
| 3105 | 3074 | 30695 | 77.9 | CACGTCCCGGTAGCTTGATGGGAC | 30 | 28 | 18 | 17 | 27 | 34 |
| 3106 | 3075 | 9686 | 80.1 | CACGTCCCTGCGGGTACTTGCCAT | 30 | 28 | 29 | 18 | 11 | 15 |
| 3107 | 3076 | 21783 | 77.6 | CACGTCCCACGGTGATCTCAATCG | 30 | 28 | 35 | 2 | 13 | 24 |
| 3108 | 3077 | 21785 | 78.7 | CACGTGCGTTGAAGTGCGTTGACC | 30 | 29 | 1 | 22 | 12 | 32 |
| 3109 | 3078 | 16052 | 79.2 | CACGTGCGATACACGGGGACGAGT | 30 | 29 | 5 | 35 | 34 | 20 |
| 3110 | 3079 | 30696 | 78.1 | CACGTGCGTACATCCCAGGACGAA | 30 | 29 | 7 | 28 | 25 | 16 |
| 3111 | 3080 | 30697 | 81 | CACGTGCGTCTGCGTTTCTGCAGC | 30 | 29 | 8 | 12 | 8 | 31 |

FIG. 25JJJ

| SEQ ID NO: | 4,633 ID# | H3X ID# | Tm | ZIPCODE (5'-3') | TETRAMER NUMBERS | | | | |
|---|---|---|---|---|---|---|---|---|---|
| 3112 | 3081 | 21787 | 76.4 | CACGTGCGTGTCTCGTTCGTCCTA | 30 | 29 | 9 | 10 | 10 | 26 |
| 3113 | 3082 | 21789 | 79 | CACGTGCGGCTTCCTATCTGGTGC | 30 | 29 | 17 | 26 | 8 | 33 |
| 3114 | 3083 | 9697 | 78.7 | CACGTGCGGGTAAGTGCACGAGTG | 30 | 29 | 18 | 22 | 30 | 22 |
| 3115 | 3084 | 9699 | 78.8 | CACGTGCGGAGTCGTTGAGTCACG | 30 | 29 | 20 | 12 | 20 | 30 |
| 3116 | 3085 | 9700 | 79.8 | CACGTGCGGCAAGGTACAGCCTTG | 30 | 29 | 21 | 18 | 31 | 11 |
| 3117 | 3086 | 9701 | 80.5 | CACGTGCGAGTGCCATGACCCTTG | 30 | 29 | 22 | 15 | 32 | 11 |
| 3118 | 3087 | 30698 | 78.8 | CACGTGCGATCGAAAGAGCCTCGT | 30 | 29 | 24 | 6 | 36 | 10 |
| 3119 | 3088 | 40756 | 80.6 | CACGTGCGCCTACTGTGACCACGG | 30 | 29 | 26 | 14 | 32 | 35 |
| 3120 | 3089 | 30700 | 83.8 | CACGTGCGTGCGGCAATACATGCG | 30 | 29 | 29 | 21 | 7 | 29 |
| 3121 | 3090 | 9705 | 79.9 | CACGTGCGACGGCCTAAAAGTCCC | 30 | 29 | 35 | 26 | 6 | 28 |
| 3122 | 3091 | 9706 | 76.5 | CACGCACGTTGAAATCTCCCTGT | 30 | 30 | 1 | 4 | 28 | 14 |
| 3123 | 3092 | 9709 | 79.8 | CACGCACGTCTGGCTTCAGCGTCT | 30 | 30 | 8 | 17 | 31 | 19 |
| 3124 | 3093 | 40757 | 80.4 | CACGCACGTCGTCTCATGCGGAGT | 30 | 30 | 10 | 13 | 29 | 20 |
| 3125 | 3094 | 9713 | 76.1 | CACGCACGCCATAAAGAAAGGCTT | 30 | 30 | 15 | 6 | 6 | 17 |
| 3126 | 3095 | 40759 | 78.7 | CACGCACGGTCTTACACGTTTGCG | 30 | 30 | 19 | 7 | 12 | 29 |
| 3127 | 3096 | 9716 | 81.2 | CACGCACGATCGCAGCAATCAGGA | 30 | 30 | 24 | 31 | 4 | 25 |
| 3128 | 3097 | 9718 | 82.1 | CACGCACGCAGCCGAAGAGTCAGC | 30 | 30 | 31 | 16 | 20 | 31 |
| 3129 | 3098 | 9719 | 82 | CACGCACGGACCGACCGTCTTTGA | 30 | 30 | 32 | 32 | 19 | 1 |
| 3130 | 3099 | 30701 | 81.8 | CACGCAGCTTAGCACGGTGCGACC | 30 | 31 | 3 | 30 | 33 | 32 |
| 3131 | 3100 | 16054 | 80.4 | CACGCAGCTCTGCAGCCCATGGTA | 30 | 31 | 8 | 31 | 15 | 18 |
| 3132 | 3101 | 9724 | 77.5 | CACGCAGCCTTGGGTAAAAGAGCC | 30 | 31 | 11 | 18 | 6 | 36 |
| 3133 | 3102 | 40763 | 78.9 | CACGCAGCCTCAACGGACGGATAC | 30 | 31 | 13 | 35 | 35 | 5 |
| 3134 | 3104 | 30702 | 78.4 | CACGCAGCGGTACGTTATCGCTCA | 30 | 31 | 18 | 12 | 24 | 13 |
| 3135 | 3105 | 9729 | 79.6 | CACGCAGCGTCTGAGTTCCCCTCA | 30 | 31 | 19 | 20 | 28 | 13 |
| 3136 | 3106 | 9732 | 77.9 | CACGCAGCACCTTTGATCGTACGG | 30 | 31 | 23 | 1 | 10 | 35 |
| 3137 | 3107 | 9733 | 78.7 | CACGCAGCATCGCCTAGACCCCTA | 30 | 31 | 24 | 26 | 32 | 26 |
| 3138 | 3108 | 9734 | 79.7 | CACGCAGCGATGGGTAGACCGATG | 30 | 31 | 27 | 18 | 32 | 27 |
| 3139 | 3109 | 9735 | 81.8 | CACGCAGCTCCCCTTGGTGCAGTG | 30 | 31 | 28 | 11 | 33 | 22 |
| 3140 | 3110 | 40766 | 78.8 | CACGGACCAATCTGCGACCTACGG | 30 | 32 | 4 | 29 | 23 | 35 |
| 3141 | 3111 | 16056 | 79.8 | CACGGACCTCTGCGTTCACGATCG | 30 | 32 | 8 | 12 | 30 | 24 |
| 3142 | 3112 | 30703 | 80.9 | CACGGACCCCATGATGGTGCGTCT | 30 | 32 | 15 | 27 | 33 | 19 |
| 3143 | 3113 | 9749 | 79.5 | CACGGACCGCAATCGTCTTGGATG | 30 | 32 | 21 | 10 | 11 | 27 |
| 3144 | 3114 | 9750 | 76.6 | CACGGACCATCGAATCCGAATGTC | 30 | 32 | 24 | 4 | 16 | 9 |
| 3145 | 3115 | 9751 | 76.9 | CACGGACCAGGAGGTATGTCTGCG | 30 | 32 | 25 | 18 | 9 | 29 |
| 3146 | 3116 | 40770 | 77.2 | CACGGACCGATGTTAGCCATCGAA | 30 | 32 | 27 | 3 | 15 | 16 |
| 3147 | 3117 | 16058 | 78.9 | CACGGTGCTTAGACGGGTGCCTTG | 30 | 33 | 3 | 35 | 33 | 11 |
| 3148 | 3118 | 9758 | 79.9 | CACGGTGCAATCCCATCACGCTGT | 30 | 33 | 4 | 15 | 30 | 14 |
| 3149 | 3119 | 40772 | 76.9 | CACGGTGCAAAGAAAGCAGCCCTA | 30 | 33 | 6 | 6 | 31 | 26 |
| 3150 | 3121 | 30704 | 79.5 | CACGGTGCTCTGCTTGCGAACCAT | 30 | 33 | 8 | 11 | 16 | 15 |
| 3151 | 3122 | 9760 | 80.7 | CACGGTGCCTTGCGAACTCACACG | 30 | 33 | 11 | 16 | 13 | 30 |
| 3152 | 3123 | 40773 | 78.9 | CACGGTGCCTCAACCTCTCAACGG | 30 | 33 | 13 | 23 | 13 | 35 |
| 3153 | 3124 | 9764 | 79.5 | CACGGTGCCGAAAGGAGACCACCT | 30 | 33 | 16 | 25 | 32 | 23 |
| 3154 | 3125 | 9766 | 77.3 | CACGGTGCGAGTGCAAAGCCTTAG | 30 | 33 | 20 | 21 | 36 | 3 |
| 3155 | 3126 | 40775 | 77.2 | CACGGTGCACCTAGGAGCAAGTGC | 30 | 33 | 23 | 25 | 21 | 33 |
| 3156 | 3127 | 9770 | 78.1 | CACGGTGCAGGAATCGAGGAGGAC | 30 | 33 | 25 | 24 | 25 | 34 |
| 3157 | 3128 | 9771 | 76.3 | CACGGTGCCCTAACCTCCTATCCC | 30 | 33 | 26 | 23 | 26 | 28 |
| 3158 | 3129 | 9772 | 81.6 | CACGGTGCTCCCCAGCCTGTGATG | 30 | 33 | 28 | 31 | 14 | 27 |
| 3159 | 3130 | 9773 | 82 | CACGGTGCTGCGTGATGTGCAGGA | 30 | 33 | 29 | 2 | 33 | 25 |
| 3160 | 3131 | 30705 | 83.9 | CACGGTGCGGACGTGCAGCCTGAT | 30 | 33 | 34 | 33 | 36 | 2 |
| 3161 | 3132 | 40776 | 79.1 | CACGGGACTTGAGCTTCGTTTGCG | 30 | 34 | 1 | 17 | 12 | 29 |
| 3162 | 3133 | 9778 | 75.8 | CACGGGACAATCTTGAAGCCGAGT | 30 | 34 | 4 | 1 | 36 | 20 |

FIG. 25KKK

| SEQ ID NO: | 4,633 ID# | HEX ID# | Tm | ZIPCODE (5'-3') | TETRAMER NUMBERS | | | | |
|---|---|---|---|---|---|---|---|---|---|
| 3163 | 3134 | 9779 | 77.8 | CACGGGACATACAGCCACCTTCCC | 30 | 34 | 5 | 36 | 23 | 28 |
| 3164 | 3135 | 21811 | 77.2 | CACGGGACCTCACTCAGCTTGTGC | 30 | 34 | 13 | 13 | 17 | 33 |
| 3165 | 3136 | 9783 | 77.9 | CACGGGACCTGTCTTGAGTGCACG | 30 | 34 | 14 | 11 | 22 | 30 |
| 3166 | 3137 | 9789 | 76.9 | CACGGGACGAGTTTGAATCGATCG | 30 | 34 | 20 | 1 | 24 | 24 |
| 3167 | 3138 | 30706 | 77.9 | CACGGGACCCTAGTGCGGACAATC | 30 | 34 | 26 | 33 | 34 | 4 |
| 3168 | 3139 | 9793 | 79.7 | CACGGGACGACCACGGTGATGGTA | 30 | 34 | 32 | 35 | 2 | 18 |
| 3169 | 3140 | 9796 | 76 | CACGACGGAATCTCGTTGATTCCC | 30 | 35 | 4 | 10 | 2 | 28 |
| 3170 | 3141 | 16062 | 77.5 | CACGACGGTACAAGCCCAGCTTGA | 30 | 35 | 7 | 36 | 31 | 1 |
| 3171 | 3142 | 9799 | 81.4 | CACGACGGTGTCGTGCGTGCAATC | 30 | 35 | 9 | 33 | 33 | 4 |
| 3172 | 3143 | 21817 | 78.8 | CACGACGGAGTGCTTGTTGATGCC | 30 | 35 | 22 | 11 | 1 | 29 |
| 3173 | 3144 | 16063 | 80.2 | CACGACGGATCGCGTTTCGTCTCA | 30 | 35 | 24 | 12 | 10 | 13 |
| 3174 | 3145 | 9806 | 79.8 | CACGACGGCAGCTCTGGCTTCTCA | 30 | 35 | 31 | 8 | 17 | 13 |
| 3175 | 3146 | 9807 | 77.9 | CACGACGGGACAGGAAATCCTTG | 30 | 35 | 34 | 25 | 4 | 11 |
| 3176 | 3147 | 9810 | 76.9 | CACGAGCCAAAGTGCGGAGTGTCT | 30 | 36 | 6 | 29 | 20 | 19 |
| 3177 | 3148 | 9811 | 77.2 | CACGAGCCTACAACGGTGCGAAAG | 30 | 36 | 7 | 35 | 29 | 6 |
| 3178 | 3149 | 9812 | 77.4 | CACGAGCCTCTGAATCGCTTCACG | 30 | 36 | 8 | 4 | 17 | 30 |
| 3179 | 3150 | 9813 | 76.7 | CACGAGCCTGTCAGCCCCTATTGA | 30 | 36 | 9 | 36 | 26 | 1 |
| 3180 | 3151 | 40781 | 78.6 | CACGAGCCCTCACGTTGGACGTCT | 30 | 36 | 13 | 12 | 34 | 19 |
| 3181 | 3152 | 9817 | 75.7 | CACGAGCCGCTTACCTAGGAATCG | 30 | 36 | 17 | 23 | 25 | 24 |
| 3182 | 3154 | 30707 | 79.1 | CACGAGCCAGTGCGTTAGCCCTTG | 30 | 36 | 22 | 12 | 36 | 11 |
| 3183 | 3155 | 30708 | 80.3 | CACGAGCCACCTCAGCAGTGCAGC | 30 | 36 | 23 | 31 | 22 | 31 |
| 3184 | 3156 | 16069 | 82.3 | CACGAGCCTGCGGACCGGACTGAT | 30 | 36 | 29 | 32 | 34 | 2 |
| 3185 | 3157 | 9827 | 81.9 | CACGAGCCCACGGCAACAGCTCTG | 30 | 36 | 30 | 21 | 31 | 8 |
| 3186 | 3158 | 9830 | 82.8 | CACGAGCCGTGCGAGTCTTGTGCG | 30 | 36 | 33 | 20 | 11 | 29 |
| 3187 | 3159 | 9831 | 81 | CACGAGCCGGACCTCATCGTCAGC | 30 | 36 | 34 | 13 | 10 | 31 |
| 3188 | 3160 | 9837 | 80.3 | CAGCTTGAGTGCCGAAAGCCGGAC | 31 | 1 | 33 | 16 | 36 | 34 |
| 3189 | 3161 | 9839 | 79.3 | CAGCTGATGCTTGGACAGCCCAGC | 31 | 2 | 17 | 34 | 36 | 31 |
| 3190 | 3162 | 16071 | 78.9 | CAGCTGATGCAACACGCTTGGTGC | 31 | 2 | 21 | 30 | 11 | 33 |
| 3191 | 3163 | 40784 | 79.8 | CAGCTGATTCCCAGTGCACGGTGC | 31 | 2 | 28 | 22 | 30 | 33 |
| 3192 | 3164 | 9848 | 79.5 | CAGCAATCTCGTACGGCACGCGTT | 31 | 4 | 10 | 35 | 30 | 12 |
| 3193 | 3165 | 9849 | 77.2 | CAGCAATCCTCACGTTAGCCGTGC | 31 | 4 | 13 | 12 | 36 | 33 |
| 3194 | 3166 | 9851 | 76.8 | CAGCAATCGGTAACGGCTTGCTGT | 31 | 4 | 18 | 35 | 11 | 14 |
| 3195 | 3167 | 9852 | 79.3 | CAGCAATCGTCTTCCCCAGCTCCC | 31 | 4 | 19 | 28 | 31 | 28 |
| 3196 | 3168 | 9854 | 76.2 | CAGCAATCATCGAAAGCACGCTTG | 31 | 4 | 24 | 6 | 30 | 11 |
| 3197 | 3169 | 9861 | 81.1 | CAGCATACTCCCACGGACGGCGAA | 31 | 5 | 28 | 35 | 35 | 16 |
| 3198 | 3170 | 40787 | 82.5 | CAGCATACTGCGCACGTGCGTCCC | 31 | 5 | 29 | 30 | 29 | 28 |
| 3199 | 3172 | 9874 | 78.5 | CAGCAAAGGTGCGTCTAGCCAGCC | 31 | 6 | 33 | 19 | 36 | 36 |
| 3200 | 3173 | 9875 | 79.3 | CAGCAAAGACGGCACGAGTGAGCC | 31 | 6 | 35 | 30 | 22 | 36 |
| 3201 | 3174 | 9880 | 81.9 | CAGCTCTGGATGAGCCACGGCACG | 31 | 8 | 27 | 36 | 35 | 30 |
| 3202 | 3175 | 9886 | 79.3 | CAGCTGTCCTTGTCCCGCTTTCCC | 31 | 9 | 11 | 28 | 17 | 28 |
| 3203 | 3176 | 9887 | 81.8 | CAGCTGTCCTCATGCGTGCGGACC | 31 | 9 | 13 | 29 | 29 | 32 |
| 3204 | 3177 | 9894 | 78.3 | CAGCTGTCGTGCCCATGCAACCTA | 31 | 9 | 33 | 15 | 21 | 26 |
| 3205 | 3178 | 9896 | 78.3 | CAGCTGTCAGCCCGAAACCTACGG | 31 | 9 | 36 | 16 | 23 | 35 |
| 3206 | 3179 | 9902 | 78.4 | CAGCTCGTTCCCGCTTGGACAAAG | 31 | 10 | 28 | 17 | 34 | 6 |
| 3207 | 3180 | 40795 | 78.5 | CAGCTCGTCAGCTCGTGAGTTGCG | 31 | 10 | 31 | 10 | 20 | 29 |
| 3208 | 3181 | 16096 | 77.8 | CAGCCTTGAAAGGCTTAGCCTGCG | 31 | 11 | 6 | 17 | 36 | 29 |
| 3209 | 3182 | 21838 | 77.8 | CAGCCTTGTCTGGACCAGCCCTGT | 31 | 11 | 8 | 32 | 35 | 14 |
| 3210 | 3183 | 9910 | 75.1 | CAGCCTTGTCGTATACGTGCGACC | 31 | 11 | 10 | 5 | 33 | 32 |
| 3211 | 3184 | 9915 | 78.6 | CAGCCTTGAGTGGACCTGCGGGTA | 31 | 11 | 22 | 32 | 29 | 18 |
| 3212 | 3185 | 40798 | 78.4 | CAGCCTTGAGGAGCAAGACCACGG | 31 | 11 | 25 | 21 | 32 | 35 |
| 3213 | 3186 | 16097 | 79.3 | CAGCCTTGTCCCCTCAATCGAGCC | 31 | 11 | 28 | 13 | 24 | 36 |

FIG. 25LLL

| SEQ ID NO: | 4,633 ID# | HEX ID# | Tm | ZIPCODE (5'-3') | TETRAMER NUMBERS | | | | |
|---|---|---|---|---|---|---|---|---|---|
| 3214 | 3187 | 9921 | 78.8 | CAGCCTTGGACCCGTTCGTTGATG | 31 | 11 | 32 | 12 | 12 27 |
| 3215 | 3188 | 9922 | 78.8 | CAGCCTTGACGGGCAAGTCTCGAA | 31 | 11 | 35 | 21 | 19 16 |
| 3216 | 3189 | 16099 | 75.7 | CAGCCGTTTACATCTGTCCCCGTT | 31 | 12 | 7 | 8 | 28 12 |
| 3217 | 3190 | 30714 | 77.1 | CAGCCGTTTCTGAAAGCAGCAGGA | 31 | 12 | 8 | 6 | 31 25 |
| 3218 | 3191 | 30715 | 76.5 | CAGCCGTTGCTTAGCCCTCATCTG | 31 | 12 | 17 | 36 | 13 8 |
| 3219 | 3192 | 9931 | 76.5 | CAGCCGTTGGTAACCTGACCCTCA | 31 | 12 | 18 | 23 | 32 13 |
| 3220 | 3193 | 16101 | 78.4 | CAGCCGTTGCAAATCGGTCTCCAT | 31 | 12 | 21 | 24 | 19 15 |
| 3221 | 3194 | 9933 | 77.1 | CAGCCGTTATCGGATGACCTTCCC | 31 | 12 | 24 | 27 | 23 28 |
| 3222 | 3195 | 16102 | 76.1 | CAGCCGTTCCTAACGGATACCACG | 31 | 12 | 26 | 35 | 5 30 |
| 3223 | 3196 | 30717 | 77.6 | CAGCCGTTGTGCTCGTAAAGGCAA | 31 | 12 | 33 | 10 | 6 21 |
| 3224 | 3197 | 9939 | 79.7 | CAGCCGTTGGACGATGGCTTGATG | 31 | 12 | 34 | 27 | 17 27 |
| 3225 | 3198 | 16104 | 77.7 | CAGCCGTTAGCCGCTTAGCCAAAG | 31 | 12 | 36 | 17 | 36 6 |
| 3226 | 3199 | 30718 | 76.2 | CAGCCTCATCGTAAAGGTGCGCTT | 31 | 13 | 10 | 6 | 33 17 |
| 3227 | 3200 | 30719 | 79.7 | CAGCCTCACCATCAGCGTGCGAGT | 31 | 13 | 15 | 31 | 33 20 |
| 3228 | 3201 | 40805 | 76.6 | CAGCCTCACGAACGAACGTTCCAT | 31 | 13 | 16 | 16 | 12 15 |
| 3229 | 3202 | 40806 | 78.3 | CAGCCTCAGCTTTCGTGCAATCCC | 31 | 13 | 17 | 10 | 21 28 |
| 3230 | 3203 | 9945 | 77.4 | CAGCCTCAGCAAGACCGAGTCACG | 31 | 13 | 21 | 32 | 20 30 |
| 3231 | 3204 | 40807 | 75.3 | CAGCCTCAACCTAATCGACCGCTT | 31 | 13 | 23 | 4 | 32 17 |
| 3232 | 3205 | 9947 | 79 | CAGCCTCATCCCGACCAAAGTCCC | 31 | 13 | 28 | 32 | 6 28 |
| 3233 | 3206 | 9950 | 78.3 | CAGCCTCAGACCTGATTCCCTGCG | 31 | 13 | 32 | 2 | 28 29 |
| 3234 | 3207 | 9954 | 75.1 | CAGCCTGTTTGATCGTTTGAACGG | 31 | 14 | 1 | 10 | 1 35 |
| 3235 | 3208 | 9955 | 78.9 | CAGCCTGTTGATCGAATCCCGTGC | 31 | 14 | 2 | 16 | 28 33 |
| 3236 | 3209 | 9956 | 79.9 | CAGCCTGTTCTGCGTTGCAAACGG | 31 | 14 | 8 | 12 | 21 35 |
| 3237 | 3210 | 9959 | 80.2 | CAGCCTGTCTCAAGCCGGACGACC | 31 | 14 | 13 | 36 | 34 32 |
| 3238 | 3211 | 40810 | 78.7 | CAGCCTGTCCATCTCATGCGGCTT | 31 | 14 | 15 | 13 | 29 17 |
| 3239 | 3212 | 9961 | 77.1 | CAGCCTGTGCTTCTCATCCCGATG | 31 | 14 | 17 | 13 | 28 27 |
| 3240 | 3213 | 21844 | 76.1 | CAGCCTGTGTGCCGAAGCTTACCT | 31 | 14 | 33 | 16 | 17 23 |
| 3241 | 3214 | 16113 | 79.5 | CAGCCCATTACACACGCACGTCCC | 31 | 15 | 7 | 30 | 30 28 |
| 3242 | 3215 | 16114 | 78 | CAGCCCATTCTGCCATCCATAGCC | 31 | 15 | 8 | 15 | 15 36 |
| 3243 | 3216 | 30720 | 76.6 | CAGCCCATCTTGTGATCACGGCTT | 31 | 15 | 11 | 2 | 30 17 |
| 3244 | 3217 | 30721 | 78.3 | CAGCCCATCGTTGCTTCCATCCAT | 31 | 15 | 12 | 17 | 15 15 |
| 3245 | 3218 | 40813 | 79.5 | CAGCCCATGTCTCCATGACCACGG | 31 | 15 | 19 | 15 | 32 35 |
| 3246 | 3219 | 40814 | 79 | CAGCCCATGAGTGCTTAGCCACGG | 31 | 15 | 20 | 17 | 36 35 |
| 3247 | 3220 | 9977 | 78.7 | CAGCCCATGCAATCTGCTCACACG | 31 | 15 | 21 | 8 | 13 30 |
| 3248 | 3221 | 40815 | 76.7 | CAGCCCATCCTAACGGCCATACCT | 31 | 15 | 26 | 35 | 15 23 |
| 3249 | 3222 | 30722 | 78.1 | CAGCCCATCACGAAAGGCTTGACC | 31 | 15 | 30 | 6 | 17 32 |
| 3250 | 3223 | 9988 | 79.1 | CAGCCCATACGGGAGTGTGCGGTA | 31 | 15 | 35 | 20 | 33 18 |
| 3251 | 3224 | 40818 | 77.3 | CAGCCGAATCTGAAAGCGAACACG | 31 | 16 | 8 | 6 | 16 30 |
| 3252 | 3225 | 9994 | 78 | CAGCCGAATGTCCGTTCTTGTCCC | 31 | 16 | 9 | 12 | 11 28 |
| 3253 | 3226 | 16124 | 77.3 | CAGCCGAAGTCTTGCGAATCGATG | 31 | 16 | 19 | 29 | 4 27 |
| 3254 | 3227 | 40821 | 78.4 | CAGCCGAAAGTGATACGTGCGCAA | 31 | 16 | 22 | 5 | 33 21 |
| 3255 | 3228 | 40822 | 78.2 | CAGCCGAAAGGATGTCATCGAGCC | 31 | 16 | 25 | 9 | 24 36 |
| 3256 | 3229 | 10006 | 81.6 | CAGCCGAATGCGCTTGGCAATGTC | 31 | 16 | 29 | 11 | 21 9 |
| 3257 | 3230 | 16127 | 78.7 | CAGCCGAACACGGCTTGCTTTGAT | 31 | 16 | 30 | 17 | 17 2 |
| 3258 | 3231 | 10009 | 78.9 | CAGCCGAAGACCCACGATACGTGC | 31 | 16 | 32 | 30 | 5 33 |
| 3259 | 3232 | 10010 | 82.4 | CAGCCGAAACGGCACGTGTCATCG | 31 | 16 | 35 | 30 | 9 24 |
| 3260 | 3233 | 10011 | 79.6 | CAGCCGAAAGCCGGTAGATGCGTT | 31 | 16 | 36 | 18 | 27 12 |
| 3261 | 3234 | 30724 | 77 | CAGCGCTTAATCTGCGTCTGCCAT | 31 | 17 | 4 | 29 | 8 15 |
| 3262 | 3235 | 10015 | 75.4 | CAGCGCTTTACACGTTTGTCCAGC | 31 | 17 | 7 | 12 | 9 31 |
| 3263 | 3236 | 30725 | 78.3 | CAGCGCTTTGTCCGAAAAAGACGG | 31 | 17 | 9 | 16 | 6 35 |
| 3264 | 3237 | 16128 | 77.3 | CAGCGCTTTCGTTCGTTTGAATCG | 31 | 17 | 10 | 10 | 1 24 |

FIG. 25MMM

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 3265 | 3238 | 10019 | 76 | CAGCGCTTCTCAGGACCCATCCTA | 31 | 17 | 13 | 34 | 15 | 26 |
| 3266 | 3239 | 21856 | 79.5 | CAGCGCTTCTGTCGAAGTGCCAGC | 31 | 17 | 14 | 16 | 33 | 31 |
| 3267 | 3240 | 10024 | 77 | CAGCGCTTATCGCGAAAATCCTCA | 31 | 17 | 24 | 16 | 4 | 13 |
| 3268 | 3241 | 10026 | 80.8 | CAGCGCTTTGCGGCTTGAGTTCGT | 31 | 17 | 29 | 17 | 20 | 10 |
| 3269 | 3242 | 10029 | 76.7 | CAGCGCTTAGCCTTGACTTGGTGC | 31 | 17 | 36 | 1 | 11 | 33 |
| 3270 | 3243 | 30726 | 77 | CAGCGGTACCATCCATGACCGGTA | 31 | 18 | 15 | 15 | 32 | 18 |
| 3271 | 3244 | 10036 | 75.8 | CAGCGGTACGAACGAACTTGCTCA | 31 | 18 | 16 | 16 | 11 | 13 |
| 3272 | 3245 | 30727 | 78.5 | CAGCGGTACAGCACCTGCTTGCAA | 31 | 18 | 31 | 23 | 17 | 21 |
| 3273 | 3246 | 10046 | 79.2 | CAGCGTCTTGATGGACCAGCCAGC | 31 | 19 | 2 | 34 | 31 | 31 |
| 3274 | 3247 | 30728 | 78 | CAGCGTCTCCATCTCATCGTTGCG | 31 | 19 | 15 | 13 | 10 | 29 |
| 3275 | 3248 | 30729 | 77.9 | CAGCGTCTCGAATCGTTCCCTCGT | 31 | 19 | 16 | 10 | 28 | 10 |
| 3276 | 3249 | 21861 | 79 | CAGCGTCTGCTTATCGTCCCACGG | 31 | 19 | 17 | 24 | 28 | 35 |
| 3277 | 3250 | 10050 | 78.4 | CAGCGTCTTGCGAGGAGATGGACC | 31 | 19 | 29 | 25 | 27 | 32 |
| 3278 | 3251 | 30730 | 77.7 | CAGCGTCTGGACTTGAATCGCGAA | 31 | 19 | 34 | 1 | 24 | 16 |
| 3279 | 3252 | 40828 | 78 | CAGCGTCTACGGAATCACGGGGAC | 31 | 19 | 35 | 4 | 35 | 34 |
| 3280 | 3253 | 10056 | 79 | CAGCGAGTTCTGCAGCGATGGCTT | 31 | 20 | 8 | 31 | 27 | 17 |
| 3281 | 3254 | 10057 | 80.5 | CAGCGAGTCTTGGCAACACGCGAA | 31 | 20 | 11 | 21 | 30 | 16 |
| 3282 | 3255 | 10058 | 75.9 | CAGCGAGTCGTTATCGTGTCACGG | 31 | 20 | 12 | 24 | 9 | 35 |
| 3283 | 3257 | 30731 | 77.7 | CAGCGAGTCGAAAGGACGAAAGCC | 31 | 20 | 16 | 25 | 16 | 36 |
| 3284 | 3259 | 16142 | 80.5 | CAGCGAGTGTGCGACCTGCGTGAT | 31 | 20 | 33 | 32 | 29 | 2 |
| 3285 | 3260 | 40831 | 77.3 | CAGCGCAATGATCGAAATCGGGTA | 31 | 21 | 2 | 16 | 24 | 18 |
| 3286 | 3261 | 16143 | 77.1 | CAGCGCAAATACAATCCAGCGGAC | 31 | 21 | 5 | 4 | 31 | 34 |
| 3287 | 3262 | 16144 | 77.5 | CAGCGCAATCTGGCTTGATGGGTA | 31 | 21 | 8 | 17 | 27 | 18 |
| 3288 | 3263 | 10076 | 79.3 | CAGCGCAATGTCCGTTGGACCTGT | 31 | 21 | 9 | 12 | 34 | 14 |
| 3289 | 3264 | 10078 | 77.4 | CAGCGCAACCATGGTAATCGAGGA | 31 | 21 | 15 | 18 | 24 | 25 |
| 3290 | 3265 | 10079 | 77.7 | CAGCGCAACGAATCGTCTTGAGGA | 31 | 21 | 16 | 10 | 11 | 25 |
| 3291 | 3266 | 30732 | 76.9 | CAGCGCAAGGTAGCAAGACCGGTA | 31 | 21 | 18 | 21 | 32 | 18 |
| 3292 | 3267 | 10081 | 76.5 | CAGCGCAAGAGTCGTTCTTGGACC | 31 | 21 | 20 | 12 | 11 | 32 |
| 3293 | 3268 | 40833 | 76.6 | CAGCGCAAAGTGTGATTCCCCCTA | 31 | 21 | 22 | 2 | 28 | 26 |
| 3294 | 3269 | 10084 | 79 | CAGCGCAAGGACGATGGACCAAAG | 31 | 21 | 34 | 27 | 32 | 6 |
| 3295 | 3270 | 10085 | 79.8 | CAGCGCAAACGGTCGTCACGAATC | 31 | 21 | 35 | 10 | 30 | 4 |
| 3296 | 3271 | 10086 | 80.7 | CAGCAGTGTCGTGTGCTCCCCACG | 31 | 22 | 10 | 33 | 28 | 30 |
| 3297 | 3272 | 30733 | 79.1 | CAGCAGTGGCTTGTGCCTGTTCCC | 31 | 22 | 17 | 33 | 14 | 28 |
| 3298 | 3274 | 10093 | 77.8 | CAGCAGTGCCTAATCGCACGCTGT | 31 | 22 | 26 | 24 | 30 | 14 |
| 3299 | 3275 | 16147 | 78.5 | CAGCAGTGTCCCCTTGCCATTCGT | 31 | 22 | 28 | 11 | 15 | 10 |
| 3300 | 3276 | 10097 | 79.9 | CAGCAGTGGGACGTCTACGGTGCG | 31 | 22 | 34 | 19 | 35 | 29 |
| 3301 | 3277 | 16148 | 77.1 | CAGCACCTCGAAAATCTGCGGATG | 31 | 23 | 16 | 4 | 29 | 27 |
| 3302 | 3278 | 30734 | 78.7 | CAGCACCTCACGTCTGCGAAGCAA | 31 | 23 | 30 | 8 | 16 | 21 |
| 3303 | 3279 | 10108 | 80.3 | CAGCACCTGTGCGACCTGTCCGAA | 31 | 23 | 33 | 32 | 9 | 16 |
| 3304 | 3280 | 10109 | 80.4 | CAGCACCTGGACGCTTGTGCAGGA | 31 | 23 | 34 | 17 | 33 | 25 |
| 3305 | 3281 | 30735 | 77.9 | CAGCATCGGCTTACCTGTGCATCG | 31 | 24 | 17 | 23 | 33 | 24 |
| 3306 | 3282 | 30736 | 77.9 | CAGCATCGGGTAAGTGAGCCGCTT | 31 | 24 | 18 | 22 | 36 | 17 |
| 3307 | 3283 | 16154 | 79.8 | CAGCATCGATCGGCAATCTGGTGC | 31 | 24 | 24 | 21 | 8 | 33 |
| 3308 | 3284 | 10125 | 79.7 | CAGCATCGACGGCACGGGTAAGTG | 31 | 24 | 35 | 30 | 18 | 22 |
| 3309 | 3285 | 10128 | 79 | CAGCAGGAAATCACGGTCCCTCCC | 31 | 25 | 4 | 35 | 28 | 28 |
| 3310 | 3286 | 10130 | 78 | CAGCAGGATCGTGTCTCGAATGCG | 31 | 25 | 10 | 19 | 16 | 29 |
| 3311 | 3287 | 10131 | 79.6 | CAGCAGGACTTGACGGCACGCCTA | 31 | 25 | 11 | 35 | 30 | 26 |
| 3312 | 3288 | 30737 | 78.8 | CAGCAGGAGCAAATCGGTGCTCGT | 31 | 25 | 21 | 24 | 33 | 10 |
| 3313 | 3289 | 10133 | 79 | CAGCAGGAAGTGTGCGCTGTCACG | 31 | 25 | 22 | 29 | 14 | 30 |
| 3314 | 3290 | 16157 | 78.9 | CAGCAGGACACGGATGGCTTACGG | 31 | 25 | 30 | 27 | 17 | 35 |
| 3315 | 3291 | 10135 | 77.6 | CAGCAGGAGTGCTCTGGGACTCCC | 31 | 25 | 33 | 8 | 34 | 28 |

FIG. 25NNN

| SEQ ID NO: | 4,633 ID# | HEX ID# | Tm | ZIPCODE (5'-3') | TETRAMER NUMBERS | | | | |
|---|---|---|---|---|---|---|---|---|---|
| 3316 | 3292 | 10136 | 76.7 | CAGCAGGAAGCCATACGGACAGGA | 31 | 25 | 36 | 5 | 34 | 25 |
| 3317 | 3293 | 30738 | 77.6 | CAGCCCTATCGTGCTTTGTCGCAA | 31 | 26 | 10 | 17 | 9 | 21 |
| 3318 | 3294 | 30739 | 77.6 | CAGCCCTACGAATCTGCAGCTCCC | 31 | 26 | 16 | 8 | 31 | 28 |
| 3319 | 3295 | 30740 | 75.7 | CAGCCCTAGCAAATACTCCCTGCG | 31 | 26 | 21 | 5 | 28 | 29 |
| 3320 | 3296 | 16161 | 76.7 | CAGCCCTAAGTGAGCCGTCTTCCC | 31 | 26 | 22 | 36 | 19 | 28 |
| 3321 | 3297 | 40839 | 78.1 | CAGCCCTAACCTTCCCAGCCGAGT | 31 | 26 | 23 | 28 | 36 | 20 |
| 3322 | 3298 | 10148 | 77.5 | CAGCCCTAACGGTCGTCTGTGCAA | 31 | 26 | 35 | 10 | 14 | 21 |
| 3323 | 3299 | 10151 | 80.1 | CAGCGATGAATCCACGGGACCGTT | 31 | 27 | 4 | 30 | 34 | 12 |
| 3324 | 3300 | 21879 | 75.7 | CAGCGATGTCTGACCTATCGCGAA | 31 | 27 | 8 | 23 | 24 | 16 |
| 3325 | 3301 | 10152 | 80.6 | CAGCGATGTGTCCCATGCTTTGCG | 31 | 27 | 9 | 15 | 17 | 29 |
| 3326 | 3302 | 10154 | 77.9 | CAGCGATGCTTGCTGTCTTGCGTT | 31 | 27 | 11 | 14 | 11 | 12 |
| 3327 | 3303 | 16166 | 77.6 | CAGCGATGCTCAGTGCTCTGAGCC | 31 | 27 | 13 | 33 | 8 | 36 |
| 3328 | 3304 | 40841 | 79.3 | CAGCGATGGTCTTGATTCCCGCAA | 31 | 27 | 19 | 2 | 28 | 21 |
| 3329 | 3305 | 16169 | 77 | CAGCGATGAGGATCGTTCGTGACC | 31 | 27 | 25 | 10 | 10 | 32 |
| 3330 | 3306 | 30741 | 76.5 | CAGCGATGCCTAGCAACCTAACGG | 31 | 27 | 26 | 21 | 26 | 35 |
| 3331 | 3307 | 16170 | 77.7 | CAGCGATGTCCCCTTGCCTACGTT | 31 | 27 | 28 | 11 | 26 | 12 |
| 3332 | 3308 | 10164 | 79.4 | CAGCGATGGACCGATGAGTGCGTT | 31 | 27 | 32 | 27 | 22 | 12 |
| 3333 | 3309 | 10167 | 80.6 | CAGCGATGACGGGATGTCGTTCCC | 31 | 27 | 35 | 27 | 10 | 28 |
| 3334 | 3310 | 10168 | 79.5 | CAGCGATGAGCCCTGTGCAATCGT | 31 | 27 | 36 | 14 | 21 | 10 |
| 3335 | 3311 | 30742 | 76.6 | CAGCTCCCAAAGTCCCCTGTAGCC | 31 | 28 | 6 | 28 | 14 | 36 |
| 3336 | 3312 | 30743 | 76.5 | CAGCTCCCCGTTAAAGATCGGACC | 31 | 28 | 12 | 6 | 24 | 32 |
| 3337 | 3313 | 30744 | 76 | CAGCTCCCCTGTATCGCGTTCCTA | 31 | 28 | 14 | 24 | 12 | 26 |
| 3338 | 3314 | 10175 | 78.9 | CAGCTCCCCGAAATCGTGTCGATG | 31 | 28 | 16 | 24 | 9 | 27 |
| 3339 | 3315 | 30745 | 77.7 | CAGCTCCCGAGTGCTTTTGAAGCC | 31 | 28 | 20 | 17 | 1 | 36 |
| 3340 | 3316 | 10178 | 75.9 | CAGCTCCCAGTGTTAGACGGCCAT | 31 | 28 | 22 | 3 | 35 | 15 |
| 3341 | 3317 | 10179 | 75.1 | CAGCTCCCACCTACCTGGACGTCT | 31 | 28 | 23 | 23 | 34 | 19 |
| 3342 | 3318 | 10180 | 77.8 | CAGCTCCCGATGGTCTTCGTCGTT | 31 | 28 | 27 | 19 | 10 | 12 |
| 3343 | 3319 | 16176 | 80 | CAGCTCCCTCCCGAGTTCCCGAGT | 31 | 28 | 28 | 20 | 28 | 20 |
| 3344 | 3320 | 10182 | 78.8 | CAGCTCCCTGCGAATCAGGACGAA | 31 | 28 | 29 | 4 | 25 | 16 |
| 3345 | 3321 | 10183 | 80.7 | CAGCTCCCCACGGATGATCGATCG | 31 | 28 | 30 | 27 | 24 | 24 |
| 3346 | 3322 | 10186 | 78.9 | CAGCTCCCACGGTCGTTGTCCTTG | 31 | 28 | 35 | 10 | 9 | 11 |
| 3347 | 3323 | 16177 | 77.8 | CAGCTGCGTTGAGTGCCGTTGTCT | 31 | 29 | 1 | 33 | 12 | 19 |
| 3348 | 3324 | 40843 | 76.9 | CAGCTGCGTTAGTCTGGGACCGAA | 31 | 29 | 3 | 8 | 34 | 16 |
| 3349 | 3325 | 16179 | 79.6 | CAGCTGCGATACCGAAAGCCCGTT | 31 | 29 | 5 | 16 | 36 | 12 |
| 3350 | 3326 | 16180 | 80.7 | CAGCTGCGTCTGGACCCAGCACCT | 31 | 29 | 8 | 32 | 31 | 23 |
| 3351 | 3327 | 30746 | 76.2 | CAGCTGCGACCTAATCAGCCTCGT | 31 | 29 | 23 | 4 | 36 | 10 |
| 3352 | 3328 | 40845 | 80.4 | CAGCTGCGATCGGCTTTGATGCAA | 31 | 29 | 24 | 17 | 2 | 21 |
| 3353 | 3329 | 10195 | 79.4 | CAGCTGCGGATGGCTTGAGTCAGC | 31 | 29 | 27 | 17 | 20 | 31 |
| 3354 | 3330 | 10196 | 80.3 | CAGCTGCGTCCCTGTCCACGTTGA | 31 | 29 | 28 | 9 | 30 | 1 |
| 3355 | 3331 | 10197 | 82.9 | CAGCTGCGCACGCTTGACGGTCTG | 31 | 29 | 30 | 11 | 35 | 8 |
| 3356 | 3332 | 40848 | 77.4 | CAGCCACGTTGATTAGGACCGCAA | 31 | 30 | 1 | 3 | 32 | 21 |
| 3357 | 3333 | 10203 | 78.7 | CAGCCACGAATCGAGTTGCGGAGT | 31 | 30 | 4 | 20 | 29 | 20 |
| 3358 | 3334 | 10204 | 78 | CAGCCACGATACCGAAGGACGGAC | 31 | 30 | 5 | 16 | 34 | 34 |
| 3359 | 3335 | 30747 | 79.8 | CAGCCACGTCTGTGTCTCCCACGG | 31 | 30 | 8 | 9 | 28 | 35 |
| 3360 | 3336 | 21894 | 76.2 | CAGCCACGTCGTGCAAGTCTTCTG | 31 | 30 | 10 | 21 | 19 | 8 |
| 3361 | 3337 | 10208 | 79.4 | CAGCCACGCGTTCGTTCCATCTGT | 31 | 30 | 12 | 12 | 15 | 14 |
| 3362 | 3338 | 10210 | 79.6 | CAGCCACGCGAAGTGCAATCGTCT | 31 | 30 | 16 | 33 | 4 | 19 |
| 3363 | 3339 | 40850 | 77.1 | CAGCCACGCCTATCCCCCTATGTC | 31 | 30 | 26 | 28 | 26 | 9 |
| 3364 | 3340 | 30748 | 77.4 | CAGCCAGCTTGAGGACGGTATCCC | 31 | 31 | 1 | 34 | 18 | 28 |
| 3365 | 3341 | 16183 | 79.4 | CAGCCAGCTTAGGACCGTGCTCCC | 31 | 31 | 3 | 32 | 33 | 28 |
| 3366 | 3344 | 16184 | 79.3 | CAGCCAGCTGTCACGGAGGAGTGC | 31 | 31 | 9 | 35 | 25 | 33 |

FIG. 25000

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 3367 | 3345 | 30749 | 77.1 | CAGCCAGCCTCAATACGGTATGCG | 31 | 31 | 13 | 5 | 18 | 29 |
| 3368 | 3346 | 16186 | 77 | CAGCCAGCCCATATCGATACTGCG | 31 | 31 | 15 | 24 | 5 | 29 |
| 3369 | 3347 | 10228 | 77.6 | CAGCCAGCAGGACGTTCGAATTGA | 31 | 31 | 25 | 12 | 16 | 1 |
| 3370 | 3348 | 10229 | 76 | CAGCCAGCGATGTTAGGGACGTCT | 31 | 31 | 27 | 3 | 34 | 19 |
| 3371 | 3349 | 10230 | 79.4 | CAGCCAGCTCCCGGTACTTGAGCC | 31 | 31 | 28 | 18 | 11 | 36 |
| 3372 | 3350 | 10233 | 81.5 | CAGCCAGCAGCCCTTGGATGCTCA | 31 | 31 | 36 | 11 | 27 | 13 |
| 3373 | 3351 | 30750 | 77.7 | CAGCGACCAATCATACAGCCCACG | 31 | 32 | 4 | 5 | 36 | 30 |
| 3374 | 3352 | 40857 | 76 | CAGCGACCTCGTAGGAGCAACCAT | 31 | 32 | 10 | 25 | 21 | 15 |
| 3375 | 3353 | 40858 | 80 | CAGCGACCCTTGCCTAGACCCACG | 31 | 32 | 11 | 26 | 32 | 30 |
| 3376 | 3354 | 10239 | 80 | CAGCGACCGCAACACGGTCTCTTG | 31 | 32 | 21 | 30 | 19 | 11 |
| 3377 | 3355 | 10241 | 77.3 | CAGCGACCATCGTACACAGCCCAT | 31 | 32 | 24 | 7 | 31 | 15 |
| 3378 | 3356 | 30751 | 79.6 | CAGCGACCTCCCAATCGGACGAGT | 31 | 32 | 28 | 4 | 34 | 20 |
| 3379 | 3357 | 10242 | 79.8 | CAGCGACCCACGGCTTTACATCCC | 31 | 32 | 30 | 17 | 7 | 28 |
| 3380 | 3358 | 10244 | 78.8 | CAGCGACCGACCTCGTCTGTCGTT | 31 | 32 | 32 | 10 | 14 | 12 |
| 3381 | 3359 | 30752 | 80.1 | CAGCGACCAGCCAGGAAATCCAGC | 31 | 32 | 36 | 25 | 4 | 31 |
| 3382 | 3360 | 10249 | 77.4 | CAGCGTGCATACTGCGAAAGAGCC | 31 | 33 | 5 | 29 | 6 | 36 |
| 3383 | 3361 | 10251 | 76.5 | CAGCGTGCTACAAGTGCACGGGTA | 31 | 33 | 7 | 22 | 30 | 18 |
| 3384 | 3362 | 30753 | 80.8 | CAGCGTGCTCTGGATGGCAATCCC | 31 | 33 | 8 | 27 | 21 | 28 |
| 3385 | 3363 | 30754 | 77.8 | CAGCGTGCTCGTAGTGACGGCCTA | 31 | 33 | 10 | 22 | 35 | 26 |
| 3386 | 3364 | 10253 | 76.1 | CAGCGTGCCTGTAATCTGCGTGTC | 31 | 33 | 14 | 4 | 29 | 9 |
| 3387 | 3365 | 10254 | 80.2 | CAGCGTGCCGAACTGTGCTTCAGC | 31 | 33 | 16 | 14 | 17 | 31 |
| 3388 | 3366 | 10256 | 78.9 | CAGCGTGCGTCTCTTGCTTGCTCA | 31 | 33 | 19 | 11 | 11 | 13 |
| 3389 | 3367 | 30755 | 79.6 | CAGCGTGCACCTTCGTCACGACCT | 31 | 33 | 23 | 10 | 30 | 23 |
| 3390 | 3368 | 10259 | 83.5 | CAGCGTGCCACGCTTGTCGTGTGC | 31 | 33 | 30 | 11 | 10 | 33 |
| 3391 | 3369 | 10260 | 82.8 | CAGCGTGCGACCCACGGATGTTGA | 31 | 33 | 32 | 30 | 27 | 1 |
| 3392 | 3370 | 10262 | 80.5 | CAGCGTGCGGACATCGTGATACGG | 31 | 33 | 34 | 24 | 2 | 35 |
| 3393 | 3371 | 10263 | 83.4 | CAGCGTGCACGGCAGCGAGTCTCA | 31 | 33 | 35 | 31 | 20 | 13 |
| 3394 | 3372 | 10264 | 81.9 | CAGCGTGCAGCCCTCAACGGTCTG | 31 | 33 | 36 | 13 | 35 | 8 |
| 3395 | 3373 | 40861 | 77.2 | CAGCGGACTGATAGCCAGGACACG | 31 | 34 | 2 | 36 | 25 | 30 |
| 3396 | 3374 | 10265 | 76.5 | CAGCGGACAATCAAAGGCAACCAT | 31 | 34 | 4 | 6 | 21 | 15 |
| 3397 | 3375 | 30757 | 78.2 | CAGCGGACTGTCAATCCGAAAGCC | 31 | 34 | 9 | 4 | 16 | 36 |
| 3398 | 3376 | 10273 | 76.3 | CAGCGGACGAGTCGAAGCTTAGGA | 31 | 34 | 20 | 16 | 17 | 25 |
| 3399 | 3377 | 40864 | 78.3 | CAGCGGACACCTTACAAGCCAGCC | 31 | 34 | 23 | 7 | 36 | 36 |
| 3400 | 3378 | 30758 | 81.2 | CAGCGGACGATGGGACACCTCGAA | 31 | 34 | 27 | 34 | 23 | 16 |
| 3401 | 3379 | 16192 | 82.8 | CAGCGGACTGCGGTCTGGACGACC | 31 | 34 | 29 | 19 | 34 | 32 |
| 3402 | 3380 | 10278 | 81.6 | CAGCGGACCACGCCATGCTTTGTC | 31 | 34 | 30 | 15 | 17 | 9 |
| 3403 | 3381 | 10279 | 80 | CAGCGGACCAGCCCTACCATCAGC | 31 | 34 | 31 | 26 | 15 | 31 |
| 3404 | 3382 | 10280 | 82.6 | CAGCGGACACGGCGAACTGTGTGC | 31 | 34 | 35 | 16 | 14 | 33 |
| 3405 | 3383 | 40866 | 76.1 | CAGCACGGTTGAAATCCCTAACGG | 31 | 35 | 1 | 4 | 26 | 35 |
| 3406 | 3384 | 10283 | 77.8 | CAGCACGGTGATGATGCGTTAGCC | 31 | 35 | 2 | 27 | 12 | 36 |
| 3407 | 3385 | 40867 | 77 | CAGCACGGAATCTCTGGGTATGCG | 31 | 35 | 4 | 8 | 18 | 29 |
| 3408 | 3386 | 10285 | 75.6 | CAGCACGGATACAAAGCACGTCGT | 31 | 35 | 5 | 6 | 30 | 10 |
| 3409 | 3387 | 21913 | 78.1 | CAGCACGGCTGTGACCGCTTAGTG | 31 | 35 | 14 | 32 | 17 | 22 |
| 3410 | 3388 | 10291 | 79.7 | CAGCACGGCGAAGCTTGATGAGGA | 31 | 35 | 16 | 17 | 27 | 25 |
| 3411 | 3389 | 10292 | 79.1 | CAGCACGGGCTTGTCTCCTATGCG | 31 | 35 | 17 | 19 | 26 | 29 |
| 3412 | 3390 | 10293 | 76.4 | CAGCACGGGGTACGAATCCCTACA | 31 | 35 | 18 | 16 | 28 | 7 |
| 3413 | 3391 | 21915 | 76.4 | CAGCACGGGAGTATCGAGTGAGCC | 31 | 35 | 20 | 24 | 22 | 36 |
| 3414 | 3392 | 30759 | 78.6 | CAGCACGGACCTTCTGCGTTCCAT | 31 | 35 | 23 | 8 | 12 | 15 |
| 3415 | 3393 | 10295 | 78.5 | CAGCACGGATCGTCCCAGTGACCT | 31 | 35 | 24 | 28 | 22 | 23 |
| 3416 | 3394 | 10296 | 77.6 | CAGCACGGAGGAACCTGAGTGCAA | 31 | 35 | 25 | 23 | 20 | 21 |
| 3417 | 3395 | 16194 | 81.4 | CAGCACGGAGCCACCTGTGCCTGT | 31 | 35 | 36 | 23 | 33 | 14 |

FIG. 25PPP

| SEQ ID NO: | 4,633 ID# | HEX ID# | Tm | ZIPCODE (5'-3') | TETRAMER NUMBERS | | | | |
|---|---|---|---|---|---|---|---|---|---|
| 3418 | 3396 | 30760 | 76.5 | CAGCAGCCTGATAAAGAGCCACGG | 31 | 36 | 2 | 6 | 36 | 35 |
| 3419 | 3397 | 16195 | 79.4 | CAGCAGCCAATCCTTGGTGCCTCA | 31 | 36 | 4 | 11 | 33 | 13 |
| 3420 | 3398 | 30761 | 76.8 | CAGCAGCCTCTGTCGTGGACCCTA | 31 | 36 | 8 | 10 | 34 | 26 |
| 3421 | 3399 | 40870 | 82 | CAGCAGCCTGTCGTGCGCAAGACC | 31 | 36 | 9 | 33 | 21 | 32 |
| 3422 | 3400 | 10310 | 76.4 | CAGCAGCCCGTTCCTAAGGAACCT | 31 | 36 | 12 | 26 | 25 | 23 |
| 3423 | 3401 | 10315 | 78.1 | CAGCAGCCGTCTCTTGCTCAGCAA | 31 | 36 | 19 | 11 | 13 | 21 |
| 3424 | 3402 | 30762 | 79.8 | CAGCAGCCGAGTGAGTCACGCGTT | 31 | 36 | 20 | 20 | 30 | 12 |
| 3425 | 3403 | 10319 | 79.2 | CAGCAGCCACCTGATGTGTCGCAA | 31 | 36 | 23 | 27 | 9 | 21 |
| 3426 | 3404 | 30763 | 80.2 | CAGCAGCCGATGATCGCTCACAGC | 31 | 36 | 27 | 24 | 13 | 31 |
| 3427 | 3405 | 10322 | 77.8 | CAGCAGCCGACCTACATCCCGTCT | 31 | 36 | 32 | 7 | 28 | 19 |
| 3428 | 3406 | 16203 | 80.4 | GACCTTAGGCAAACGGCACGCGAA | 32 | 3 | 21 | 35 | 30 | 16 |
| 3429 | 3407 | 30764 | 77.9 | GACCAATCCGAACGAACGAAACGG | 32 | 4 | 16 | 16 | 16 | 35 |
| 3430 | 3408 | 10346 | 80.3 | GACCAATCGGACGTGCGGACTCGT | 32 | 4 | 34 | 33 | 34 | 10 |
| 3431 | 3409 | 30765 | 75.7 | GACCAAAGCGTTAGCCCTGTCAGC | 32 | 6 | 12 | 36 | 14 | 31 |
| 3432 | 3410 | 10356 | 79.9 | GACCAAAGATCGCGTTGTGCTGCG | 32 | 6 | 24 | 12 | 33 | 29 |
| 3433 | 3411 | 10357 | 80.7 | GACCAAAGGATGCACGGACCTGCG | 32 | 6 | 27 | 30 | 32 | 29 |
| 3434 | 3412 | 10360 | 78.9 | GACCAAAGGGACGACCAGGAACGG | 32 | 6 | 34 | 32 | 25 | 35 |
| 3435 | 3413 | 16210 | 80.2 | GACCTCTGGTGCCAGCGCTTGGAC | 32 | 8 | 33 | 31 | 17 | 34 |
| 3436 | 3414 | 10372 | 79.2 | GACCTCTGACGGCGTTTCGTTCCC | 32 | 8 | 35 | 12 | 10 | 28 |
| 3437 | 3415 | 10375 | 76.9 | GACCTGTCGTGCAAAGCCATGACC | 32 | 9 | 33 | 6 | 15 | 32 |
| 3438 | 3416 | 30766 | 79 | GACCTCGTCGAATGCGGTCTGTGC | 32 | 10 | 16 | 29 | 19 | 33 |
| 3439 | 3417 | 10378 | 77.6 | GACCTCGTGGTATCCCGTGCGAGT | 32 | 10 | 18 | 28 | 33 | 20 |
| 3440 | 3418 | 10379 | 77.9 | GACCTCGTCACGGCTTACGGCTGT | 32 | 10 | 30 | 17 | 35 | 14 |
| 3441 | 3419 | 30767 | 76.9 | GACCCTTGCGAATCGTTACATGCG | 32 | 11 | 16 | 10 | 7 | 29 |
| 3442 | 3420 | 30768 | 75.6 | GACCCTTGGGTACCATTCCCCCTA | 32 | 11 | 18 | 15 | 28 | 26 |
| 3443 | 3421 | 30769 | 79.4 | GACCCTTGCAGCCCTACAGCCAGC | 32 | 11 | 31 | 26 | 31 | 31 |
| 3444 | 3422 | 16219 | 75.7 | GACCCGTTTACAGTGCGGACCTGT | 32 | 12 | 7 | 33 | 34 | 14 |
| 3445 | 3423 | 10396 | 78 | GACCCGTTTCTGCACGGTCTGACC | 32 | 12 | 8 | 30 | 19 | 32 |
| 3446 | 3424 | 30770 | 76.3 | GACCCGTTCTCAGCTTTCCCGAGT | 32 | 12 | 13 | 17 | 28 | 20 |
| 3447 | 3425 | 30771 | 77 | GACCCGTTGGTACAGCAATCTGCG | 32 | 12 | 18 | 31 | 4 | 29 |
| 3448 | 3426 | 10402 | 77.7 | GACCCGTTAGTGTTGATGCGCACG | 32 | 12 | 22 | 1 | 29 | 30 |
| 3449 | 3427 | 30772 | 78.3 | GACCCGTTAGGATCCCCCATCGAA | 32 | 12 | 25 | 28 | 15 | 16 |
| 3450 | 3428 | 40880 | 78.4 | GACCCGTTGATGATCGCAGCCCTA | 32 | 12 | 27 | 24 | 31 | 26 |
| 3451 | 3429 | 10404 | 77.8 | GACCCGTTTGCGAATCTGTCGCTT | 32 | 12 | 29 | 4 | 9 | 17 |
| 3452 | 3430 | 21938 | 77.4 | GACCCGTTCACGTGATGCTTCGAA | 32 | 12 | 30 | 2 | 17 | 16 |
| 3453 | 3431 | 10405 | 78.9 | GACCCGTTCAGCGGTATCTGTGCG | 32 | 12 | 31 | 18 | 8 | 29 |
| 3454 | 3432 | 10406 | 80.8 | GACCCGTTGTGCGGACACCTCAGC | 32 | 12 | 33 | 34 | 23 | 31 |
| 3455 | 3433 | 10422 | 76.6 | GACCCTGTGCAAGGTATGCGAGGA | 32 | 14 | 21 | 18 | 29 | 25 |
| 3456 | 3434 | 40883 | 78 | GACCCATTTGAGCAAGTGCGACC | 32 | 15 | 1 | 21 | 33 | 32 |
| 3457 | 3435 | 40885 | 79.5 | GACCCATGGTACTTGTGCGCACG | 32 | 15 | 18 | 11 | 29 | 30 |
| 3458 | 3436 | 16237 | 80.7 | GACCCATCACGGAGTGACCTGCG | 32 | 15 | 30 | 20 | 32 | 29 |
| 3459 | 3437 | 16239 | 78.5 | GACCCATACGGGGTACACGGACC | 32 | 15 | 35 | 18 | 30 | 32 |
| 3460 | 3438 | 30773 | 77.6 | GACCCGAATTGAAGGATCCCCGTT | 32 | 16 | 1 | 25 | 28 | 12 |
| 3461 | 3439 | 40890 | 76.4 | GACCCGAAGGTACCATCGAAAGCC | 32 | 16 | 18 | 15 | 16 | 36 |
| 3462 | 3440 | 10453 | 76.9 | GACCCGAAATCGGCTTCTCACGTT | 32 | 16 | 24 | 17 | 13 | 12 |
| 3463 | 3441 | 16250 | 79 | GACCCGAAACGGGCTTAGGACACG | 32 | 16 | 35 | 17 | 25 | 30 |
| 3464 | 3442 | 10460 | 75.6 | GACCGCTTTGATGGTAATCGCCAT | 32 | 17 | 2 | 18 | 24 | 15 |
| 3465 | 3443 | 30775 | 82.7 | GACCGCTTTGTCGGACCAGCGTGC | 32 | 17 | 9 | 34 | 31 | 33 |
| 3466 | 3444 | 16254 | 77.2 | GACCGCTTCTGTCCATGAGTTGCG | 32 | 17 | 14 | 15 | 20 | 29 |
| 3467 | 3445 | 30776 | 75.6 | GACCGCTTGCTTACGGAAAGGATG | 32 | 17 | 17 | 35 | 6 | 27 |
| 3468 | 3446 | 40894 | 76.2 | GACCGCTTATCGAATCGGTATGCG | 32 | 17 | 24 | 4 | 18 | 29 |

FIG. 25QQQ

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 3469 | 3447 | 30777 | 75.7 | GACCGCTTCCTAAGGAAGCCGTCT | 32 | 17 | 26 | 25 | 36 | 19 |
| 3470 | 3448 | 30778 | 81.3 | GACCGCTTTGCGTCGTGTGCACCT | 32 | 17 | 29 | 10 | 33 | 23 |
| 3471 | 3449 | 16256 | 77.3 | GACCGCTTGTGCAATCCGTTGGTA | 32 | 17 | 33 | 4 | 12 | 18 |
| 3472 | 3450 | 10478 | 80.4 | GACCGGTATTGATGCGACGGACGG | 32 | 18 | 1 | 29 | 35 | 35 |
| 3473 | 3451 | 30779 | 78.7 | GACCGGTACGTTGGACCTCATGCG | 32 | 18 | 12 | 34 | 13 | 29 |
| 3474 | 3452 | 16261 | 76.9 | GACCGGTACGAAGACCGGACTCGT | 32 | 18 | 16 | 32 | 34 | 10 |
| 3475 | 3453 | 40896 | 76.7 | GACCGGTAGCTTCACGAATCGCAA | 32 | 18 | 17 | 30 | 4 | 21 |
| 3476 | 3454 | 10487 | 76.5 | GACCGGTAGGTAGCTTTCCCCACG | 32 | 18 | 18 | 17 | 28 | 30 |
| 3477 | 3455 | 30780 | 76.1 | GACCGGTAAGGAAGGAACGGCCTA | 32 | 18 | 25 | 25 | 35 | 26 |
| 3478 | 3456 | 10491 | 77.7 | GACCGGTATGCGTGCGTGATTCTG | 32 | 18 | 29 | 29 | 2 | 8 |
| 3479 | 3457 | 40898 | 78.7 | GACCGTCTTCGTTTGAAGCCGCAA | 32 | 19 | 10 | 1 | 36 | 21 |
| 3480 | 3458 | 10498 | 76.7 | GACCGTCTCGAACAGCATCGTCGT | 32 | 19 | 16 | 31 | 24 | 10 |
| 3481 | 3459 | 16265 | 76 | GACCGTCTGCTTTGATGGACGCTT | 32 | 19 | 17 | 2 | 34 | 17 |
| 3482 | 3460 | 10503 | 79.9 | GACCGTCTGACCGTGCCTTGTCCC | 32 | 19 | 32 | 33 | 11 | 28 |
| 3483 | 3461 | 10509 | 75.6 | GACCGAGTGGTAAAAGACGGCAGC | 32 | 20 | 18 | 6 | 35 | 31 |
| 3484 | 3462 | 10512 | 79.2 | GACCGAGTGTGCCGTTGCAACCAT | 32 | 20 | 33 | 12 | 21 | 15 |
| 3485 | 3463 | 10513 | 78.3 | GACCGAGTGGACACGGTCGTCCAT | 32 | 20 | 34 | 35 | 10 | 15 |
| 3486 | 3464 | 10514 | 79.1 | GACCGAGTAGCCGATGCAGCGATG | 32 | 20 | 36 | 27 | 31 | 27 |
| 3487 | 3465 | 30781 | 78.9 | GACCGCAATGATACGGCGAACAGC | 32 | 21 | 2 | 35 | 16 | 31 |
| 3488 | 3466 | 21954 | 77.1 | GACCGCAAAATCTGTCCTGTTGCG | 32 | 21 | 4 | 9 | 14 | 29 |
| 3489 | 3467 | 40904 | 76.3 | GACCGCAATCTGTGATTCCCGGTA | 32 | 21 | 8 | 2 | 28 | 18 |
| 3490 | 3468 | 30782 | 77.7 | GACCGCAACTTGTGATGTGCGACC | 32 | 21 | 11 | 2 | 33 | 32 |
| 3491 | 3469 | 30783 | 77.4 | GACCGCAAGCTTTTGATCCCCTTG | 32 | 21 | 17 | 1 | 28 | 11 |
| 3492 | 3470 | 30784 | 80 | GACCGCAAGTCTCACGCGTTCACG | 32 | 21 | 19 | 30 | 12 | 30 |
| 3493 | 3471 | 10528 | 76.9 | GACCGCAAGAGTTGATGGACACGG | 32 | 21 | 20 | 2 | 34 | 35 |
| 3494 | 3472 | 10529 | 78.3 | GACCGCAAAGTGGATGGATGCGTT | 32 | 21 | 22 | 27 | 27 | 12 |
| 3495 | 3474 | 30785 | 80.1 | GACCGCAATCCCCCATTCCCTGAT | 32 | 21 | 28 | 15 | 28 | 2 |
| 3496 | 3475 | 10537 | 80.2 | GACCAGTGTGCGGAGTGACCGCAA | 32 | 22 | 29 | 20 | 32 | 21 |
| 3497 | 3476 | 10538 | 81.2 | GACCAGTGCACGCTCACACGGCAA | 32 | 22 | 30 | 13 | 30 | 21 |
| 3498 | 3477 | 16277 | 81.4 | GACCAGTGAGCCGACCGACCCGTT | 32 | 22 | 36 | 32 | 32 | 12 |
| 3499 | 3478 | 10545 | 79.5 | GACCACCTCACGGATGCCATCACG | 32 | 23 | 30 | 27 | 15 | 30 |
| 3500 | 3479 | 40906 | 78.7 | GACCACCTACGGGCTTAGCCCGAA | 32 | 23 | 35 | 17 | 36 | 16 |
| 3501 | 3480 | 10550 | 77.4 | GACCATCGCTCAAGCCCTCAGGAC | 32 | 24 | 13 | 36 | 13 | 34 |
| 3502 | 3481 | 30786 | 78.3 | GACCATCGCGAATCCCCTGTTTGA | 32 | 24 | 16 | 28 | 14 | 1 |
| 3503 | 3482 | 16287 | 75.3 | GACCAGGACCATACGGCCATTGAT | 32 | 25 | 15 | 35 | 15 | 2 |
| 3504 | 3483 | 10566 | 77.2 | GACCAGGAATCGCGAAGATGGACC | 32 | 25 | 24 | 16 | 27 | 32 |
| 3505 | 3484 | 16289 | 78.3 | GACCAGGATCCCGCTTGAGTTCCC | 32 | 25 | 28 | 17 | 20 | 28 |
| 3506 | 3485 | 10570 | 78.7 | GACCAGGAGTGCCTTGGCTTGCAA | 32 | 25 | 33 | 11 | 17 | 21 |
| 3507 | 3486 | 10573 | 77.9 | GACCCCTACTTGCCATCACGGTGC | 32 | 26 | 11 | 15 | 30 | 33 |
| 3508 | 3487 | 40909 | 75.5 | GACCCCTACGTTAGGAACGGGACC | 32 | 26 | 12 | 25 | 35 | 32 |
| 3509 | 3488 | 30787 | 75.8 | GACCCCTACGAAGGTAAGCCCAGC | 32 | 26 | 16 | 18 | 36 | 31 |
| 3510 | 3489 | 30788 | 79.2 | GACCCCTAGCAACACGACGGAGCC | 32 | 26 | 21 | 30 | 35 | 36 |
| 3511 | 3490 | 10581 | 76.3 | GACCCCTAGTGCTGTCAGGATGCG | 32 | 26 | 33 | 9 | 25 | 29 |
| 3512 | 3491 | 16294 | 78.6 | GACCCCTAGGACAGCCGCAACCAT | 32 | 26 | 34 | 36 | 21 | 15 |
| 3513 | 3494 | 40915 | 79 | GACCGATGATCGTGCGCCTAGTGC | 32 | 27 | 24 | 29 | 26 | 33 |
| 3514 | 3495 | 16299 | 77.8 | GACCGATGAGGAATCGGGACGATG | 32 | 27 | 25 | 24 | 34 | 27 |
| 3515 | 3496 | 10595 | 77.3 | GACCGATGTGCGTCGTATCGTCGT | 32 | 27 | 29 | 10 | 24 | 10 |
| 3516 | 3497 | 16302 | 78.9 | GACCGATGCAGCCCTACACGATCG | 32 | 27 | 31 | 26 | 30 | 24 |
| 3517 | 3498 | 16303 | 80.4 | GACCGATGGTGCCAGCAGGAAGGA | 32 | 27 | 33 | 31 | 25 | 25 |
| 3518 | 3499 | 30791 | 77.2 | GACCGATGAGCCTCTGGGTAACGG | 32 | 27 | 36 | 8 | 18 | 35 |
| 3519 | 3500 | 10602 | 77.1 | GACCTCCCAAAGCGAAGATGCGTT | 32 | 28 | 6 | 16 | 27 | 12 |

FIG. 25RRR

| SEQ ID NO: | 4,633 ID# | HEX ID# | Tm | ZIPCODE (5'-3') | TETRAMER NUMBERS | | | | |
|---|---|---|---|---|---|---|---|---|---|
| 3520 | 3502 | 10611 | 79.7 | GACCTCCCAGTGGTGCGCTTTCGT | 32 28 | 22 | 33 | 17 | 10 |
| 3521 | 3503 | 10612 | 76.1 | GACCTCCCACCTTACACGAATGCG | 32 28 | 23 | 7 | 16 | 29 |
| 3522 | 3504 | 10619 | 77.3 | GACCTCCCGGACTCTGCGAATGTC | 32 28 | 34 | 8 | 16 | 9 |
| 3523 | 3505 | 10621 | 79.3 | GACCTCCCAGCCCGTTGCTTTCTG | 32 28 | 36 | 12 | 17 | 8 |
| 3524 | 3506 | 30793 | 76.9 | GACCTGCGTTGAGTCTACGGCGAA | 32 29 | 1 | 19 | 35 | 16 |
| 3525 | 3507 | 10626 | 76 | GACCTGCGTCGTACCTGATGGACC | 32 29 | 10 | 23 | 27 | 32 |
| 3526 | 3508 | 10629 | 76.3 | GACCTGCGGAGTCTGTATCGACGG | 32 29 | 20 | 14 | 24 | 35 |
| 3527 | 3509 | 10631 | 78.2 | GACCTGCGATCGGTCTACCTTGCG | 32 29 | 24 | 19 | 23 | 29 |
| 3528 | 3510 | 30794 | 76.2 | GACCTGCGCCTAAGGAAAAGAGCC | 32 29 | 26 | 25 | 6 | 36 |
| 3529 | 3511 | 10634 | 82.2 | GACCTGCGTGCGCGTTTGTCAGGA | 32 29 | 29 | 12 | 9 | 25 |
| 3530 | 3512 | 10637 | 81.2 | GACCTGCGGTGCCACGAGGATTGA | 32 29 | 33 | 30 | 25 | 1 |
| 3531 | 3513 | 10638 | 78.2 | GACCCACGTTAGGGACGATGGCAA | 32 30 | 3 | 34 | 27 | 21 |
| 3532 | 3514 | 10639 | 80.5 | GACCCACGTGTCCCATGACCCAGC | 32 30 | 9 | 15 | 32 | 31 |
| 3533 | 3515 | 10640 | 76.8 | GACCCACGCTGTCAGCGTCTCCTA | 32 30 | 14 | 31 | 19 | 26 |
| 3534 | 3516 | 10644 | 75.8 | GACCCACGCCTATCGTCTCAAGGA | 32 30 | 26 | 10 | 13 | 25 |
| 3535 | 3517 | 10651 | 80.9 | GACCCACGAGCCGCAAGACCAGTG | 32 30 | 36 | 21 | 32 | 22 |
| 3536 | 3518 | 40923 | 77.5 | GACCCAGCTTGATACATGCGCGAA | 32 31 | 1 | 7 | 29 | 16 |
| 3537 | 3519 | 10654 | 78.7 | GACCCAGCATACCTTGGCAATGCG | 32 31 | 5 | 11 | 21 | 29 |
| 3538 | 3520 | 10655 | 75.8 | GACCCAGCTACACTTGGTGCCGTT | 32 31 | 7 | 11 | 33 | 12 |
| 3539 | 3521 | 16324 | 75.9 | GACCCAGCGGTAGCTTTGTCGGTA | 32 31 | 18 | 17 | 9 | 18 |
| 3540 | 3522 | 10662 | 78.6 | GACCCAGCAGTGGACCAAAGCGAA | 32 31 | 22 | 32 | 6 | 16 |
| 3541 | 3523 | 40926 | 80 | GACCCAGCGATGCCATTGTCCCAT | 32 31 | 27 | 15 | 9 | 15 |
| 3542 | 3524 | 30796 | 81.7 | GACCCAGCGTGCAGGATGTCGTGC | 32 31 | 33 | 25 | 9 | 33 |
| 3543 | 3525 | 10665 | 79.6 | GACCCAGCAGCCGCAAAATCACCT | 32 31 | 36 | 21 | 4 | 23 |
| 3544 | 3526 | 16328 | 75.2 | GACCGACCTGATAGCCCCATATCG | 32 32 | 2 | 36 | 15 | 24 |
| 3545 | 3527 | 10668 | 78.5 | GACCGACCAAAGGTCTGACCGCAA | 32 32 | 6 | 19 | 32 | 21 |
| 3546 | 3528 | 10670 | 78.5 | GACCGACCTCTGCGAAGGACTCCC | 32 32 | 8 | 16 | 34 | 28 |
| 3547 | 3529 | 16329 | 75.3 | GACCGACCCTGTAAAGCAGCGTCT | 32 32 | 14 | 6 | 31 | 19 |
| 3548 | 3530 | 30797 | 78.7 | GACCGACCACCTGCAACGTTACGG | 32 32 | 23 | 21 | 12 | 35 |
| 3549 | 3531 | 10680 | 81.7 | GACCGACCGTGCCTCATCTGCACG | 32 32 | 33 | 13 | 8 | 30 |
| 3550 | 3532 | 16333 | 77 | GACCGTGCTTAGGCTTACGGCAT | 32 33 | 3 | 17 | 35 | 15 |
| 3551 | 3533 | 21989 | 75.3 | GACCGTGCATACTCGTCTTGCAGC | 32 33 | 5 | 10 | 11 | 31 |
| 3552 | 3534 | 10690 | 78 | GACCGTGCCGAAGGTAAGTGACGG | 32 33 | 16 | 18 | 22 | 35 |
| 3553 | 3535 | 10691 | 75.4 | GACCGTGCGTCTCTCAAAAGGCTT | 32 33 | 19 | 13 | 6 | 17 |
| 3554 | 3536 | 10693 | 80.7 | GACCGTGCGCAATCGTGTCTCACG | 32 33 | 21 | 10 | 19 | 30 |
| 3555 | 3537 | 40932 | 79.6 | GACCGTGCAGTGTCTGTGCGGCTT | 32 33 | 22 | 8 | 29 | 17 |
| 3556 | 3538 | 30798 | 78.3 | GACCGTGCACCTCTCACGAAAGCC | 32 33 | 23 | 13 | 16 | 36 |
| 3557 | 3539 | 30799 | 78.4 | GACCGTGCAGGACCATGGACGAGT | 32 33 | 25 | 15 | 34 | 20 |
| 3558 | 3540 | 10697 | 81.3 | GACCGTGCTGCGGTCTGCAACGTT | 32 33 | 29 | 19 | 21 | 12 |
| 3559 | 3541 | 10698 | 81.7 | GACCGTGCCACGCTCACTTGACGG | 32 33 | 30 | 13 | 11 | 35 |
| 3560 | 3542 | 10699 | 80.5 | GACCGTGCCAGCCTCATCTGCGTT | 32 33 | 31 | 13 | 8 | 12 |
| 3561 | 3543 | 21992 | 80 | GACCGTGCGTGCGCTTGAGTTGTC | 32 33 | 33 | 17 | 20 | 9 |
| 3562 | 3544 | 10706 | 78.9 | GACCGGACCGTTCAGCGATGAGTG | 32 34 | 12 | 31 | 27 | 22 |
| 3563 | 3545 | 40935 | 79.7 | GACCGGACCTGTGGACCGTTGACC | 32 34 | 14 | 34 | 12 | 32 |
| 3564 | 3546 | 10709 | 77.9 | GACCGGACCGAAAATCTGTCACGG | 32 34 | 16 | 4 | 9 | 35 |
| 3565 | 3547 | 30800 | 79.4 | GACCGGACGCAAGCAAGCAATTGA | 32 34 | 21 | 21 | 21 | 1 |
| 3566 | 3548 | 10713 | 77.5 | GACCGGACATCGATCGATCGACCT | 32 34 | 24 | 24 | 24 | 23 |
| 3567 | 3549 | 40937 | 82.2 | GACCGGACCAGCGTCTCAGCAGCC | 32 34 | 31 | 19 | 31 | 36 |
| 3568 | 3550 | 30801 | 81.4 | GACCGGACGACCCTCACACGGCTT | 32 34 | 32 | 13 | 30 | 17 |
| 3569 | 3551 | 10715 | 80.4 | GACCGGACGTGCCTCAATCGCTGT | 32 34 | 33 | 13 | 24 | 14 |
| 3570 | 3552 | 10716 | 79.5 | GACCGGACACGGGTCTGCTTCGTT | 32 34 | 35 | 19 | 17 | 12 |

*FIG. 25SSS*

| SEQ ID NO: | 4,633 ID# | HEX ID# | Tm | ZIPCODE (5'-3') | TETRAMER NUMBERS | | | | |
|---|---|---|---|---|---|---|---|---|---|
| 3571 | 3553 | 16341 | 75.8 | GACCACGGTCGTAATCGATGTCCC | 32 | 35 | 10 | 4 | 27 28 |
| 3572 | 3554 | 10722 | 76.6 | GACCACGGCTTGATCGTGATGCTT | 32 | 35 | 11 | 24 | 2 17 |
| 3573 | 3555 | 10723 | 79.3 | GACCACGGCGTTGTCTGTGCCCTA | 32 | 35 | 12 | 19 | 33 26 |
| 3574 | 3556 | 30802 | 77.6 | GACCACGGCTGTATACCACGTGCG | 32 | 35 | 14 | 5 | 30 29 |
| 3575 | 3557 | 16342 | 75.3 | GACCACGGGTATTAGACGGCTTG | 32 | 35 | 18 | 3 | 35 11 |
| 3576 | 3558 | 10726 | 75 | GACCACGGGTCTAGGATGTCGCTT | 32 | 35 | 19 | 25 | 9 17 |
| 3577 | 3559 | 40939 | 76.1 | GACCACGGGAGTATACAGCCGTGC | 32 | 35 | 20 | 5 | 36 33 |
| 3578 | 3560 | 16343 | 77.6 | GACCACGGCAGCTCGTTTAGAGCC | 32 | 35 | 31 | 10 | 3 36 |
| 3579 | 3561 | 30804 | 80.1 | GACCACGGAGCCAGCCACCTTCTG | 32 | 35 | 36 | 36 | 23 8 |
| 3580 | 3562 | 10735 | 76.9 | GACCAGCCAATCACGGCTGTTGTC | 32 | 36 | 4 | 35 | 14 9 |
| 3581 | 3563 | 10736 | 77.2 | GACCAGCCAAAGCGTTGCAACTTG | 32 | 36 | 6 | 12 | 21 11 |
| 3582 | 3564 | 10738 | 76 | GACCAGCCTCGTCCATAATCACGG | 32 | 36 | 10 | 15 | 4 35 |
| 3583 | 3565 | 10741 | 78 | GACCAGCCCCATGCTTCGTTTGTC | 32 | 36 | 15 | 17 | 12 9 |
| 3584 | 3566 | 10742 | 78.5 | GACCAGCCGCTTCGAACTCAGTGC | 32 | 36 | 17 | 16 | 13 33 |
| 3585 | 3567 | 30805 | 81.5 | GACCAGCCAGTGAGCCAGCCCCAT | 32 | 36 | 22 | 36 | 36 15 |
| 3586 | 3568 | 30806 | 76.5 | GACCAGCCATCGTACAATCGCGTT | 32 | 36 | 24 | 7 | 24 12 |
| 3587 | 3569 | 30807 | 77.5 | GACCAGCCCCTAAATCTGCGCTTG | 32 | 36 | 26 | 4 | 29 11 |
| 3588 | 3570 | 10748 | 81.4 | GACCAGCCTCCCGGACAGTGCCAT | 32 | 36 | 28 | 34 | 22 15 |
| 3589 | 3571 | 10749 | 79.5 | GACCAGCCTGCGTGTCCGTTCTCA | 32 | 36 | 29 | 9 | 12 13 |
| 3590 | 3572 | 10750 | 81.3 | GACCAGCCGACCGATGCTCACGAA | 32 | 36 | 32 | 27 | 13 16 |
| 3591 | 3573 | 10753 | 77.3 | GTGCTTGAGCTTATCGGCAATGCG | 33 | 1 | 17 | 24 | 21 29 |
| 3592 | 3574 | 10758 | 83.3 | GTGCTTGAGTGCGTGCTGCGCGAA | 33 | 1 | 33 | 33 | 29 16 |
| 3593 | 3575 | 22007 | 77.7 | GTGCTGATCCATGTGCCTTGACGG | 33 | 2 | 15 | 33 | 11 35 |
| 3594 | 3576 | 10763 | 81.5 | GTGCTGATGTGCCGTTTGCGGGAC | 33 | 2 | 33 | 12 | 29 34 |
| 3595 | 3577 | 10775 | 76.5 | GTGCAATCCGAACGTTGGACTCGT | 33 | 4 | 16 | 12 | 34 10 |
| 3596 | 3578 | 10776 | 75 | GTGCAATCGGTATCGTCGAAATCG | 33 | 4 | 18 | 10 | 16 24 |
| 3597 | 3579 | 10780 | 77.5 | GTGCAATCGATGAGCCCCATGATG | 33 | 4 | 27 | 36 | 15 27 |
| 3598 | 3580 | 10781 | 77.1 | GTGCAATCTCCCGCAAATACTGCG | 33 | 4 | 28 | 21 | 5 29 |
| 3599 | 3581 | 22013 | 76.6 | GTGCAATCCACGGATGTCTGTCCC | 33 | 4 | 30 | 27 | 8 28 |
| 3600 | 3582 | 30809 | 79.8 | GTGCAATCCAGCAGCCCACGTCTG | 33 | 4 | 31 | 36 | 30 8 |
| 3601 | 3583 | 16358 | 78.5 | GTGCATACCACGGCAAATCGGGAC | 33 | 5 | 30 | 21 | 24 34 |
| 3602 | 3584 | 10792 | 81.4 | GTGCATACAGCCACGGTGCGTCCC | 33 | 5 | 36 | 35 | 29 28 |
| 3603 | 3585 | 10793 | 78.4 | GTGCAAAGTCGTCGAACACGCGAA | 33 | 6 | 10 | 16 | 30 16 |
| 3604 | 3586 | 10799 | 75.6 | GTGCAAAGCCTAATCGGCAAGACC | 33 | 6 | 26 | 24 | 21 32 |
| 3605 | 3587 | 16360 | 79.4 | GTGCAAAGCAGCCAGCAGTGAGCC | 33 | 6 | 31 | 31 | 22 36 |
| 3606 | 3588 | 30810 | 77.4 | GTGCAAAGGACCATCGGCTTAGCC | 33 | 6 | 32 | 24 | 17 36 |
| 3607 | 3589 | 10808 | 78.1 | GTGCTCTGGGTAATCGGGACTGCG | 33 | 8 | 18 | 24 | 34 29 |
| 3608 | 3590 | 10809 | 79.5 | GTGCTCTGCCTAGCTTTGCGCACG | 33 | 8 | 26 | 17 | 29 30 |
| 3609 | 3591 | 10810 | 78.7 | GTGCTCTGTGCGCGTTAGTGCGAA | 33 | 8 | 29 | 12 | 22 16 |
| 3610 | 3592 | 16367 | 77.5 | GTGCTGTCCGAAACGGCTGTTTGA | 33 | 9 | 16 | 35 | 14 1 |
| 3611 | 3593 | 16368 | 80.9 | GTGCTGTCCACGGGACACGGGGTA | 33 | 9 | 30 | 34 | 35 18 |
| 3612 | 3594 | 16369 | 81.4 | GTGCTGTCGACCGACCCAGCCTCA | 33 | 9 | 32 | 32 | 31 13 |
| 3613 | 3595 | 10823 | 79.9 | GTGCTGTCACGGGTCTTCCCGGAC | 33 | 9 | 35 | 19 | 28 34 |
| 3614 | 3596 | 10825 | 77.3 | GTGCTCGTTGATAGCCGCTTCACG | 33 | 10 | 2 | 36 | 17 30 |
| 3615 | 3597 | 10828 | 78.4 | GTGCTCGTCTTGTGTCACGGCGAA | 33 | 10 | 11 | 9 | 35 16 |
| 3616 | 3598 | 10834 | 76.9 | GTGCTCGTAGGAAATCAGCCGCAA | 33 | 10 | 25 | 4 | 36 21 |
| 3617 | 3599 | 10836 | 78.8 | GTGCTCGTTCCCCGTTTTGACACG | 33 | 10 | 28 | 12 | 1 30 |
| 3618 | 3600 | 16374 | 80.4 | GTGCTCGTGGACGGACGCTTCCAT | 33 | 10 | 34 | 34 | 17 15 |
| 3619 | 3601 | 22025 | 77.5 | GTGCTCGTAGCCTCTGACGGGGAC | 33 | 10 | 36 | 8 | 35 34 |
| 3620 | 3602 | 10843 | 80.1 | GTGCCTTGTTGATCCCGTGCCGTT | 33 | 11 | 1 | 28 | 33 12 |
| 3621 | 3603 | 10844 | 76.9 | GTGCCTTGAAAGGCAACTTGCGAA | 33 | 11 | 6 | 21 | 11 16 |

FIG. 25TTT

| SEQ ID NO: | 4,633 ID# | HEX ID# | Tm | ZIPCODE (5'-3') | TETRAMER NUMBERS |
|---|---|---|---|---|---|
| 3622 | 3604 | 30811 | 80.5 | GTGCCTTGGTCTGGACTGCGCGTT | 33 11 19 34 29 12 |
| 3623 | 3605 | 40950 | 78.2 | GTGCCTTGAGGAGTGCTCCCGATG | 33 11 25 33 28 27 |
| 3624 | 3606 | 10852 | 75.3 | GTGCCTTGCCTATCGTATCGTCCC | 33 11 26 10 24 28 |
| 3625 | 3607 | 10853 | 78.5 | GTGCCTTGGATGGCTTCGAACGAA | 33 11 27 17 16 16 |
| 3626 | 3608 | 10855 | 77.6 | GTGCCTTGCAGCTGTCAGTGCCAT | 33 11 31 9 22 15 |
| 3627 | 3609 | 30812 | 78.3 | GTGCCGTTTTGAAGGAGACCTGCG | 33 12 1 25 32 29 |
| 3628 | 3610 | 30813 | 76.6 | GTGCCGTTTTAGATCGGATGCGAA | 33 12 3 24 27 16 |
| 3629 | 3611 | 30814 | 76.8 | GTGCCGTTTCTGTGCGATACGCTT | 33 12 8 29 5 17 |
| 3630 | 3612 | 30815 | 77.1 | GTGCCGTTCTGTAATCGTGCAGCC | 33 12 14 4 33 36 |
| 3631 | 3613 | 40952 | 78.6 | GTGCCGTTCCATTTGACACGTCCC | 33 12 15 1 30 28 |
| 3632 | 3614 | 30816 | 77.5 | GTGCCGTTGGTAGACCCGTTTCGT | 33 12 18 32 12 10 |
| 3633 | 3615 | 40953 | 76.8 | GTGCCGTTGAGTAGCCGCAACCTA | 33 12 20 36 21 26 |
| 3634 | 3616 | 30817 | 76.6 | GTGCCGTTGATGTCTGGCTTTCGT | 33 12 27 8 17 10 |
| 3635 | 3617 | 30818 | 78.3 | GTGCCGTTTCCCTTAGTCCCCAGC | 33 12 28 3 28 31 |
| 3636 | 3618 | 10869 | 80.5 | GTGCCGTTGGACGACCAATCGACC | 33 12 34 32 4 32 |
| 3637 | 3619 | 10870 | 77.6 | GTGCCTCATTGACACGGGTATGCG | 33 13 1 30 18 29 |
| 3638 | 3620 | 10874 | 75.6 | GTGCCTCACCATAGCCCGTTTGAT | 33 13 15 36 12 2 |
| 3639 | 3621 | 10877 | 80.8 | GTGCCTCAAGTGGGACCAGCCACG | 33 13 22 34 31 30 |
| 3640 | 3622 | 10880 | 75.1 | GTGCCTCACCTACTTGACGGGCTT | 33 13 26 11 35 17 |
| 3641 | 3623 | 10881 | 77.7 | GTGCCTCATCCCTGATGATGCACG | 33 13 28 2 27 30 |
| 3642 | 3624 | 30819 | 79 | GTGCCTCAAGCCTGATGGACGTGC | 33 13 36 2 34 33 |
| 3643 | 3625 | 10886 | 81.7 | GTGCCTGTTCTGTGCGTCCCGTGC | 33 14 8 29 28 33 |
| 3644 | 3626 | 10890 | 82.5 | GTGCCTGTGATGCACGGCTTTGCG | 33 14 27 30 17 29 |
| 3645 | 3627 | 30820 | 77.7 | GTGCCCATTTGACGAAGTGCATCG | 33 15 1 16 33 24 |
| 3646 | 3628 | 40960 | 79.5 | GTGCCCATTCTGATCGTCCCGCTT | 33 15 8 24 28 17 |
| 3647 | 3629 | 30821 | 78.6 | GTGCCCATTGTCTGTCCAGCGCTT | 33 15 9 9 31 17 |
| 3648 | 3630 | 16391 | 75.9 | GTGCCCATTCGTACGGGTCTTGTC | 33 15 10 35 19 9 |
| 3649 | 3631 | 16393 | 77.2 | GTGCCCATCTCAATACGGACGCAA | 33 15 13 5 34 21 |
| 3650 | 3632 | 40963 | 78.3 | GTGCCCATAGGAGTGCGATGCCAT | 33 15 25 33 27 15 |
| 3651 | 3633 | 40964 | 78.1 | GTGCCCATCCTACACGGACCGGTA | 33 15 26 30 32 18 |
| 3652 | 3634 | 10910 | 80.5 | GTGCCCATTGCGGAGTACGGATCG | 33 15 29 20 35 24 |
| 3653 | 3635 | 10911 | 78.9 | GTGCCCATCAGCCTGTACCTTGCG | 33 15 31 14 23 29 |
| 3654 | 3636 | 40967 | 77.7 | GTGCCGAATTGAGATGGATGCACG | 33 16 1 27 27 30 |
| 3655 | 3637 | 30822 | 75.5 | GTGCCGAATGATAATCCAGCCCAT | 33 16 2 4 31 15 |
| 3656 | 3638 | 10914 | 75.3 | GTGCCGAAAATCAATCGAGTTCCC | 33 16 4 4 20 28 |
| 3657 | 3639 | 16396 | 77 | GTGCCGAAAAAGGGTATCCCATCG | 33 16 6 18 28 24 |
| 3658 | 3640 | 22045 | 78.5 | GTGCCGAATGTCGATGTGATTGCG | 33 16 9 27 2 29 |
| 3659 | 3641 | 10918 | 77.2 | GTGCCGAACGTTTGATGACCGGTA | 33 16 12 2 32 18 |
| 3660 | 3642 | 30823 | 78.6 | GTGCCGAACCATTCGTCAGCGTCT | 33 16 15 10 31 19 |
| 3661 | 3643 | 30824 | 77.8 | GTGCCGAAAGTGAATCGCAACACG | 33 16 22 4 21 30 |
| 3662 | 3644 | 10926 | 79.7 | GTGCCGAACACGCGTTGAGTACGG | 33 16 30 12 20 35 |
| 3663 | 3645 | 22050 | 76.3 | GTGCCGAAGGACCTGTAAAGCACG | 33 16 34 14 6 30 |
| 3664 | 3646 | 16401 | 80.6 | GTGCCGAAACGGCCATCGAACTTG | 33 16 35 15 16 11 |
| 3665 | 3647 | 30825 | 77.3 | GTGCCGCTTTTAGTCGTGTGCCAGC | 33 17 3 10 33 31 |
| 3666 | 3648 | 10932 | 75.1 | GTGCCGCTTAAAGAGTGCACGTCGT | 33 17 6 22 30 10 |
| 3667 | 3649 | 40971 | 77.2 | GTGCCGCTTTACAAAAGCACGACGG | 33 17 7 6 30 35 |
| 3668 | 3650 | 10936 | 77.3 | GTGCCGCTTCTCACTCAGGACCACG | 33 17 13 13 34 30 |
| 3669 | 3651 | 22053 | 75.5 | GTGCCGCTTGGTAGTCTACGGTCCC | 33 17 18 19 35 28 |
| 3670 | 3652 | 30826 | 75.6 | GTGCCGCTTAGGACCATCGTTAGCC | 33 17 25 15 12 36 |
| 3671 | 3654 | 10943 | 77.5 | GTGCCGCTTGATGCTTGGGTACGAA | 33 17 27 11 18 16 |
| 3672 | 3655 | 10944 | 79.1 | GTGCCGCTTTCCCCGAATTGAGACC | 33 17 28 16 1 32 |

FIG. 25UUU

| SEQ ID NO: | 4,633 ID# | HEX ID# | Tm | ZIPCODE (5'-3') | T3TRAMER NUMBERS | | | | |
|---|---|---|---|---|---|---|---|---|---|
| 3673 | 3656 | 10946 | 75.1 | GTGCGCTTGACCTCTGGGTAACCT | 33 | 17 | 32 | 8 | 18 23 |
| 3674 | 3657 | 10948 | 78.5 | GTGCGCTTGGACTGTCGATGCTCA | 33 | 17 | 34 | 9 | 27 13 |
| 3675 | 3658 | 30828 | 77.5 | GTGCGGTAAAAGGACCGGACGGTA | 33 | 18 | 6 | 32 | 34 18 |
| 3676 | 3659 | 30829 | 77.7 | GTGCGGTACGTTTCTGGACCGCTT | 33 | 18 | 12 | 8 | 32 17 |
| 3677 | 3660 | 22057 | 80 | GTGCGGTACGAATGCGAGGAAGCC | 33 | 18 | 16 | 29 | 25 36 |
| 3678 | 3661 | 30830 | 77.7 | GTGCGGTAGCAAAGGACAGCCCAT | 33 | 18 | 21 | 25 | 31 15 |
| 3679 | 3662 | 16408 | 79.8 | GTGCGGTACCTAACGGGTGCCAGC | 33 | 18 | 26 | 35 | 33 31 |
| 3680 | 3663 | 16409 | 80.1 | GTGCGGTAAGCCGGACTCTGGTGC | 33 | 18 | 36 | 34 | 8 33 |
| 3681 | 3664 | 10961 | 76.2 | GTGCGTCTTTGACCTATGCGTCCC | 33 | 19 | 1 | 26 | 29 28 |
| 3682 | 3665 | 10963 | 79.8 | GTGCGTCTTGTCGCAACGAAACGG | 33 | 19 | 9 | 21 | 16 35 |
| 3683 | 3666 | 10966 | 78.2 | GTGCGTCTGGTAATCGGTGCCCAT | 33 | 19 | 18 | 24 | 33 15 |
| 3684 | 3667 | 10967 | 77.3 | GTGCGTCTATCGGCTTACGGTCCC | 33 | 19 | 24 | 17 | 35 28 |
| 3685 | 3668 | 10969 | 80.7 | GTGCGTCTGATGCTTGGTGCCACG | 33 | 19 | 27 | 11 | 33 30 |
| 3686 | 3669 | 10970 | 78.3 | GTGCGTCTTCCCGTCTGCTTACGG | 33 | 19 | 28 | 19 | 17 35 |
| 3687 | 3670 | 10983 | 76.8 | GTGCGAGTAGGAGCAATGCGGGTA | 33 | 20 | 25 | 21 | 29 18 |
| 3688 | 3671 | 10984 | 82.7 | GTGCGAGTGATGCAGCCAGCACGG | 33 | 20 | 27 | 31 | 31 35 |
| 3689 | 3672 | 10985 | 80.2 | GTGCGAGTTCCCGTCTCAGCGACC | 33 | 20 | 28 | 19 | 31 32 |
| 3690 | 3673 | 16417 | 77.1 | GTGCGAGTTGCGAATCCGTTATCG | 33 | 20 | 29 | 4 | 12 24 |
| 3691 | 3674 | 40979 | 76.4 | GTGCGCAATTGATTAGAGCCAGCC | 33 | 21 | 1 | 3 | 36 36 |
| 3692 | 3675 | 30831 | 78 | GTGCGCAAATACCAGCAAAGTGCG | 33 | 21 | 5 | 31 | 6 29 |
| 3693 | 3676 | 40981 | 79.7 | GTGCGCAATACAAGCCCTGTTGCG | 33 | 21 | 7 | 36 | 14 29 |
| 3694 | 3677 | 40982 | 79.7 | GTGCGCAATGTCTCTGGGACCACG | 33 | 21 | 9 | 8 | 34 30 |
| 3695 | 3679 | 10993 | 77.6 | GTGCGCAACTCAGGACATCGCTGT | 33 | 21 | 13 | 34 | 24 14 |
| 3696 | 3680 | 40983 | 80 | GTGCGCAACTGTGATGGACCCGAA | 33 | 21 | 14 | 27 | 32 16 |
| 3697 | 3681 | 16419 | 75.2 | GTGCGCAAGGTATACAGCAAACGG | 33 | 21 | 18 | 7 | 21 35 |
| 3698 | 3682 | 10998 | 76 | GTGCGCAAAGTGATACAGGATGCG | 33 | 21 | 22 | 5 | 25 29 |
| 3699 | 3683 | 30833 | 78.6 | GTGCGCAAACCTTCGTGACCGAGT | 33 | 21 | 23 | 10 | 32 20 |
| 3700 | 3684 | 10999 | 77.6 | GTGCGCAAATCGTACACACGGACC | 33 | 21 | 24 | 7 | 30 32 |
| 3701 | 3685 | 16421 | 78.9 | GTGCGCAAGATGAGTGACGGTCCC | 33 | 21 | 27 | 22 | 35 28 |
| 3702 | 3686 | 11003 | 82.5 | GTGCGCAATGCGGCTTGGACAGTG | 33 | 21 | 29 | 17 | 34 22 |
| 3703 | 3687 | 11006 | 78.4 | GTGCGCAAGTGCAGGACGTTTTGA | 33 | 21 | 33 | 25 | 12 1 |
| 3704 | 3688 | 40985 | 76 | GTGCAGTGGCTTACGGCCTAAGGA | 33 | 22 | 17 | 35 | 26 25 |
| 3705 | 3689 | 11016 | 81.8 | GTGCAGTGGATGGCAATGCGCCAT | 33 | 22 | 27 | 21 | 29 15 |
| 3706 | 3690 | 16425 | 80.9 | GTGCAGTGTGCGGCTTTGTCTGCG | 33 | 22 | 29 | 17 | 9 29 |
| 3707 | 3691 | 22072 | 78.6 | GTGCAGTGGGACATCGGATGTCCC | 33 | 22 | 34 | 24 | 27 28 |
| 3708 | 3692 | 11020 | 81 | GTGCAGTGACGGCAGCGTCTCACG | 33 | 22 | 35 | 31 | 19 30 |
| 3709 | 3693 | 30834 | 78.9 | GTGCAGTGAGCCAATCGACCGACC | 33 | 22 | 36 | 4 | 32 32 |
| 3710 | 3694 | 11029 | 82.5 | GTGCACCTGATGACGGGTGCGTGC | 33 | 23 | 27 | 35 | 33 33 |
| 3711 | 3695 | 11031 | 80.1 | GTGCACCTCACGCACGAATCCGAA | 33 | 23 | 30 | 30 | 4 16 |
| 3712 | 3696 | 11034 | 77.8 | GTGCACCTACGGCCATTTGATCCC | 33 | 23 | 35 | 15 | 1 28 |
| 3713 | 3697 | 11037 | 81 | GTGCATCGTGATCAGCACGGGCAA | 33 | 24 | 2 | 31 | 35 21 |
| 3714 | 3698 | 30835 | 80.8 | GTGCATCGCTTGCTCAACGGGGAC | 33 | 24 | 11 | 13 | 35 34 |
| 3715 | 3699 | 30836 | 77.4 | GTGCATCGCTGTTTAGAGCCTGCG | 33 | 24 | 14 | 3 | 36 29 |
| 3716 | 3700 | 40991 | 80.5 | GTGCATCGGTCTGTGCGACCGATG | 33 | 24 | 19 | 33 | 32 27 |
| 3717 | 3701 | 40992 | 81.3 | GTGCATCGACCTTGCGCACGGAGT | 33 | 24 | 23 | 29 | 30 20 |
| 3718 | 3702 | 40993 | 76.9 | GTGCATCGATCGTGATAGCCGACC | 33 | 24 | 24 | 2 | 36 32 |
| 3719 | 3703 | 30837 | 80.7 | GTGCATCGTCCCCTTGTCCCTCCC | 33 | 24 | 28 | 11 | 28 28 |
| 3720 | 3704 | 16431 | 79.7 | GTGCATCGCACGCACGGCTTAATC | 33 | 24 | 30 | 30 | 17 4 |
| 3721 | 3705 | 11050 | 79.4 | GTGCATCGCAGCCGTTTCGTAGGA | 33 | 24 | 31 | 12 | 10 25 |
| 3722 | 3706 | 11051 | 79.4 | GTGCATCGACGGGCAATGATGACC | 33 | 24 | 35 | 21 | 2 32 |
| 3723 | 3707 | 30838 | 79.3 | GTGCAGGATCGTTGTCTCCCGCAA | 33 | 25 | 10 | 9 | 28 21 |

FIG. 25VVV

| SEQ ID NO: | 4,633 ID# | HEX ID# | Tm | ZIPCODE (5'-3') | TETRAMER NUMBERS | | | | |
|---|---|---|---|---|---|---|---|---|---|
| 3724 | 3708 | 11052 | 78.3 | GTGCAGGACTTGCGAAATCGAGCC | 33 25 | 11 | 16 | 24 | 36 |
| 3725 | 3709 | 22086 | 76.6 | GTGCAGGAGCTTGCTTCGTTACGG | 33 25 | 17 | 17 | 12 | 35 |
| 3726 | 3710 | 30839 | 77.6 | GTGCAGGAAGGAAATCGACCCGAA | 33 25 | 25 | 4 | 32 | 16 |
| 3727 | 3712 | 16435 | 78.3 | GTGCAGGACACGTGTCGCAACGTT | 33 25 | 30 | 9 | 21 | 12 |
| 3728 | 3713 | 11063 | 78.1 | GTGCAGGACAGCCGAACGAAGCTT | 33 25 | 31 | 16 | 16 | 17 |
| 3729 | 3714 | 11064 | 80 | GTGCAGGAGACCCGAAGACCACGG | 33 25 | 32 | 16 | 32 | 35 |
| 3730 | 3715 | 11065 | 77.9 | GTGCAGGAGTGCCGTTAGCCACCT | 33 25 | 33 | 12 | 36 | 23 |
| 3731 | 3716 | 11067 | 78.3 | GTGCAGGAACGGCTGTCGTTAGCC | 33 25 | 35 | 14 | 12 | 36 |
| 3732 | 3717 | 11071 | 76.4 | GTGCCCTAAAAGGACCTCCCGATG | 33 26 | 6 | 32 | 28 | 27 |
| 3733 | 3718 | 11072 | 78.7 | GTGCCCTATGTCCGAAATCGCACG | 33 26 | 9 | 16 | 24 | 30 |
| 3734 | 3719 | 40995 | 76.4 | GTGCCCTACGTTGGTAGCTTTGCG | 33 26 | 12 | 18 | 17 | 29 |
| 3735 | 3720 | 40996 | 79.3 | GTGCCCTACCATTCTGCACGCGAA | 33 26 | 15 | 8 | 30 | 16 |
| 3736 | 3721 | 41000 | 78.2 | GTGCCCTAGACCTGTCGCAAACGG | 33 26 | 32 | 9 | 21 | 35 |
| 3737 | 3722 | 30840 | 76.6 | GTGCCCTAAGCCTCGTCTGTTCCC | 33 26 | 36 | 10 | 14 | 28 |
| 3738 | 3723 | 11084 | 75.8 | GTGCGATGTGATATCGCGAAATCG | 33 27 | 2 | 24 | 16 | 24 |
| 3739 | 3724 | 11086 | 81.8 | GTGCGATGTCTGTGCGAGCCGACC | 33 27 | 8 | 29 | 36 | 32 |
| 3740 | 3725 | 16441 | 77.5 | GTGCGATGCTTGGCAATTAGGCAA | 33 27 | 11 | 21 | 3 | 21 |
| 3741 | 3726 | 11092 | 80.7 | GTGCGATGATCGCTGTGTGCGACC | 33 27 | 24 | 14 | 33 | 32 |
| 3742 | 3727 | 30841 | 80.5 | GTGCGATGTCCCGGACGCAAAATC | 33 27 | 28 | 34 | 21 | 4 |
| 3743 | 3728 | 11099 | 78.5 | GTGCTCCCTTAGCTTGGTGCTGCG | 33 28 | 3 | 11 | 33 | 29 |
| 3744 | 3729 | 11104 | 78.1 | GTGCTCCCCTTGGAGTTGATTGCG | 33 28 | 11 | 20 | 2 | 29 |
| 3745 | 3730 | 16449 | 79.1 | GTGCTCCCCGTTCTGTCTGTTGCG | 33 28 | 12 | 14 | 14 | 29 |
| 3746 | 3731 | 11111 | 77.1 | GTGCTCCCGAGTTACAGTGCCACG | 33 28 | 20 | 7 | 33 | 30 |
| 3747 | 3732 | 16451 | 78.1 | GTGCTCCCACCTGACCCCTATCCC | 33 28 | 23 | 32 | 26 | 28 |
| 3748 | 3733 | 22097 | 78.5 | GTGCTCCCATCGATCGCGTTAGGA | 33 28 | 24 | 24 | 12 | 25 |
| 3749 | 3734 | 41006 | 81.1 | GTGCTCCCGTGCAGTGTCCCGGTA | 33 28 | 33 | 22 | 28 | 18 |
| 3750 | 3735 | 11116 | 78 | GTGCTCCCGGACTTGAGTGCGAGT | 33 28 | 34 | 1 | 33 | 20 |
| 3751 | 3736 | 11118 | 81.1 | GTGCTCCCAGCCGTCTTCTGCACG | 33 28 | 36 | 19 | 8 | 30 |
| 3752 | 3737 | 41007 | 78.7 | GTGCTGCGTCTGTCTGCACGAGGA | 33 29 | 8 | 8 | 30 | 25 |
| 3753 | 3738 | 11125 | 77.6 | GTGCTGCGCTGTGCAAAATCCCTA | 33 29 | 14 | 21 | 4 | 26 |
| 3754 | 3739 | 41008 | 75.4 | GTGCTGCGGAGTAAAGAGCCCTA | 33 29 | 20 | 6 | 36 | 26 |
| 3755 | 3740 | 11132 | 78.3 | GTGCTGCGTCCCTACACAGCTCCC | 33 29 | 28 | 7 | 31 | 28 |
| 3756 | 3741 | 11133 | 82.9 | GTGCTGCGCACGGCTTGTCTGTGC | 33 29 | 30 | 17 | 19 | 33 |
| 3757 | 3742 | 11134 | 81 | GTGCTGCGCAGCAAAGCACGTGTC | 33 29 | 31 | 6 | 30 | 9 |
| 3758 | 3743 | 11135 | 80.1 | GTGCTGCGGACCTCTGAGTGTGCG | 33 29 | 32 | 8 | 22 | 29 |
| 3759 | 3744 | 16457 | 82 | GTGCTGCGAGCCGCAAGATGCTTG | 33 29 | 36 | 21 | 27 | 11 |
| 3760 | 3745 | 16458 | 80.9 | GTGCCACGTTAGGTGCGTGCCCAT | 33 30 | 3 | 33 | 33 | 15 |
| 3761 | 3746 | 11144 | 78.3 | GTGCCACGTCTGAGTGGACCCCAT | 33 30 | 8 | 22 | 32 | 15 |
| 3762 | 3747 | 16460 | 76.2 | GTGCCACGGGTAACCTAGGATCCC | 33 30 | 18 | 23 | 25 | 28 |
| 3763 | 3748 | 30842 | 77.9 | GTGCCACGGAGTACGGGAGTGACC | 33 30 | 20 | 35 | 20 | 32 |
| 3764 | 3749 | 11152 | 77.6 | GTGCCACGAGTGTGTCATCGGGAC | 33 30 | 22 | 9 | 24 | 34 |
| 3765 | 3750 | 11158 | 79.7 | GTGCCACGAGCCAATCCTCACACG | 33 30 | 36 | 4 | 13 | 30 |
| 3766 | 3751 | 30843 | 75.4 | GTGCCAGCTGATAGCCAAAGGCT | 33 31 | 2 | 36 | 6 | 17 |
| 3767 | 3752 | 41012 | 76.1 | GTGCCAGCAATCAAAGGGTAACGG | 33 31 | 4 | 6 | 18 | 35 |
| 3768 | 3753 | 11162 | 79.3 | GTGCCAGCATACCAGCGATGCGTT | 33 31 | 5 | 31 | 27 | 12 |
| 3769 | 3754 | 22115 | 77.6 | GTGCCAGCAAAGGTCTGTGCAGGA | 33 31 | 6 | 19 | 33 | 25 |
| 3770 | 3755 | 30844 | 79 | GTGCCAGCCGAATTAGTGCGATCG | 33 31 | 16 | 3 | 29 | 24 |
| 3771 | 3756 | 11171 | 78.6 | GTGCCAGCGTCTTGTCGTGCTTGA | 33 31 | 19 | 9 | 33 | 1 |
| 3772 | 3757 | 41014 | 78.4 | GTGCCAGCGAGTTTAGGTGCAGCC | 33 31 | 20 | 3 | 33 | 36 |
| 3773 | 3758 | 30845 | 76.8 | GTGCCAGCCCTAAATCGGACCCTA | 33 31 | 26 | 4 | 34 | 26 |
| 3774 | 3759 | 11176 | 79.6 | GTGCCAGCTCCCCTCACTTGCCAT | 33 31 | 28 | 13 | 11 | 15 |

FIG. 25WWW

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 3775 | 3760 | 11178 | 80.8 | GTGCCAGCGTGCAGTGGCAACTTG | 33 | 31 | 33 | 22 | 21 | 11 |
| 3776 | 3761 | 11179 | 78.9 | GTGCCAGCACGGAAAGATCGGATG | 33 | 31 | 35 | 6 | 24 | 27 |
| 3777 | 3762 | 16466 | 78.9 | GTGCGACCTTAGGTGCGGTATGCG | 33 | 32 | 3 | 33 | 18 | 29 |
| 3778 | 3763 | 11183 | 81 | GTGCGACCATACAGCCGGACCGAA | 33 | 32 | 5 | 36 | 34 | 16 |
| 3779 | 3764 | 11186 | 76.1 | GTGCGACCCTGTTTAGCAGCGAGT | 33 | 32 | 14 | 3 | 31 | 20 |
| 3780 | 3765 | 16468 | 79.7 | GTGCGACCCGAAAGCCTGTCACCT | 33 | 32 | 16 | 36 | 9 | 23 |
| 3781 | 3766 | 41018 | 78.3 | GTGCGACCGCTTATACCAGCAGCC | 33 | 32 | 17 | 5 | 31 | 36 |
| 3782 | 3767 | 30847 | 77 | GTGCGACCGGTAGGACGGTAGCTT | 33 | 32 | 18 | 34 | 18 | 17 |
| 3783 | 3768 | 11191 | 81.2 | GTGCGACCAGTGGATGCACGCTCA | 33 | 32 | 22 | 27 | 30 | 13 |
| 3784 | 3769 | 16469 | 77.8 | GTGCGACCAGGAAGCCACCTGAGT | 33 | 32 | 25 | 36 | 23 | 20 |
| 3785 | 3770 | 11196 | 80.2 | GTGCGACCCAGCGAGTAGCCCTTG | 33 | 32 | 31 | 20 | 36 | 11 |
| 3786 | 3771 | 11197 | 81.2 | GTGCGACCACGGCTCAATCGTCGT | 33 | 32 | 35 | 13 | 24 | 10 |
| 3787 | 3772 | 41020 | 79.2 | GTGCGTGCTTGACGAAGGACAGCC | 33 | 33 | 1 | 16 | 34 | 36 |
| 3788 | 3773 | 11198 | 76.7 | GTGCGTGCTGATTCCCAAAGAGGA | 33 | 33 | 2 | 28 | 6 | 25 |
| 3789 | 3774 | 22127 | 77.6 | GTGCGTGCTACATGCGAGGACGTT | 33 | 33 | 7 | 29 | 25 | 12 |
| 3790 | 3775 | 11205 | 76.5 | GTGCGTGCCTGTACCTGACCACCT | 33 | 33 | 14 | 23 | 32 | 23 |
| 3791 | 3776 | 11208 | 79.2 | GTGCGTGCGTCTCCATGCAACTCA | 33 | 33 | 19 | 15 | 21 | 13 |
| 3792 | 3777 | 11209 | 79.4 | GTGCGTGCGAGTCTGTGTGCCTCA | 33 | 33 | 20 | 14 | 33 | 13 |
| 3793 | 3778 | 11210 | 79.8 | GTGCGTGCATCGCCATAGCCTGTC | 33 | 33 | 24 | 15 | 36 | 9 |
| 3794 | 3779 | 11212 | 82.6 | GTGCGTGCCACGGCTTCACGTCTG | 33 | 33 | 30 | 17 | 30 | 8 |
| 3795 | 3780 | 11216 | 80.7 | GTGCGGACATACGCAAAGCCGACC | 33 | 34 | 5 | 21 | 36 | 32 |
| 3796 | 3781 | 30848 | 78.2 | GTGCGGACGTCTCGTTGGTAAGCC | 33 | 34 | 19 | 12 | 18 | 36 |
| 3797 | 3782 | 11226 | 78.9 | GTGCGGACTCCCCAGCGTCTACCT | 33 | 34 | 28 | 31 | 19 | 23 |
| 3798 | 3783 | 11227 | 81.3 | GTGCGGACTGCGAGTGTGTCGCAA | 33 | 34 | 29 | 22 | 9 | 21 |
| 3799 | 3784 | 11228 | 78.4 | GTGCGGACGACCTCGTTTGACCAT | 33 | 34 | 32 | 10 | 1 | 15 |
| 3800 | 3785 | 41026 | 82.5 | GTGCACGGAATCGCTTTGCGGGAC | 33 | 35 | 4 | 17 | 29 | 34 |
| 3801 | 3786 | 41027 | 82.9 | GTGCACGGTCTGTCCCCACGCCAT | 33 | 35 | 8 | 28 | 30 | 15 |
| 3802 | 3787 | 30849 | 79.3 | GTGCACGGCTCAACCTTCTGCAGC | 33 | 35 | 13 | 23 | 8 | 31 |
| 3803 | 3788 | 11239 | 78.6 | GTGCACGGCCATCTTGACCTGCTT | 33 | 35 | 15 | 11 | 23 | 17 |
| 3804 | 3789 | 22145 | 79.8 | GTGCACGGGTCTTGCGATCGTCTG | 33 | 35 | 19 | 29 | 24 | 8 |
| 3805 | 3790 | 41028 | 78.8 | GTGCACGGGAGTCCATCGAAATCG | 33 | 35 | 20 | 15 | 16 | 24 |
| 3806 | 3791 | 41029 | 82.7 | GTGCACGGAGTGGACCAGCCGGAC | 33 | 35 | 22 | 32 | 36 | 34 |
| 3807 | 3792 | 41030 | 80.2 | GTGCACGGATCGGATGAGCCCCTA | 33 | 35 | 24 | 27 | 36 | 26 |
| 3808 | 3793 | 11243 | 77.7 | GTGCACGGAGGATCCCTGTCTCGT | 33 | 35 | 25 | 28 | 9 | 10 |
| 3809 | 3794 | 11246 | 83.4 | GTGCACGGGTGCGAGTGTGCGATG | 33 | 35 | 33 | 20 | 33 | 27 |
| 3810 | 3795 | 22147 | 78.1 | GTGCACGGGACCCATTCTGTGAT | 33 | 35 | 34 | 15 | 8 | 2 |
| 3811 | 3796 | 11248 | 79.8 | GTGCACGGACGGAGTGGTGCAAAG | 33 | 35 | 35 | 22 | 33 | 6 |
| 3812 | 3797 | 16475 | 79.1 | GTGCAGCCAAAGCAGCCGTTTGTC | 33 | 36 | 6 | 31 | 12 | 9 |
| 3813 | 3798 | 11250 | 77 | GTGCAGCCTCGTTACAACGGGATG | 33 | 36 | 10 | 7 | 35 | 27 |
| 3814 | 3799 | 16478 | 77.3 | GTGCAGCCATCGAATCGCAATGAT | 33 | 36 | 24 | 4 | 21 | 2 |
| 3815 | 3800 | 16479 | 81.5 | GTGCAGCCTCCCGACCACCTCGTT | 33 | 36 | 28 | 32 | 23 | 12 |
| 3816 | 3801 | 11261 | 81.5 | GTGCAGCCTGCGCCATCTTGAGGA | 33 | 36 | 29 | 15 | 11 | 25 |
| 3817 | 3802 | 11264 | 82.4 | GTGCAGCCGACCCCATGTGCAGTG | 33 | 36 | 32 | 15 | 33 | 22 |
| 3818 | 3803 | 11265 | 80.9 | GTGCAGCCGTGCAGTGCGAATCTG | 33 | 36 | 33 | 22 | 16 | 8 |
| 3819 | 3804 | 11266 | 82.6 | GTGCAGCCACGGGATGCTGTGTGC | 33 | 36 | 35 | 27 | 14 | 33 |
| 3820 | 3805 | 41034 | 78 | GGACTTGAAGCCAATCCCATTGCG | 34 | 1 | 36 | 4 | 15 | 29 |
| 3821 | 3806 | 11275 | 81.8 | GGACTTAGCAGCCACGCACGTGCG | 34 | 3 | 31 | 30 | 30 | 29 |
| 3822 | 3807 | 11276 | 78 | GGACAATCCTTGACGGCCATCAGC | 34 | 4 | 11 | 35 | 15 | 31 |
| 3823 | 3808 | 30850 | 75.8 | GGACAATCTGCGTACAAGCCCGTT | 34 | 4 | 29 | 7 | 36 | 12 |
| 3824 | 3809 | 11295 | 80.5 | GGACAAAGGATGACGGGCAATGCG | 34 | 6 | 27 | 35 | 21 | 29 |
| 3825 | 3810 | 30851 | 76.8 | GGACAAAGCACGAGCCTTGACGAA | 34 | 6 | 30 | 36 | 1 | 16 |

FIG. 25XXX

| SEQ ID NO: | 4,633 ID# | HEX ID# | Tm | ZIPCODE (5'-3') | TETRAMER NUMBERS | | | | |
|---|---|---|---|---|---|---|---|---|---|
| 3826 | 3811 | 11300 | 77.2 | GGACTCTGCGTTTCGTTCGTGTGC | 34 | 8 | 12 | 10 | 10 33 |
| 3827 | 3812 | 11303 | 79.4 | GGACTCTGCCTAACGGGCTTTGCG | 34 | 8 | 26 | 35 | 17 29 |
| 3828 | 3813 | 11305 | 78 | GGACTCTGCACGGCAAACCTGCTT | 34 | 8 | 30 | 21 | 23 17 |
| 3829 | 3814 | 30852 | 76.8 | GGACTCGTCGTTATCGCAGCAGGA | 34 | 10 | 12 | 24 | 31 25 |
| 3830 | 3815 | 16494 | 78.8 | GGACTCGTCCATGATGGGACTGCG | 34 | 10 | 15 | 27 | 34 29 |
| 3831 | 3816 | 11321 | 78.3 | GGACTCGTACGGCTTGGTCTTGCG | 34 | 10 | 35 | 11 | 19 29 |
| 3832 | 3817 | 30853 | 77.2 | GGACCTTGCTTGTGCGTTAGCACG | 34 | 11 | 11 | 29 | 3 30 |
| 3833 | 3818 | 30854 | 75.8 | GGACCTTGCGTTACGGCCTATTGA | 34 | 11 | 12 | 35 | 26 1 |
| 3834 | 3819 | 41042 | 77.7 | GGACCTTGCTCAAAAGCAGCAGCC | 34 | 11 | 13 | 6 | 31 36 |
| 3835 | 3820 | 11328 | 78.1 | GGACCTTGGAGTCACGAGCCATCG | 34 | 11 | 20 | 30 | 36 24 |
| 3836 | 3821 | 30855 | 77.1 | GGACCTTGGCAAGGACGCAAGAGT | 34 | 11 | 21 | 34 | 21 20 |
| 3837 | 3823 | 11332 | 79.2 | GGACCTTGCAGCGCTTGCAAAGTG | 34 | 11 | 31 | 17 | 21 22 |
| 3838 | 3824 | 16502 | 79.7 | GGACCTTGGTGCCGAATCGTGGAC | 34 | 11 | 33 | 16 | 10 34 |
| 3839 | 3825 | 11335 | 79.1 | GGACCTTGGGACGCAACGAAGACC | 34 | 11 | 34 | 21 | 16 32 |
| 3840 | 3826 | 30856 | 76.3 | GGACCGTTCGTTATACACGGGCAA | 34 | 12 | 12 | 5 | 35 21 |
| 3841 | 3827 | 16508 | 77.2 | GGACCGTTACCTGAGTTGCGGGAC | 34 | 12 | 23 | 20 | 29 34 |
| 3842 | 3828 | 22167 | 76.5 | GGACCGTTTGCGGAGTATCGTTGA | 34 | 12 | 29 | 20 | 24 1 |
| 3843 | 3829 | 11361 | 75.4 | GGACCTGTTTGATGCGGAGTAGCC | 34 | 14 | 1 | 29 | 20 36 |
| 3844 | 3830 | 11363 | 77.2 | GGACCTGTCCATCCATTCCCAGGA | 34 | 14 | 15 | 15 | 28 25 |
| 3845 | 3831 | 16519 | 79.1 | GGACCCATTGATCAGCGACCCAT | 34 | 15 | 2 | 31 | 32 15 |
| 3846 | 3832 | 11374 | 77.1 | GGACCCATAAAGCTGTTCCCGTGC | 34 | 15 | 6 | 14 | 28 33 |
| 3847 | 3833 | 11378 | 77.9 | GGACCCATCTTGCTTGTCCCATCG | 34 | 15 | 11 | 11 | 28 24 |
| 3848 | 3834 | 16522 | 76.5 | GGACCCATGGTATGCGGTGCATAC | 34 | 15 | 18 | 29 | 33 5 |
| 3849 | 3835 | 11385 | 78.9 | GGACCCATCACGCTTGCGAACTTG | 34 | 15 | 30 | 11 | 16 11 |
| 3850 | 3836 | 22172 | 76.7 | GGACCCATGTGCATACGCAAGGAC | 34 | 15 | 33 | 5 | 21 34 |
| 3851 | 3837 | 30859 | 79.7 | GGACCGAATTGACTTGCACGCACG | 34 | 16 | 1 | 11 | 30 30 |
| 3852 | 3838 | 11392 | 77.4 | GGACCGAAATACACGGGTGCCCTA | 34 | 16 | 5 | 35 | 33 26 |
| 3853 | 3839 | 41053 | 76 | GGACCGAAAAGTCTGCTTGGCAA | 34 | 16 | 6 | 8 | 11 21 |
| 3854 | 3840 | 30860 | 78.7 | GGACCGAACTTGACGGTCCCTCGT | 34 | 16 | 11 | 35 | 28 10 |
| 3855 | 3841 | 11397 | 75.6 | GGACCGAAGCTTTCGTAGGACACG | 34 | 16 | 17 | 10 | 25 30 |
| 3856 | 3842 | 41055 | 77.4 | GGACCGAAACCTGCTTGCTTGACC | 34 | 16 | 23 | 17 | 17 32 |
| 3857 | 3843 | 41056 | 77.1 | GGACCGAAAGGAATACCAGCCACG | 34 | 16 | 25 | 5 | 31 30 |
| 3858 | 3844 | 11402 | 77.4 | GGACCGAAGACCCAGCGCAATTAG | 34 | 16 | 32 | 31 | 21 3 |
| 3859 | 3845 | 16533 | 77 | GGACGCTTTTAGGGACCGAACGAA | 34 | 17 | 3 | 34 | 16 16 |
| 3860 | 3846 | 16534 | 79.3 | GGACGCTTAAAGGTGCGTGCTCCC | 34 | 17 | 6 | 33 | 33 28 |
| 3861 | 3847 | 41058 | 80 | GGACGCTTTGTCACCTTCCCTGCG | 34 | 17 | 9 | 23 | 28 29 |
| 3862 | 3848 | 41059 | 75.2 | GGACGCTTGGTAAATCGCTTTCGT | 34 | 17 | 18 | 4 | 17 10 |
| 3863 | 3849 | 11413 | 75.8 | GGACGCTTACCTGCAACGAACCAT | 34 | 17 | 23 | 21 | 16 15 |
| 3864 | 3850 | 30862 | 76.6 | GGACGCTTCCTATGTCATCGGCAA | 34 | 17 | 26 | 9 | 24 21 |
| 3865 | 3851 | 30863 | 79.9 | GGACGCTTTGCGTTGAATCGGACC | 34 | 17 | 29 | 1 | 24 32 |
| 3866 | 3852 | 41061 | 79.5 | GGACGGTACGTTTCGTTGCGGCTT | 34 | 18 | 12 | 10 | 29 17 |
| 3867 | 3853 | 16537 | 75.9 | GGACGGTACCATTGTCGCAAGGAC | 34 | 18 | 15 | 9 | 21 34 |
| 3868 | 3854 | 16539 | 79.1 | GGACGGTAGTGCAGTGCAGCGACC | 34 | 18 | 33 | 22 | 31 32 |
| 3869 | 3855 | 11431 | 78.5 | GGACGGTAGGACGCAATCCCACCT | 34 | 18 | 34 | 21 | 28 23 |
| 3870 | 3856 | 16540 | 80.7 | GGACGGTAAGCCGTGCACCTGTGC | 34 | 18 | 36 | 33 | 23 33 |
| 3871 | 3857 | 11433 | 80.2 | GGACGTCTTTGATCCCCACGCGAA | 34 | 19 | 1 | 28 | 30 16 |
| 3872 | 3858 | 11434 | 76.8 | GGACGTCTTCGTGCAAGCAAAGGA | 34 | 19 | 10 | 21 | 21 25 |
| 3873 | 3859 | 16541 | 79.9 | GGACGTCTCCATGGACCAGCGACC | 34 | 19 | 15 | 34 | 31 32 |
| 3874 | 3860 | 11437 | 77.3 | GGACGTCTGCAAGACCTCTGTGCG | 34 | 19 | 21 | 32 | 8 29 |
| 3875 | 3861 | 16543 | 79.3 | GGACGTCTCACGCACGAAAGCAGC | 34 | 19 | 30 | 30 | 6 31 |
| 3876 | 3862 | 11449 | 77.1 | GGACGAGTATCGGGACCCTATGCG | 34 | 20 | 24 | 34 | 26 29 |

FIG. 25YYY

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 3877 | 3863 | 11452 | 82.4 | GGACGAGTCAGCGTGCGTGCAGGA | 34 | 20 | 31 | 33 | 33 | 25 |
| 3878 | 3864 | 11455 | 75 | GGACGAGTACGGTTGAATCGGCTT | 34 | 20 | 35 | 1 | 24 | 17 |
| 3879 | 3865 | 30864 | 79 | GGACGCAATTGAACGGAGTGCAGC | 34 | 21 | 1 | 35 | 22 | 31 |
| 3880 | 3866 | 11458 | 78.5 | GGACGCAAATACGTGCCCATGGAC | 34 | 21 | 5 | 33 | 15 | 34 |
| 3881 | 3867 | 22187 | 75.8 | GGACGCAATGTCCCATGGTAGGAC | 34 | 21 | 9 | 15 | 18 | 34 |
| 3882 | 3868 | 11460 | 77.1 | GGACGCAATCGTTCTGGTGCAAAG | 34 | 21 | 10 | 8 | 33 | 6 |
| 3883 | 3869 | 30865 | 77.1 | GGACGCAACCTAATACTGCGTGCG | 34 | 21 | 26 | 5 | 29 | 29 |
| 3884 | 3870 | 11468 | 78.4 | GGACGCAATGCGTTGAAGGATCGT | 34 | 21 | 29 | 1 | 25 | 10 |
| 3885 | 3871 | 11469 | 78.2 | GGACGCAAGTGCAGTGGTCTTCCC | 34 | 21 | 33 | 22 | 19 | 28 |
| 3886 | 3872 | 30866 | 76.6 | GGACGCAAGGACTCCCGGTAAAAG | 34 | 21 | 34 | 28 | 18 | 6 |
| 3887 | 3873 | 22189 | 78.9 | GGACGCAAACGGTGATCAGCCTTG | 34 | 21 | 35 | 2 | 31 | 11 |
| 3888 | 3874 | 16552 | 79.8 | GGACAGTGTGCGACGGACCTGTGC | 34 | 22 | 29 | 35 | 23 | 33 |
| 3889 | 3875 | 16556 | 78.8 | GGACACCTCACGGGACTGATTGCG | 34 | 23 | 30 | 34 | 2 | 29 |
| 3890 | 3876 | 16557 | 81.1 | GGACACCTGACCGTGCACGGCCTA | 34 | 23 | 32 | 33 | 35 | 26 |
| 3891 | 3877 | 30867 | 75.8 | GGACACCTAGCCTTAGCGTTTGCG | 34 | 23 | 36 | 3 | 12 | 29 |
| 3892 | 3878 | 11490 | 80.6 | GGACATCGAAAGACGGGTGCCACG | 34 | 24 | 6 | 35 | 33 | 30 |
| 3893 | 3879 | 41069 | 78.2 | GGACATCGGCTTCTTGCTTGACGG | 34 | 24 | 17 | 11 | 11 | 35 |
| 3894 | 3880 | 11496 | 78.9 | GGACATCGCACGGTCTAGCCATCG | 34 | 24 | 30 | 19 | 36 | 24 |
| 3895 | 3881 | 11499 | 79.3 | GGACATCGACGGGGACCTGTCGTT | 34 | 24 | 35 | 34 | 14 | 12 |
| 3896 | 3882 | 22199 | 78.9 | GGACAGGACGAAATCGTCCCGGAC | 34 | 25 | 16 | 24 | 28 | 34 |
| 3897 | 3883 | 16564 | 76.7 | GGACAGGAATCGACGGCCTACCAT | 34 | 25 | 24 | 35 | 26 | 15 |
| 3898 | 3884 | 11505 | 75.3 | GGACAGGAAGGATTGAGGACGTGC | 34 | 25 | 25 | 1 | 34 | 33 |
| 3899 | 3885 | 41072 | 77.3 | GGACCCTACGAAAGGATCGTTGCG | 34 | 26 | 16 | 25 | 10 | 29 |
| 3900 | 3886 | 11511 | 75.4 | GGACCCTAGCTTGCAAGTGCGTCT | 34 | 26 | 17 | 21 | 33 | 19 |
| 3901 | 3887 | 30869 | 78.7 | GGACCCTAGCAACAGCGATGCGAA | 34 | 26 | 21 | 31 | 27 | 16 |
| 3902 | 3888 | 11516 | 76.4 | GGACCCTACCTAGACCAGCCACGG | 34 | 26 | 26 | 32 | 36 | 35 |
| 3903 | 3889 | 41076 | 78.9 | GGACGATGCTCACTGTTGCGGACC | 34 | 27 | 13 | 14 | 29 | 32 |
| 3904 | 3890 | 30870 | 76.3 | GGACGATGGGTAACGGGGTACCAT | 34 | 27 | 18 | 35 | 18 | 15 |
| 3905 | 3891 | 11527 | 75.4 | GGACGATGGTCTAGCCCGAAAGTG | 34 | 27 | 19 | 36 | 16 | 22 |
| 3906 | 3892 | 41077 | 79.7 | GGACGATGATCGCGAAAGCCGTCT | 34 | 27 | 24 | 16 | 36 | 19 |
| 3907 | 3893 | 11535 | 78.6 | GGACTCCCTGTCCGTTGCTTGCAA | 34 | 28 | 9 | 12 | 17 | 21 |
| 3908 | 3894 | 11537 | 75.4 | GGACTCCCCTGTTACAGACCTGCG | 34 | 28 | 14 | 7 | 32 | 29 |
| 3909 | 3895 | 16576 | 77 | GGACTCCCCATTTAGCACGGATG | 34 | 28 | 15 | 3 | 30 | 27 |
| 3910 | 3896 | 30872 | 76.6 | GGACTCCCACCTAGCCCAGCTGTC | 34 | 28 | 23 | 36 | 31 | 9 |
| 3911 | 3897 | 16578 | 78.4 | GGACTCCCATCGCGAAAGGAGGAC | 34 | 28 | 24 | 16 | 25 | 34 |
| 3912 | 3898 | 41080 | 79.6 | GGACTCCCCACGCTTGCGTTAGGA | 34 | 28 | 30 | 11 | 12 | 25 |
| 3913 | 3899 | 11548 | 79.5 | GGACTCCGGACGCTTCACGTGAT | 34 | 28 | 34 | 17 | 30 | 2 |
| 3914 | 3900 | 11551 | 78.9 | GGACTGCGTTAGCCATCACGACGG | 34 | 29 | 3 | 15 | 30 | 35 |
| 3915 | 3901 | 11555 | 78.1 | GGACTGCGTCGTCGTTCAGCAGTG | 34 | 29 | 10 | 12 | 31 | 22 |
| 3916 | 3902 | 16583 | 78 | GGACTGCGCTTGACCTCACGACCT | 34 | 29 | 11 | 23 | 30 | 23 |
| 3917 | 3903 | 11557 | 77.6 | GGACTGCGCTCATCGTCGTTTTGA | 34 | 29 | 13 | 10 | 12 | 1 |
| 3918 | 3904 | 30874 | 77.7 | GGACTGCGGCTTAGGAGCTTCACG | 34 | 29 | 17 | 25 | 17 | 30 |
| 3919 | 3905 | 16587 | 76.8 | GGACTGCGACCTTTGAGCAACGAA | 34 | 29 | 23 | 1 | 21 | 16 |
| 3920 | 3906 | 11563 | 78 | GGACTGCGATCGACCTCCATGGAC | 34 | 29 | 24 | 23 | 15 | 34 |
| 3921 | 3907 | 11565 | 77.5 | GGACTGCGGATGGAGTATCGCCAT | 34 | 29 | 27 | 20 | 24 | 15 |
| 3922 | 3908 | 11567 | 79.5 | GGACTGCGCACGATACCAGCAGGA | 34 | 29 | 30 | 5 | 31 | 25 |
| 3923 | 3909 | 11568 | 79.9 | GGACTGCGGGACCCATCCATGGTA | 34 | 29 | 34 | 15 | 15 | 18 |
| 3924 | 3910 | 16588 | 80.1 | GGACCACGTGATGACCTCCCCGAA | 34 | 30 | 2 | 32 | 28 | 16 |
| 3925 | 3911 | 30875 | 77.4 | GGACCACGCTCATTGATCCCCTGT | 34 | 30 | 13 | 1 | 28 | 14 |
| 3926 | 3912 | 11578 | 79.1 | GGACCACGGCTTTCTGCACGAGTG | 34 | 30 | 17 | 8 | 30 | 22 |
| 3927 | 3913 | 41086 | 76.9 | GGACCACGGAGTATCGCTCACACG | 34 | 30 | 20 | 24 | 13 | 30 |

FIG. 25ZZZ

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 3928 | 3914 | 11584 | 81.3 | GGACCACGCACGCTCAGTGCCCTA | 34 | 30 | 30 | 13 | 33 | 26 |
| 3929 | 3915 | 11589 | 79.7 | GGACCACGACGGTCTGTGCGTGTC | 34 | 30 | 35 | 8 | 29 | 9 |
| 3930 | 3916 | 16594 | 79.8 | GGACCACGAGCCCGAACGTTTGTC | 34 | 30 | 36 | 16 | 12 | 9 |
| 3931 | 3917 | 41088 | 78.1 | GGACCAGCTTGATCGTCGAAACGG | 34 | 31 | 1 | 10 | 16 | 35 |
| 3932 | 3918 | 11595 | 78.7 | GGACCAGCTGTCCAGCAGGACGAA | 34 | 31 | 9 | 31 | 25 | 16 |
| 3933 | 3919 | 30876 | 78 | GGACCAGCCTTGTGCGACGGATAC | 34 | 31 | 11 | 29 | 35 | 5 |
| 3934 | 3921 | 11599 | 78.9 | GGACCAGCCTGTGGACTGTCCACG | 34 | 31 | 14 | 34 | 9 | 30 |
| 3935 | 3922 | 30877 | 77.9 | GGACCAGCGGTATGATGACCAGCC | 34 | 31 | 18 | 2 | 32 | 36 |
| 3936 | 3923 | 41094 | 78.8 | GGACCAGCAGTGACCTGTGCGCTT | 34 | 31 | 22 | 23 | 33 | 17 |
| 3937 | 3924 | 11607 | 81.2 | GGACCAGCTGCGGACCCTCAGGAC | 34 | 31 | 29 | 32 | 13 | 34 |
| 3938 | 3925 | 30879 | 79.6 | GGACGACCTTGAGTGCGCAAGCAA | 34 | 32 | 1 | 33 | 21 | 21 |
| 3939 | 3926 | 30880 | 76.6 | GGACGACCCTGTAGTGCGTTCGAA | 34 | 32 | 14 | 22 | 12 | 16 |
| 3940 | 3927 | 22225 | 78 | GGACGACCGGTAGTGCAGCCAATC | 34 | 32 | 18 | 33 | 36 | 4 |
| 3941 | 3928 | 22226 | 79.4 | GGACGACCGTCTGTGCACCTCGAA | 34 | 32 | 19 | 33 | 23 | 16 |
| 3942 | 3929 | 11615 | 76.9 | GGACGACCGAGTCTTGGGACGAGT | 34 | 32 | 20 | 11 | 34 | 20 |
| 3943 | 3930 | 41097 | 78.2 | GGACGACCAGTGAAAGGTGCAGCC | 34 | 32 | 22 | 6 | 33 | 36 |
| 3944 | 3931 | 16601 | 80.6 | GGACGACCGACCCCATCTCATCCC | 34 | 32 | 32 | 15 | 13 | 28 |
| 3945 | 3932 | 11626 | 76.4 | GGACGTGCTGATTGATTCCCAGGA | 34 | 33 | 2 | 2 | 28 | 25 |
| 3946 | 3933 | 16603 | 80.1 | GGACGTGCAATCGGACCGTTTCGT | 34 | 33 | 4 | 34 | 12 | 10 |
| 3947 | 3934 | 11629 | 76.9 | GGACGTGCTCTGTCGTCCATACGG | 34 | 33 | 8 | 10 | 15 | 35 |
| 3948 | 3935 | 11630 | 79.9 | GGACGTGCTGTCCAGCACGGAGTG | 34 | 33 | 9 | 31 | 35 | 22 |
| 3949 | 3936 | 30881 | 78 | GGACGTGCTCGTCGAAGCAAACCT | 34 | 33 | 10 | 16 | 21 | 23 |
| 3950 | 3937 | 11632 | 78.9 | GGACGTGCCGTTGCTTCGAATGTC | 34 | 33 | 12 | 17 | 16 | 9 |
| 3951 | 3938 | 30882 | 79.8 | GGACGTGCCGAAATACTCCCGTGC | 34 | 33 | 16 | 5 | 28 | 33 |
| 3952 | 3939 | 30883 | 79.1 | GGACGTGCGGTATGTCGGACAGGA | 34 | 33 | 18 | 9 | 34 | 25 |
| 3953 | 3940 | 16606 | 81.4 | GGACGTGCAGTGGTGCTGCGACCT | 34 | 33 | 22 | 33 | 29 | 23 |
| 3954 | 3941 | 30884 | 76.3 | GGACGTGCCCTACCTATCGTTCCC | 34 | 33 | 26 | 26 | 10 | 28 |
| 3955 | 3942 | 16609 | 80 | GGACGTGCTGCGTGTCCTTGCTTG | 34 | 33 | 29 | 9 | 11 | 11 |
| 3956 | 3943 | 11644 | 81.6 | GGACGTGCCACGGGACAGTGCTTG | 34 | 33 | 30 | 34 | 22 | 11 |
| 3957 | 3944 | 11646 | 79.5 | GGACGTGCACGGTGATTGTCGACC | 34 | 33 | 35 | 2 | 9 | 32 |
| 3958 | 3945 | 16610 | 78 | GGACGGACTCGTCTGTCACGGGAC | 34 | 34 | 10 | 14 | 30 | 34 |
| 3959 | 3946 | 30885 | 78.1 | GGACGGACCGTTTTAGGACCGACC | 34 | 34 | 12 | 3 | 32 | 32 |
| 3960 | 3947 | 16612 | 77.7 | GGACGGACCTGTTACATCCCCACG | 34 | 34 | 14 | 7 | 28 | 30 |
| 3961 | 3948 | 30886 | 79.6 | GGACGGACCGAAGATGCAGCCTGT | 34 | 34 | 16 | 27 | 31 | 14 |
| 3962 | 3949 | 41101 | 78.8 | GGACGGACGAGTTACATGCGACGG | 34 | 34 | 20 | 7 | 29 | 35 |
| 3963 | 3950 | 30887 | 79.3 | GGACGGACACCTGCAACTTGGCAA | 34 | 34 | 23 | 21 | 11 | 21 |
| 3964 | 3951 | 41103 | 77.2 | GGACGGACGATGTTAGACGGAGCC | 34 | 34 | 27 | 3 | 35 | 36 |
| 3965 | 3952 | 11662 | 79.5 | GGACGGACTCCCAGTGACGGTCGT | 34 | 34 | 28 | 22 | 35 | 10 |
| 3966 | 3953 | 22239 | 79.6 | GGACGGACTGCGAGGATCTGCCAT | 34 | 34 | 29 | 25 | 8 | 15 |
| 3967 | 3954 | 11664 | 77.3 | GGACGGACCAGCCCATGCTTAAAG | 34 | 34 | 31 | 15 | 17 | 6 |
| 3968 | 3955 | 11667 | 79.2 | GGACACGGTTAGGACCTGCGAGCC | 34 | 35 | 3 | 32 | 29 | 36 |
| 3969 | 3956 | 16616 | 79.1 | GGACACGGTCTGAGCCTCGTGTGC | 34 | 35 | 8 | 36 | 10 | 33 |
| 3970 | 3957 | 11670 | 77.1 | GGACACGGCGTTAATCTGCGAGTG | 34 | 35 | 12 | 4 | 29 | 22 |
| 3971 | 3958 | 11672 | 75.5 | GGACACGGCTGTTACAGCTTTCCC | 34 | 35 | 14 | 7 | 17 | 28 |
| 3972 | 3959 | 22240 | 78 | GGACACGGGAGTCGAAGGACATCG | 34 | 35 | 20 | 16 | 34 | 24 |
| 3973 | 3960 | 11674 | 77.4 | GGACACGGAGTGCGTTCCTAAGCC | 34 | 35 | 22 | 12 | 26 | 36 |
| 3974 | 3961 | 11681 | 77.3 | GGACAGCCCGTTCTTGAATCCAGC | 34 | 36 | 12 | 11 | 4 | 31 |
| 3975 | 3962 | 30889 | 76.6 | GGACAGCCCTGTAAAGAGCCGACC | 34 | 36 | 14 | 6 | 36 | 32 |
| 3976 | 3963 | 11688 | 81.1 | GGACAGCCTGCGGCAACTCAGTGC | 34 | 36 | 29 | 21 | 13 | 33 |
| 3977 | 3964 | 16618 | 82.8 | GGACAGCCCACGCACGTGATGCAA | 34 | 36 | 30 | 30 | 2 | 21 |
| 3978 | 3965 | 11690 | 80.8 | GGACAGCCGACCCGTTCTGTCACG | 34 | 36 | 32 | 12 | 14 | 30 |

FIG. 25AAAA

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 3979 | 3966 | 11692 | 79.1 | GGACAGCCGGACCCTACTCAACGG | 34 | 36 | 34 | 26 | 13 | 35 |
| 3980 | 3968 | 30890 | 77.9 | ACGGTTGACCATTGATTGCGGCTT | 35 | 1 | 15 | 2 | 29 | 17 |
| 3981 | 3969 | 11704 | 79.8 | ACGGTTGACAGCCACGATCGCTCA | 35 | 1 | 31 | 30 | 24 | 13 |
| 3982 | 3970 | 11705 | 80.2 | ACGGTTGAGACCGGACGATGACGG | 35 | 1 | 32 | 34 | 27 | 35 |
| 3983 | 3971 | 41106 | 78.5 | ACGGTTGAGTGCTGCGTTGATCCC | 35 | 1 | 33 | 29 | 1 | 28 |
| 3984 | 3972 | 41107 | 78.7 | ACGGTGATCGAAGCAAATCGCAGC | 35 | 2 | 16 | 21 | 24 | 31 |
| 3985 | 3973 | 16624 | 77.2 | ACGGTGATGCAAACCTTCCCTCGT | 35 | 2 | 21 | 23 | 28 | 10 |
| 3986 | 3974 | 16625 | 79.1 | ACGGTGATGGACTCCCTGCGGTCT | 35 | 2 | 34 | 28 | 29 | 19 |
| 3987 | 3975 | 30891 | 77.4 | ACGGTTAGGCAACACGGATGGACC | 35 | 3 | 21 | 30 | 27 | 32 |
| 3988 | 3976 | 11723 | 75.2 | ACGGTTAGTCCCAAAGGGACTCCC | 35 | 3 | 28 | 6 | 34 | 28 |
| 3989 | 3977 | 41110 | 78.1 | ACGGTTAGCACGCAGCTTGAAGCC | 35 | 3 | 30 | 31 | 1 | 36 |
| 3990 | 3978 | 22253 | 78.5 | ACGGAATCCCATTCGTAGCCGACC | 35 | 4 | 15 | 10 | 36 | 32 |
| 3991 | 3979 | 16633 | 76.3 | ACGGAATCCGAAACCTGGACCCTA | 35 | 4 | 16 | 23 | 34 | 26 |
| 3992 | 3980 | 30892 | 78.6 | ACGGAATCATCGAGCCCAGCAGTG | 35 | 4 | 24 | 36 | 31 | 22 |
| 3993 | 3981 | 41116 | 79.4 | ACGGAATCCCTACACGAGCCACGG | 35 | 4 | 26 | 30 | 36 | 35 |
| 3994 | 3982 | 11742 | 76.6 | ACGGAATCGATGTCTGGACCTCCC | 35 | 4 | 27 | 8 | 32 | 28 |
| 3995 | 3983 | 11743 | 77.3 | ACGGAATCTCCCGGTAGCAACGAA | 35 | 4 | 28 | 18 | 21 | 16 |
| 3996 | 3984 | 41117 | 77 | ACGGAATCGGACTGATACGGCCAT | 35 | 4 | 34 | 2 | 35 | 15 |
| 3997 | 3985 | 30893 | 76.1 | ACGGATACCGAACGTTCGAACGAA | 35 | 5 | 16 | 12 | 16 | 16 |
| 3998 | 3986 | 41119 | 75.7 | ACGGATACGCTTGACCCGTTATCG | 35 | 5 | 17 | 32 | 12 | 24 |
| 3999 | 3987 | 16644 | 77 | ACGGATACGGACTTGACACGCGAA | 35 | 5 | 34 | 1 | 30 | 16 |
| 4000 | 3988 | 41122 | 75.9 | ACGGAAAGCTCAGCAACAGCGTCT | 35 | 6 | 13 | 21 | 31 | 19 |
| 4001 | 3989 | 16647 | 75.2 | ACGGAAAGCTGTATCGCTTGGACC | 35 | 6 | 14 | 24 | 11 | 32 |
| 4002 | 3990 | 30894 | 76.1 | ACGGAAAGCGAATTAGACGGGGAC | 35 | 6 | 16 | 3 | 35 | 34 |
| 4003 | 3991 | 16650 | 75.4 | ACGGAAAGGAGTATCGTCCCCCAT | 35 | 6 | 20 | 24 | 28 | 15 |
| 4004 | 3992 | 30895 | 78.8 | ACGGAAAGAGGACACGTCCCCAGC | 35 | 6 | 25 | 30 | 28 | 31 |
| 4005 | 3993 | 11771 | 76.5 | ACGGAAAGCAGCTCGTGTGCTGAT | 35 | 6 | 31 | 10 | 33 | 2 |
| 4006 | 3994 | 16653 | 79.2 | ACGGAAAGGTGCGACCCCATATCG | 35 | 6 | 33 | 32 | 15 | 24 |
| 4007 | 3995 | 41125 | 78.8 | ACGGAAAGAGCCGGTAGCAAACGG | 35 | 6 | 36 | 18 | 21 | 35 |
| 4008 | 3996 | 11777 | 76.8 | ACGGTACAGCTTGATGGCTTTGCG | 35 | 7 | 17 | 27 | 17 | 29 |
| 4009 | 3997 | 30896 | 76.3 | ACGGTACATGCGTCCCTGATACGG | 35 | 7 | 29 | 28 | 2 | 35 |
| 4010 | 3998 | 11786 | 81.8 | ACGGTCTGAAAGCACGCACGCGAA | 35 | 8 | 6 | 30 | 30 | 16 |
| 4011 | 3999 | 16655 | 78.4 | ACGGTCTGCGTTGACCAGTGTCCC | 35 | 8 | 12 | 32 | 22 | 28 |
| 4012 | 4000 | 11789 | 77.3 | ACGGTCTGCTCACGTTCAGCAGGA | 35 | 8 | 13 | 12 | 31 | 25 |
| 4013 | 4001 | 11790 | 76.6 | ACGGTCTGCTGTCGAAATCGGATG | 35 | 8 | 14 | 16 | 24 | 27 |
| 4014 | 4002 | 16656 | 80 | ACGGTCTGCCATGTGCCACGTGTC | 35 | 8 | 15 | 33 | 30 | 9 |
| 4015 | 4003 | 41126 | 76.4 | ACGGTCTGGGTATTGAATCGTGCG | 35 | 8 | 18 | 1 | 24 | 29 |
| 4016 | 4004 | 16657 | 77.5 | ACGGTCTGAGGAACCTAGCCGCAA | 35 | 8 | 25 | 23 | 36 | 21 |
| 4017 | 4005 | 11800 | 78 | ACGGTCTGGGACCCATACGGGTCT | 35 | 8 | 34 | 15 | 35 | 19 |
| 4018 | 4006 | 30897 | 78.1 | ACGGTGTCCTCAGGACGTGCCTGT | 35 | 9 | 13 | 34 | 33 | 14 |
| 4019 | 4007 | 30898 | 75.2 | ACGGTGTCCCATATCGAATCGCTT | 35 | 9 | 15 | 24 | 4 | 17 |
| 4020 | 4008 | 11803 | 76.6 | ACGGTGTCGGTAAGTGGTCTTGCG | 35 | 9 | 18 | 22 | 19 | 29 |
| 4021 | 4009 | 16662 | 79.1 | ACGGTGTCCACGACCTGACCGATG | 35 | 9 | 30 | 23 | 32 | 27 |
| 4022 | 4010 | 30899 | 79.1 | ACGGTCGTTGATTTGAACGGCACG | 35 | 10 | 2 | 1 | 35 | 30 |
| 4023 | 4011 | 30900 | 77.9 | ACGGTCGTCGTTTTAGACGGCAGC | 35 | 10 | 12 | 3 | 35 | 31 |
| 4024 | 4012 | 41130 | 77 | ACGGTCGTCTCATTAGCAGCTGCG | 35 | 10 | 13 | 3 | 31 | 29 |
| 4025 | 4013 | 30901 | 76.7 | ACGGTCGTGCTTAGGACGTTCACG | 35 | 10 | 17 | 25 | 12 | 30 |
| 4026 | 4014 | 16667 | 76 | ACGGTCGTACCTTCGTTGCGAAAG | 35 | 10 | 23 | 10 | 29 | 6 |
| 4027 | 4015 | 30902 | 78.5 | ACGGTCGTGATGAAAGGGACTGCG | 35 | 10 | 27 | 6 | 34 | 29 |
| 4028 | 4016 | 11823 | 80.9 | ACGGTCGTTGCGCTTGTCGTTCGT | 35 | 10 | 29 | 11 | 10 | 10 |
| 4029 | 4017 | 11824 | 80.4 | ACGGTCGTGTGCCCATGATGCTCA | 35 | 10 | 33 | 15 | 27 | 13 |

FIG. 25BBBB

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 4030 | 4018 | 41133 | 77.5 | ACGGTCGTACGGATACTGCGGACC | 35 | 10 | 35 | 5 | 29 | 32 |
| 4031 | 4019 | 16668 | 78.8 | ACGGCTTGTCTGAGGAGTGCACGG | 35 | 11 | 8 | 25 | 33 | 35 |
| 4032 | 4020 | 16669 | 76 | ACGGCTTGTCGTGCTTAATCAGCC | 35 | 11 | 10 | 17 | 4 | 36 |
| 4033 | 4021 | 30903 | 78.4 | ACGGCTTGGGTACTCACACGGTGC | 35 | 11 | 18 | 13 | 30 | 33 |
| 4034 | 4022 | 30904 | 78.4 | ACGGCTTGGAGTCGTTCAGCCTCA | 35 | 11 | 20 | 12 | 31 | 13 |
| 4035 | 4023 | 30905 | 78.3 | ACGGCTTGAGTGTCCCTCTGGCAA | 35 | 11 | 22 | 28 | 8 | 21 |
| 4036 | 4024 | 41138 | 78.8 | ACGGCTTGACCTGACCCCATCCAT | 35 | 11 | 23 | 32 | 15 | 15 |
| 4037 | 4025 | 30906 | 77.8 | ACGGCTTGAGGAGGACTCCCGTCT | 35 | 11 | 25 | 34 | 28 | 19 |
| 4038 | 4026 | 11842 | 80.3 | ACGGCTTGCAGCCAGCTGATTCGT | 35 | 11 | 31 | 31 | 2 | 10 |
| 4039 | 4027 | 11844 | 80.9 | ACGGCTTGGTGCCCATTGATGTGC | 35 | 11 | 33 | 15 | 2 | 33 |
| 4040 | 4028 | 11845 | 79.7 | ACGGCTTGGGACCACGACCTGGTA | 35 | 11 | 34 | 30 | 23 | 18 |
| 4041 | 4029 | 16671 | 77.2 | ACGGCTTGACGGATACCGTTTCGT | 35 | 11 | 35 | 5 | 12 | 10 |
| 4042 | 4030 | 11847 | 78.2 | ACGGCGTTTGATGATGATCGGACC | 35 | 12 | 2 | 27 | 24 | 32 |
| 4043 | 4031 | 11849 | 75.7 | ACGGCGTTTACAGACCCTGTGGAC | 35 | 12 | 7 | 32 | 14 | 34 |
| 4044 | 4032 | 11850 | 79.2 | ACGGCGTTTCTGGTCTCAGCCCAT | 35 | 12 | 8 | 19 | 31 | 15 |
| 4045 | 4033 | 11851 | 76 | ACGGCGTTTGTCTTGAAGGACAGC | 35 | 12 | 9 | 1 | 25 | 31 |
| 4046 | 4034 | 41141 | 76.4 | ACGGCGTTCTCATTGAAAAGCGAA | 35 | 12 | 13 | 1 | 6 | 16 |
| 4047 | 4035 | 41142 | 76.8 | ACGGCGTTCTGTACCTCTTGTGCG | 35 | 12 | 14 | 23 | 11 | 29 |
| 4048 | 4036 | 11856 | 78.1 | ACGGCGTTGCTTGCTTAGGAGTGC | 35 | 12 | 17 | 17 | 25 | 33 |
| 4049 | 4037 | 11857 | 75.3 | ACGGCGTTGGTATCGTAGGACGTT | 35 | 12 | 18 | 10 | 25 | 12 |
| 4050 | 4038 | 41143 | 75.5 | ACGGCGTTACCTAGTGACGGCTGT | 35 | 12 | 23 | 22 | 35 | 14 |
| 4051 | 4039 | 30907 | 76.6 | ACGGCGTTAGGAATCGGTCTCGTT | 35 | 12 | 25 | 24 | 19 | 12 |
| 4052 | 4040 | 11861 | 76.3 | ACGGCGTTCCTAAATCGTGCTTGA | 35 | 12 | 26 | 4 | 33 | 1 |
| 4053 | 4041 | 11862 | 80.5 | ACGGCGTTTGCGTTGAGATGAGCC | 35 | 12 | 29 | 1 | 27 | 36 |
| 4054 | 4042 | 11863 | 80 | ACGGCGTTCACGGTCTTCGTTCGT | 35 | 12 | 30 | 19 | 10 | 10 |
| 4055 | 4043 | 11864 | 80.1 | ACGGCGTTCAGCTGCGTGATCTCA | 35 | 12 | 31 | 29 | 2 | 13 |
| 4056 | 4044 | 11865 | 78.5 | ACGGCGTTGGACACCTGCTTTGTC | 35 | 12 | 34 | 23 | 17 | 9 |
| 4057 | 4045 | 41145 | 79.1 | ACGGCGTTACGGTACAATCGTGCG | 35 | 12 | 35 | 7 | 24 | 29 |
| 4058 | 4046 | 41146 | 79.4 | ACGGCTCATGATCACGACGGCTTG | 35 | 13 | 2 | 30 | 35 | 11 |
| 4059 | 4047 | 11867 | 76.3 | ACGGCTCATTAGGCAACGTTCGAA | 35 | 13 | 3 | 21 | 12 | 16 |
| 4060 | 4048 | 30908 | 77.8 | ACGGCTCAAAAGGTGCGCAAAATC | 35 | 13 | 6 | 33 | 21 | 4 |
| 4061 | 4049 | 16677 | 76.6 | ACGGCTCATCGTATCGAGTGACGG | 35 | 13 | 10 | 24 | 22 | 35 |
| 4062 | 4050 | 11874 | 76.3 | ACGGCTCACGTTCTGTCCATGCTT | 35 | 13 | 12 | 14 | 15 | 17 |
| 4063 | 4051 | 30909 | 78.8 | ACGGCTCAGCTTGCAATGCGAATC | 35 | 13 | 17 | 21 | 29 | 4 |
| 4064 | 4052 | 11878 | 75.8 | ACGGCTCAGGTAATACGGACGTGC | 35 | 13 | 18 | 5 | 34 | 33 |
| 4065 | 4053 | 11881 | 76 | ACGGCTCAGCAAAGGACTGTACGG | 35 | 13 | 21 | 25 | 14 | 35 |
| 4066 | 4054 | 41151 | 77.1 | ACGGCTCACCTACCTAAGCCGTGC | 35 | 13 | 26 | 26 | 36 | 33 |
| 4067 | 4055 | 11886 | 82.1 | ACGGCTCATGCGGATGAGTGTGCG | 35 | 13 | 29 | 27 | 22 | 29 |
| 4068 | 4056 | 11888 | 78.3 | ACGGCTCAGACCCTTGGTGCTTGA | 35 | 13 | 32 | 11 | 33 | 1 |
| 4069 | 4058 | 11890 | 75.9 | ACGGCTGTAATCTCTGTCCCGTGC | 35 | 14 | 4 | 8 | 28 | 33 |
| 4070 | 4059 | 41153 | 80.3 | ACGGCTGTTCTGGGACGACCGATG | 35 | 14 | 8 | 34 | 32 | 27 |
| 4071 | 4060 | 30911 | 78 | ACGGCTGTCGAAAGTGGACCGGTA | 35 | 14 | 16 | 22 | 32 | 18 |
| 4072 | 4061 | 11896 | 77.3 | ACGGCTGTGCTTCTGTGCAAAGGA | 35 | 14 | 17 | 14 | 21 | 25 |
| 4073 | 4063 | 30912 | 78.9 | ACGGCTGTGTCTTGCGGAGTCAGC | 35 | 14 | 19 | 29 | 20 | 31 |
| 4074 | 4064 | 41155 | 76.1 | ACGGCTGTGAGTAGTGAGCCCAGC | 35 | 14 | 20 | 22 | 36 | 31 |
| 4075 | 4065 | 30913 | 79 | ACGGCTGTACCTTGTCAGCCGCAA | 35 | 14 | 23 | 9 | 36 | 21 |
| 4076 | 4066 | 30914 | 77.7 | ACGGCTGTACGGTGATTCGTGCAA | 35 | 14 | 35 | 2 | 10 | 21 |
| 4077 | 4067 | 11907 | 78.1 | ACGGCCATTGTCCGTTTCTGCTGT | 35 | 15 | 9 | 12 | 8 | 14 |
| 4078 | 4068 | 11908 | 77.9 | ACGGCCATTCGTGTGCCCTAGGTA | 35 | 15 | 10 | 33 | 26 | 18 |
| 4079 | 4069 | 30916 | 77.2 | ACGGCCATCTCAACCTCTTGCCAT | 35 | 15 | 13 | 23 | 11 | 15 |
| 4080 | 4070 | 30917 | 78 | ACGGCCATAGTGCCATAGCCAGGA | 35 | 15 | 22 | 15 | 36 | 25 |

FIG. 25CCCC

| SEQ ID NO: | 4,633 ID# | H3X ID# | Tm | ZIPCODE (5'-3') | TETRAMER NUMBERS | | | | | |
|---|---|---|---|---|---|---|---|---|---|---|
| 4081 | 4071 | 41157 | 76.2 | ACGGCCATCCTAGCTTTGTCTCCC | 35 | 15 | 26 | 17 | 9 | 28 |
| 4082 | 4072 | 11917 | 81.8 | ACGGCCATTCCCCCATCTGTCACG | 35 | 15 | 28 | 15 | 14 | 30 |
| 4083 | 4073 | 11918 | 82.5 | ACGGCCATTGCGCGTTGAGTCGTT | 35 | 15 | 29 | 12 | 20 | 12 |
| 4084 | 4074 | 11919 | 79.9 | ACGGCCATGACCCTGTCCATACGG | 35 | 15 | 32 | 14 | 15 | 35 |
| 4085 | 4075 | 41158 | 78.3 | ACGGCCATAGCCCCTAAAAGGCAA | 35 | 15 | 36 | 26 | 6 | 21 |
| 4086 | 4076 | 41159 | 77.4 | ACGGCGAATTGAAGTGATCGGCTT | 35 | 16 | 1 | 22 | 24 | 17 |
| 4087 | 4077 | 30918 | 76.6 | ACGGCGAATGATAGGACAGCGATG | 35 | 16 | 2 | 25 | 31 | 27 |
| 4088 | 4078 | 41160 | 77.7 | ACGGCGAATTAGGATGCTTGACGG | 35 | 16 | 3 | 27 | 11 | 35 |
| 4089 | 4079 | 11922 | 75.8 | ACGGCGAAAATCTACAATCGGTGC | 35 | 16 | 4 | 7 | 24 | 33 |
| 4090 | 4080 | 11924 | 75.3 | ACGGCGAATCTGTCTGGGTATCGT | 35 | 16 | 8 | 8 | 18 | 10 |
| 4091 | 4081 | 41161 | 79.3 | ACGGCGAATCGTTGATCGTTTCCC | 35 | 16 | 10 | 2 | 12 | 28 |
| 4092 | 4082 | 11926 | 79.4 | ACGGCGAACTTGGAGTGTGCATCG | 35 | 16 | 11 | 20 | 33 | 24 |
| 4093 | 4083 | 11927 | 79 | ACGGCGAACGTTTCGTCTGTCGAA | 35 | 16 | 12 | 10 | 14 | 16 |
| 4094 | 4084 | 11928 | 76.1 | ACGGCGAACTCATTGACCATCGTT | 35 | 16 | 13 | 1 | 15 | 12 |
| 4095 | 4085 | 11931 | 75.6 | ACGGCGAAGGTATCTGAGTGCGTT | 35 | 16 | 18 | 8 | 22 | 12 |
| 4096 | 4086 | 41162 | 79.4 | ACGGCGAAGAGTGATGGATGTGCG | 35 | 16 | 20 | 27 | 27 | 29 |
| 4097 | 4087 | 41163 | 80.4 | ACGGCGAAATCGAGGATGTCTGCG | 35 | 16 | 24 | 25 | 9 | 29 |
| 4098 | 4088 | 11935 | 79.8 | ACGGCGAATCCCACCTGCTTGGTA | 35 | 16 | 28 | 23 | 17 | 18 |
| 4099 | 4089 | 11937 | 80.1 | ACGGCGAACACGCTTGGAGTTCGT | 35 | 16 | 30 | 11 | 20 | 10 |
| 4100 | 4090 | 30919 | 80.8 | ACGGCGAAGTGCACGGTCGTCCTA | 35 | 16 | 33 | 35 | 10 | 26 |
| 4101 | 4091 | 11939 | 80.1 | ACGGCGAAGGACCTCACACGCTGT | 35 | 16 | 34 | 13 | 30 | 14 |
| 4102 | 4092 | 11940 | 79.5 | ACGGCGAAAGCCAATCCGAACTTG | 35 | 16 | 36 | 4 | 16 | 11 |
| 4103 | 4093 | 30920 | 75.2 | ACGGGCTTTTGACCTAATCGCTTG | 35 | 17 | 1 | 26 | 24 | 11 |
| 4104 | 4094 | 16691 | 76.5 | ACGGGCTTTGATTACATGCGATCG | 35 | 17 | 2 | 7 | 29 | 24 |
| 4105 | 4095 | 30921 | 77.4 | ACGGGCTTTTAGGTGCCGTTCTCA | 35 | 17 | 3 | 33 | 12 | 13 |
| 4106 | 4096 | 30922 | 77.3 | ACGGGCTTAAAGCCTATCCCCAGC | 35 | 17 | 6 | 26 | 28 | 31 |
| 4107 | 4097 | 16692 | 76.3 | ACGGGCTTTACATCGTCAGCAGGA | 35 | 17 | 7 | 10 | 31 | 25 |
| 4108 | 4098 | 30923 | 78.7 | ACGGGCTTCGTTCTCACGTTTCCC | 35 | 17 | 12 | 13 | 12 | 28 |
| 4109 | 4099 | 30924 | 76.3 | ACGGGCTTCTCATCGTCCTAAGCC | 35 | 17 | 13 | 10 | 26 | 36 |
| 4110 | 4100 | 41164 | 75.1 | ACGGGCTTCTGTAGGAGCTTCGAA | 35 | 17 | 14 | 25 | 17 | 16 |
| 4111 | 4101 | 11949 | 75.6 | ACGGGCTTGGTAAAAGCTGTCGAA | 35 | 17 | 18 | 6 | 14 | 16 |
| 4112 | 4102 | 30926 | 77.3 | ACGGGCTTGAGTGGTAGTGCCGTT | 35 | 17 | 20 | 18 | 33 | 12 |
| 4113 | 4103 | 11957 | 80.1 | ACGGGCTTTCCCGCTTCCATCCTA | 35 | 17 | 28 | 17 | 15 | 26 |
| 4114 | 4104 | 11958 | 75.9 | ACGGGCTTGACCTTGATTAGTGCG | 35 | 17 | 32 | 1 | 3 | 29 |
| 4115 | 4105 | 11960 | 75.8 | ACGGGGTATGATCACGGATGCCTA | 35 | 18 | 2 | 30 | 27 | 26 |
| 4116 | 4106 | 16703 | 76.1 | ACGGGGTATACAAGCCGTGCTTGA | 35 | 18 | 7 | 36 | 33 | 1 |
| 4117 | 4107 | 16704 | 76.6 | ACGGGGTATCTGACGGAGTGTCCC | 35 | 18 | 8 | 35 | 22 | 28 |
| 4118 | 4108 | 22300 | 75.2 | ACGGGGTACGTTCACGAATCTCGT | 35 | 18 | 12 | 30 | 4 | 10 |
| 4119 | 4109 | 30927 | 77.4 | ACGGGGTACTGTGAGTTCCCCACG | 35 | 18 | 14 | 20 | 28 | 30 |
| 4120 | 4110 | 30928 | 77.3 | ACGGGGTAGCTTGGTACAGCCGAA | 35 | 18 | 17 | 18 | 31 | 16 |
| 4121 | 4111 | 30929 | 76 | ACGGGGTAGCAAAATCCGAAGACC | 35 | 18 | 21 | 4 | 16 | 32 |
| 4122 | 4112 | 11972 | 76.2 | ACGGGGTAAGGAGTCTCACGAGCC | 35 | 18 | 25 | 19 | 30 | 36 |
| 4123 | 4113 | 16710 | 75.3 | ACGGGGTACCTATCCCTCGTCCAT | 35 | 18 | 26 | 28 | 10 | 15 |
| 4124 | 4114 | 11975 | 78.6 | ACGGGGTATGCGCGTTAGGAGACC | 35 | 18 | 29 | 12 | 25 | 32 |
| 4125 | 4115 | 11976 | 76.6 | ACGGGGTAGTGCATACGAGTTGCG | 35 | 18 | 33 | 5 | 20 | 29 |
| 4126 | 4116 | 30930 | 76.3 | ACGGGGTAGGACTCTGCTTGAGCC | 35 | 18 | 34 | 8 | 11 | 36 |
| 4127 | 4117 | 16711 | 78.4 | ACGGGGTAACGGCCTAAATCCACG | 35 | 18 | 35 | 26 | 4 | 30 |
| 4128 | 4118 | 16712 | 78.5 | ACGGGGTAAGCCCGAACTGTACGG | 35 | 18 | 36 | 16 | 14 | 35 |
| 4129 | 4119 | 11982 | 76.1 | ACGGGTCTAAAGCGAATCCCCTTG | 35 | 19 | 6 | 16 | 28 | 11 |
| 4130 | 4120 | 41170 | 78.5 | ACGGGTCTCGTTGCAAGATGGTGC | 35 | 19 | 12 | 21 | 27 | 33 |
| 4131 | 4121 | 11987 | 76.6 | ACGGGTCTCTCAAGCCACCTCGTT | 35 | 19 | 13 | 36 | 23 | 12 |

FIG. 25DDDD

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 4132 | 4122 | 11990 | 76.9 | ACGGGTCTCGAAGGACGTCTGGAC | 35 | 19 | 16 | 34 | 19 | 34 |
| 4133 | 4123 | 30931 | 79.1 | ACGGGTCTATCGACGGGCTTCGAA | 35 | 19 | 24 | 35 | 17 | 16 |
| 4134 | 4124 | 11997 | 78.2 | ACGGGTCTGACCCTTGGGACTCGT | 35 | 19 | 32 | 11 | 34 | 10 |
| 4135 | 4125 | 11998 | 77.5 | ACGGGTCTGTGCAAAGGATGTCCC | 35 | 19 | 33 | 6 | 27 | 28 |
| 4136 | 4126 | 11999 | 78.6 | ACGGGTCTACGGGACCTCGTGGAC | 35 | 19 | 35 | 32 | 10 | 34 |
| 4137 | 4127 | 12000 | 76.1 | ACGGGAGTTGATCTGTTCCCCCAT | 35 | 20 | 2 | 14 | 28 | 15 |
| 4138 | 4128 | 16717 | 78.9 | ACGGGAGTCTTGCAGCACCTTCCC | 35 | 20 | 11 | 31 | 23 | 28 |
| 4139 | 4129 | 12004 | 76.6 | ACGGGAGTCTCAAGCCAAAGCCAT | 35 | 20 | 13 | 36 | 6 | 15 |
| 4140 | 4130 | 30932 | 78.8 | ACGGGAGTGGTAAGTGGTGCGCAA | 35 | 20 | 18 | 22 | 33 | 21 |
| 4141 | 4131 | 12011 | 78.9 | ACGGGAGTGATGGTGCTCTGGCAA | 35 | 20 | 27 | 33 | 8 | 21 |
| 4142 | 4132 | 12012 | 79.4 | ACGGGAGTTCCCCTGTCACGATCG | 35 | 20 | 28 | 14 | 30 | 24 |
| 4143 | 4133 | 30933 | 77.7 | ACGGGAGTCAGCTGATGACCGACC | 35 | 20 | 31 | 2 | 32 | 32 |
| 4144 | 4134 | 30934 | 77.8 | ACGGGCAAAATCAGTGCCATCCAT | 35 | 21 | 4 | 22 | 15 | 15 |
| 4145 | 4135 | 30935 | 76.8 | ACGGGCAAATACAGTGATCGGCAA | 35 | 21 | 5 | 22 | 24 | 21 |
| 4146 | 4136 | 41174 | 76.1 | ACGGGCAATACACTTGAGCCGGTA | 35 | 21 | 7 | 11 | 36 | 18 |
| 4147 | 4137 | 30936 | 76.4 | ACGGGCAACGTTTTAGCCTAAGCC | 35 | 21 | 12 | 3 | 26 | 36 |
| 4148 | 4138 | 12024 | 78.2 | ACGGGCAAGCTTCGAACAGCTCTG | 35 | 21 | 17 | 16 | 31 | 8 |
| 4149 | 4139 | 12026 | 76.5 | ACGGGCAAGAGTCTCAGACCCCAT | 35 | 21 | 20 | 13 | 32 | 15 |
| 4150 | 4140 | 30937 | 80 | ACGGGCAAGCAAATCGCGTTGTCT | 35 | 21 | 21 | 24 | 12 | 19 |
| 4151 | 4141 | 16725 | 75.5 | ACGGGCAACCTACACGCCTAGGTA | 35 | 21 | 26 | 30 | 26 | 18 |
| 4152 | 4142 | 12033 | 82.4 | ACGGGCAAACGGCCATGTCTCGAA | 35 | 21 | 35 | 15 | 19 | 16 |
| 4153 | 4143 | 12034 | 79.1 | ACGGGCAAAGCCTCTGCCTAGTGC | 35 | 21 | 36 | 8 | 26 | 33 |
| 4154 | 4144 | 30938 | 77.6 | ACGGAGTGCGAATTGATCGTTCCC | 35 | 22 | 16 | 1 | 10 | 28 |
| 4155 | 4146 | 22312 | 77.6 | ACGGAGTGGGTACGAAGTGCGACC | 35 | 22 | 18 | 16 | 33 | 32 |
| 4156 | 4147 | 12044 | 76.9 | ACGGAGTGGAGTTGTCTCCCCAGC | 35 | 22 | 20 | 9 | 28 | 31 |
| 4157 | 4148 | 41178 | 77.4 | ACGGAGTGGCAACAGCCTTGACCT | 35 | 22 | 21 | 31 | 11 | 23 |
| 4158 | 4149 | 22313 | 76.6 | ACGGAGTGATCGTCGTCTCAACGG | 35 | 22 | 24 | 10 | 13 | 35 |
| 4159 | 4150 | 12047 | 75.4 | ACGGAGTGCCTACGTTTGTCCGTT | 35 | 22 | 26 | 12 | 9 | 12 |
| 4160 | 4151 | 12048 | 77.9 | ACGGAGTGTGCGTCGTGCAAGGTA | 35 | 22 | 29 | 10 | 21 | 18 |
| 4161 | 4152 | 16729 | 80.5 | ACGGAGTGGGACGCTTGCAACAGC | 35 | 22 | 34 | 17 | 21 | 31 |
| 4162 | 4153 | 12055 | 78.1 | ACGGACCTTGATGATGTCCCACGG | 35 | 23 | 2 | 27 | 28 | 35 |
| 4163 | 4154 | 12058 | 78.9 | ACGGACCTTGTCCGTTGACCCGTT | 35 | 23 | 9 | 12 | 32 | 12 |
| 4164 | 4155 | 12059 | 77.5 | ACGGACCTCTTGCACGCCTAAGGA | 35 | 23 | 11 | 30 | 26 | 25 |
| 4165 | 4156 | 30939 | 75.9 | ACGGACCTGCTTAAAGCCATCACG | 35 | 23 | 17 | 6 | 15 | 30 |
| 4166 | 4157 | 12063 | 77.9 | ACGGACCTGTCTGACCCCATCGAA | 35 | 23 | 19 | 32 | 15 | 16 |
| 4167 | 4158 | 12066 | 78.6 | ACGGACCTTCCCGAGTTTGAACGG | 35 | 23 | 28 | 20 | 1 | 35 |
| 4168 | 4159 | 30940 | 78.3 | ACGGACCTGACCAAAGACGGGCTT | 35 | 23 | 32 | 6 | 35 | 17 |
| 4169 | 4160 | 16731 | 78.1 | ACGGACCTAGCCGCTTTCTGTCCC | 35 | 23 | 36 | 17 | 8 | 28 |
| 4170 | 4161 | 41185 | 76.8 | ACGGATCGAAAGTCCCAAAGACGG | 35 | 24 | 6 | 28 | 6 | 35 |
| 4171 | 4163 | 12074 | 80.3 | ACGGATCGTGTCCGAACACGAGCC | 35 | 24 | 9 | 16 | 30 | 36 |
| 4172 | 4164 | 30942 | 77.8 | ACGGATCGCTCACGAATCCCTCTG | 35 | 24 | 13 | 16 | 28 | 8 |
| 4173 | 4165 | 12079 | 77.9 | ACGGATCGCTGTCTGTGATGCGAA | 35 | 24 | 14 | 14 | 27 | 16 |
| 4174 | 4166 | 41188 | 78.5 | ACGGATCGGAGTCGAACGAACACG | 35 | 24 | 20 | 16 | 16 | 30 |
| 4175 | 4167 | 41189 | 79.8 | ACGGATCGGCAACTTGGACCCTCA | 35 | 24 | 21 | 11 | 32 | 13 |
| 4176 | 4168 | 12083 | 77.4 | ACGGATCGAGTGTCTGCCATCACG | 35 | 24 | 22 | 8 | 15 | 30 |
| 4177 | 4169 | 30943 | 77.1 | ACGGATCGACCTCTTGACGGGGTA | 35 | 24 | 23 | 11 | 35 | 18 |
| 4178 | 4170 | 30945 | 79.4 | ACGGATCGCAGCTCCCTGATGCTT | 35 | 24 | 31 | 28 | 2 | 17 |
| 4179 | 4171 | 12088 | 78.2 | ACGGATCGGGACGGACTTAGCCAT | 35 | 24 | 34 | 34 | 3 | 15 |
| 4180 | 4172 | 12089 | 80.6 | ACGGATCGACGGCTCAGAGTTGCG | 35 | 24 | 35 | 13 | 20 | 29 |
| 4181 | 4173 | 22320 | 78.1 | ACGGATCGAGCCCCTAAGGAGTGC | 35 | 24 | 36 | 26 | 25 | 33 |
| 4182 | 4175 | 22321 | 75 | ACGGAGGATCTGGCAAACCTATCG | 35 | 25 | 8 | 21 | 23 | 24 |

FIG. 25EEEE

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 4183 | 4176 | 12098 | 75.5 | ACGGAGGACCATAATCGATGACGG | 35 | 25 | 15 | 4 | 27 | 35 |
| 4184 | 4177 | 30946 | 76.7 | ACGGAGGAGCTTGTGCCGTTACCT | 35 | 25 | 17 | 33 | 12 | 23 |
| 4185 | 4178 | 41192 | 78.6 | ACGGAGGAGGTATCGTGTGCTGCG | 35 | 25 | 18 | 10 | 33 | 29 |
| 4186 | 4179 | 22323 | 79.8 | ACGGAGGAGTCTAGCCCACGTGCG | 35 | 25 | 19 | 36 | 30 | 29 |
| 4187 | 4180 | 16734 | 76.6 | ACGGAGGAGCAAAGCCAATCCTGT | 35 | 25 | 21 | 36 | 4 | 14 |
| 4188 | 4181 | 12106 | 79.6 | ACGGAGGATGCGCCTAACCTCACG | 35 | 25 | 29 | 26 | 23 | 30 |
| 4189 | 4182 | 12110 | 76.7 | ACGGCCTATCTGGAGTCAGCCGTT | 35 | 26 | 8 | 20 | 31 | 12 |
| 4190 | 4183 | 41199 | 78.5 | ACGGCCTACTGTGGACACGGCTTG | 35 | 26 | 14 | 34 | 35 | 11 |
| 4191 | 4184 | 30948 | 77.1 | ACGGCCTAGAGTTCGTGGACCAGC | 35 | 26 | 20 | 10 | 34 | 31 |
| 4192 | 4185 | 30950 | 76.7 | ACGGCCTACCTATCCCTGTCACGG | 35 | 26 | 26 | 28 | 9 | 35 |
| 4193 | 4186 | 22328 | 76.5 | ACGGGATGAATCCCATAGGAACGG | 35 | 27 | 4 | 15 | 25 | 35 |
| 4194 | 4187 | 12121 | 76.6 | ACGGGATGCCATCGAATTAGTCCC | 35 | 27 | 15 | 16 | 3 | 28 |
| 4195 | 4188 | 41207 | 80.2 | ACGGGATGATCGGAGTCGTTTGCG | 35 | 27 | 24 | 20 | 12 | 29 |
| 4196 | 4189 | 41208 | 76.8 | ACGGGATGCCTAAGTGCTTGTCCC | 35 | 27 | 26 | 22 | 11 | 28 |
| 4197 | 4190 | 12129 | 78.3 | ACGGGATGGGACCACGATACTCCC | 35 | 27 | 34 | 30 | 5 | 28 |
| 4198 | 4191 | 12131 | 80.1 | ACGGGATGAGCCGTGCACGGATAC | 35 | 27 | 36 | 33 | 35 | 5 |
| 4199 | 4192 | 16741 | 75.8 | ACGGTCCCTTGACGTTGCAAAAAG | 35 | 28 | 1 | 12 | 21 | 6 |
| 4200 | 4193 | 30952 | 79.2 | ACGGTCCCCTCAAATCACGGATCG | 35 | 28 | 13 | 4 | 35 | 24 |
| 4201 | 4194 | 41214 | 78.6 | ACGGTCCCCCATACCTGACCGGTA | 35 | 28 | 15 | 23 | 32 | 18 |
| 4202 | 4195 | 30953 | 78.1 | ACGGTCCCAGTGTGTCTGCGACCT | 35 | 28 | 22 | 9 | 29 | 23 |
| 4203 | 4196 | 12142 | 79.6 | ACGGTCCCATCGGCTTGTCTCAGC | 35 | 28 | 24 | 17 | 19 | 31 |
| 4204 | 4197 | 12143 | 77 | ACGGTCCCCCTATCGTGATGCTGT | 35 | 28 | 26 | 10 | 27 | 14 |
| 4205 | 4198 | 12144 | 76.4 | ACGGTCCCGATGTGATTTAGCACG | 35 | 28 | 27 | 2 | 3 | 30 |
| 4206 | 4199 | 30954 | 78.4 | ACGGTGCGTTGAATACAGCCGACC | 35 | 29 | 1 | 5 | 36 | 32 |
| 4207 | 4200 | 16745 | 75.4 | ACGGTGCGTGATAGGATCTGGCTT | 35 | 29 | 2 | 25 | 8 | 17 |
| 4208 | 4201 | 16746 | 79 | ACGGTGCGTTAGGGACGACCACCT | 35 | 29 | 3 | 34 | 32 | 23 |
| 4209 | 4202 | 41217 | 76.9 | ACGGTGCGATACAATCATCGCGTT | 35 | 29 | 5 | 4 | 24 | 12 |
| 4210 | 4203 | 41218 | 76.8 | ACGGTGCGTACACGTTGGACCCTA | 35 | 29 | 7 | 12 | 34 | 26 |
| 4211 | 4204 | 12150 | 80.5 | ACGGTGCGCTTGCCTAAGGACACG | 35 | 29 | 11 | 26 | 25 | 30 |
| 4212 | 4205 | 12152 | 78.7 | ACGGTGCGCCATATACGACCAGGA | 35 | 29 | 15 | 5 | 32 | 25 |
| 4213 | 4206 | 30955 | 81.7 | ACGGTGCGAGTGCTGTCAGCCAGC | 35 | 29 | 22 | 14 | 31 | 31 |
| 4214 | 4207 | 12153 | 78.9 | ACGGTGCGAGGACTCAGATGCAGC | 35 | 29 | 25 | 13 | 27 | 31 |
| 4215 | 4208 | 12154 | 83.4 | ACGGTGCGTGCGCACGAATCCTGT | 35 | 29 | 29 | 30 | 4 | 14 |
| 4216 | 4209 | 12155 | 83.4 | ACGGTGCGCACGGTGCCTGTCCTA | 35 | 29 | 30 | 33 | 14 | 26 |
| 4217 | 4210 | 30957 | 82.7 | ACGGTGCGCAGCACCTCCATGCTT | 35 | 29 | 31 | 23 | 15 | 17 |
| 4218 | 4211 | 12156 | 82.7 | ACGGTGCGGTGCGAGTGCTTCGTT | 35 | 29 | 33 | 20 | 17 | 12 |
| 4219 | 4212 | 12157 | 82.2 | ACGGTGCGGGACCAGCACCTCTTG | 35 | 29 | 34 | 31 | 23 | 11 |
| 4220 | 4213 | 12158 | 81.2 | ACGGTGCGAGCCCTTGGAGTGCTT | 35 | 29 | 36 | 11 | 20 | 17 |
| 4221 | 4214 | 12159 | 77.6 | ACGGCACGTTGAGGACTGATTCCC | 35 | 30 | 1 | 34 | 2 | 28 |
| 4222 | 4215 | 41220 | 76.7 | ACGGCACGTGATACGGTGATCGTT | 35 | 30 | 2 | 35 | 2 | 12 |
| 4223 | 4216 | 41221 | 77.2 | ACGGCACGTTAGAGTGATCGCGAA | 35 | 30 | 3 | 22 | 24 | 16 |
| 4224 | 4217 | 41222 | 80.5 | ACGGCACGAATCCAGCTCTGACGG | 35 | 30 | 4 | 31 | 8 | 35 |
| 4225 | 4218 | 30958 | 77.7 | ACGGCACGTACATGATTGCGCCTA | 35 | 30 | 7 | 2 | 29 | 26 |
| 4226 | 4219 | 12162 | 79.5 | ACGGCACGTCTGCTCAATCGATCG | 35 | 30 | 8 | 13 | 24 | 24 |
| 4227 | 4220 | 12164 | 79.5 | ACGGCACGTCGTGCTTCGAATCTG | 35 | 30 | 10 | 17 | 16 | 8 |
| 4228 | 4221 | 30959 | 80.6 | ACGGCACGGAGTCTCACAGCGGAC | 35 | 30 | 20 | 13 | 31 | 34 |
| 4229 | 4222 | 12168 | 78.2 | ACGGCACGACCTCGAATCTGAGGA | 35 | 30 | 23 | 16 | 8 | 25 |
| 4230 | 4223 | 16748 | 81.6 | ACGGCACGCAGCTGATGGACGGTA | 35 | 30 | 31 | 2 | 34 | 18 |
| 4231 | 4224 | 12172 | 81.9 | ACGGCACGGGACGGACGGTATCTG | 35 | 30 | 34 | 34 | 18 | 8 |
| 4232 | 4225 | 12173 | 81.7 | ACGGCACGACGGTCGTGAGTCGAA | 35 | 30 | 35 | 10 | 20 | 16 |
| 4233 | 4226 | 16749 | 75 | ACGGCAGCTTAGAAAGCCATTCGT | 35 | 31 | 3 | 6 | 15 | 10 |

FIG. 25FFFF

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 4234 | 4227 | 16750 | 78.5 | ACGGCAGCTGTCCGAAATACCACG | 35 | 31 | 9 | 16 | 5 | 30 |
| 4235 | 4228 | 12179 | 79.5 | ACGGCAGCCTTGCTCAGATGGCTT | 35 | 31 | 11 | 13 | 27 | 17 |
| 4236 | 4229 | 22350 | 80.1 | ACGGCAGCCTGTTTAGACGGCGAA | 35 | 31 | 14 | 3 | 35 | 16 |
| 4237 | 4230 | 12181 | 78.3 | ACGGCAGCCCATAATCCACGTCTG | 35 | 31 | 15 | 4 | 30 | 8 |
| 4238 | 4231 | 12182 | 81.3 | ACGGCAGCCGAACTGTTCGTGTGC | 35 | 31 | 16 | 14 | 10 | 33 |
| 4239 | 4232 | 12183 | 81.6 | ACGGCAGCGCTTGAGTGAGTTGCG | 35 | 31 | 17 | 20 | 20 | 29 |
| 4240 | 4233 | 22351 | 79 | ACGGCAGCGGTACACGTTAGCGAA | 35 | 31 | 18 | 30 | 3 | 16 |
| 4241 | 4234 | 12188 | 77.7 | ACGGCAGCAGGAGTCTACGGCTGT | 35 | 31 | 25 | 19 | 35 | 14 |
| 4242 | 4235 | 12190 | 80.9 | ACGGCAGCCACGAGGAGCAATTGA | 35 | 31 | 30 | 25 | 21 | 1 |
| 4243 | 4236 | 12191 | 82.5 | ACGGCAGCCAGCCTGTCGAACAGC | 35 | 31 | 31 | 14 | 16 | 31 |
| 4244 | 4237 | 12193 | 81.2 | ACGGCAGCGTGCCCTATCCCAATC | 35 | 31 | 33 | 26 | 28 | 4 |
| 4245 | 4238 | 12194 | 82.1 | ACGGCAGCACGGTCGTGACCAGTG | 35 | 31 | 35 | 10 | 32 | 22 |
| 4246 | 4239 | 12195 | 75.7 | ACGGGACCTTGATTGACGTTCAGC | 35 | 32 | 1 | 1 | 12 | 31 |
| 4247 | 4240 | 16752 | 78.1 | ACGGGACCAATCACCTGACCATCG | 35 | 32 | 4 | 23 | 32 | 24 |
| 4248 | 4241 | 16753 | 76.6 | ACGGGACCAAAGAATCGATGGACC | 35 | 32 | 6 | 4 | 27 | 32 |
| 4249 | 4242 | 12199 | 76.2 | ACGGGACCTACACAGCGCAACTGT | 35 | 32 | 7 | 31 | 21 | 14 |
| 4250 | 4243 | 12201 | 78.7 | ACGGGACCCGTTGTCTTCGTAGCC | 35 | 32 | 12 | 19 | 10 | 36 |
| 4251 | 4244 | 30960 | 79.1 | ACGGGACCCTCAGTGCGATGACCT | 35 | 32 | 13 | 33 | 27 | 23 |
| 4252 | 4245 | 30961 | 78.8 | ACGGGACCCCATACCTCGAACGAA | 35 | 32 | 15 | 23 | 16 | 16 |
| 4253 | 4246 | 12202 | 79.1 | ACGGGACCCGAACTCATGTCGCTT | 35 | 32 | 16 | 13 | 9 | 17 |
| 4254 | 4247 | 16754 | 76.6 | ACGGGACCGCTTAATCCCTAGCAA | 35 | 32 | 17 | 4 | 26 | 21 |
| 4255 | 4248 | 12206 | 76.5 | ACGGGACCATCGTCCCACCTAATC | 35 | 32 | 24 | 28 | 23 | 4 |
| 4256 | 4249 | 12208 | 80.3 | ACGGGACCGATGGATGCAGCTGTC | 35 | 32 | 27 | 27 | 31 | 9 |
| 4257 | 4250 | 12209 | 78.7 | ACGGGACCTCCCATCGGGTATTGA | 35 | 32 | 28 | 24 | 18 | 1 |
| 4258 | 4251 | 16755 | 80.3 | ACGGGACCCAGCCGAACCTAATCG | 35 | 32 | 31 | 16 | 26 | 24 |
| 4259 | 4252 | 12212 | 81.3 | ACGGGACCGTGCGGACTTAGGTGC | 35 | 32 | 33 | 34 | 3 | 33 |
| 4260 | 4253 | 41229 | 77.2 | ACGGGTGCTTGAGTCTAGCCCAGC | 35 | 33 | 1 | 19 | 36 | 31 |
| 4261 | 4254 | 30963 | 77.7 | ACGGGTGCTGATTTGAATCGAGCC | 35 | 33 | 2 | 1 | 24 | 36 |
| 4262 | 4255 | 30964 | 76.2 | ACGGGTGCTTAGTCTGGCTTTCCC | 35 | 33 | 3 | 8 | 17 | 28 |
| 4263 | 4256 | 41230 | 79.7 | ACGGGTGCAATCGCTTCTTGAGCC | 35 | 33 | 4 | 17 | 11 | 36 |
| 4264 | 4257 | 41231 | 77.7 | ACGGGTGCATACACCTGACCCGTT | 35 | 33 | 5 | 23 | 32 | 12 |
| 4265 | 4258 | 16757 | 80.7 | ACGGGTGCTGTCGGACTCTGCAGC | 35 | 33 | 9 | 34 | 8 | 31 |
| 4266 | 4259 | 12216 | 79.2 | ACGGGTGCCTCACTGTTGTCACGG | 35 | 33 | 13 | 14 | 9 | 35 |
| 4267 | 4260 | 12217 | 77.8 | ACGGGTGCCGAAGACCCCTAAATC | 35 | 33 | 16 | 32 | 26 | 4 |
| 4268 | 4261 | 12218 | 79.7 | ACGGGTGCGCTTGCTTTTGAGGAC | 35 | 33 | 17 | 17 | 1 | 34 |
| 4269 | 4262 | 30965 | 78.4 | ACGGGTGCGTCTCCTAACGGACCT | 35 | 33 | 19 | 26 | 35 | 23 |
| 4270 | 4263 | 12220 | 80.7 | ACGGGTGCGCAACAGCTGATCCAT | 35 | 33 | 21 | 31 | 2 | 15 |
| 4271 | 4264 | 12221 | 79.4 | ACGGGTGCAGTGGACCACGGTACA | 35 | 33 | 22 | 32 | 35 | 7 |
| 4272 | 4265 | 22367 | 77.4 | ACGGGTGCACCTGCAACTCATCTG | 35 | 33 | 23 | 21 | 13 | 8 |
| 4273 | 4266 | 12223 | 80.3 | ACGGGTGCTGCGAGGAATACCACG | 35 | 33 | 29 | 25 | 5 | 30 |
| 4274 | 4267 | 12224 | 80.5 | ACGGGTGCGACCATCGGGTACTCA | 35 | 33 | 32 | 24 | 18 | 13 |
| 4275 | 4268 | 12225 | 81.7 | ACGGGTGCGGACCACGGGTATGTC | 35 | 33 | 34 | 30 | 18 | 9 |
| 4276 | 4269 | 12226 | 75.8 | ACGGGGACTTGAAAAGTTGATGCG | 35 | 34 | 1 | 6 | 1 | 29 |
| 4277 | 4270 | 41232 | 77.3 | ACGGGGACTTAGTGCGGCAACCTA | 35 | 34 | 3 | 29 | 21 | 26 |
| 4278 | 4271 | 30966 | 78.9 | ACGGGGACTACAACGGGGACCTCA | 35 | 34 | 7 | 35 | 34 | 13 |
| 4279 | 4272 | 30967 | 78.9 | ACGGGGACCTTGACGGTTGATCGT | 35 | 34 | 11 | 35 | 1 | 10 |
| 4280 | 4273 | 41234 | 78.3 | ACGGGGACCGTTATCGCGAAGAGT | 35 | 34 | 12 | 24 | 16 | 20 |
| 4281 | 4274 | 30968 | 77.5 | ACGGGGACGGTAAGGAAATCGCTT | 35 | 34 | 18 | 25 | 4 | 17 |
| 4282 | 4275 | 12237 | 79.8 | ACGGGGACGCAAAGTGCCATAGGA | 35 | 34 | 21 | 22 | 15 | 25 |
| 4283 | 4276 | 22374 | 77.5 | ACGGGGACACCTGAGTTCCCAGTG | 35 | 34 | 23 | 20 | 28 | 22 |
| 4284 | 4277 | 12238 | 77.2 | ACGGGGACATCGTCCCATCGATAC | 35 | 34 | 24 | 28 | 24 | 5 |

FIG. 25GGGG

```
SEQ    4,633  HEX              ZIPCODE (5'-3')          TETRAMER NUMBERS
ID NO: ID#    ID#    Tm
4285   4278   12239  81.2  ACGGGGACTCCCGATGCTCAATCG   35  34  28  27  13  24
4286   4279   12240  82.3  ACGGGGACTGCGCTGTGCTTGGAC   35  34  29  14  17  34
4287   4280   12241  80.8  ACGGGGACGTGCGCAACCTAACCT   35  34  33  21  26  23
4288   4281   12243  76.1  ACGGACGGTTGAGGTACACGAGGA   35  35   1  18  30  25
4289   4282   41238  77    ACGGACGGTACACGAACAGCCTCA   35  35   7  16  31  13
4290   4283   41239  78.5  ACGGACGGTCTGAATCACCTTGCG   35  35   8   4  23  29
4291   4284   41241  79.1  ACGGACGGTCGTGGTAGACCGCTT   35  35  10  18  32  17
4292   4285   30970  79.2  ACGGACGGCTCAGTCTTCCCGGTA   35  35  13  19  28  18
4293   4286   30971  77.7  ACGGACGGGAGTTCGTAATCTGCG   35  35  20  10   4  29
4294   4287   12249  80    ACGGACGGGCAATCGTCAGCTGAT   35  35  21  10  31   2
4295   4288   12251  77.3  ACGGACGGACCTGGTAGTGCTCGT   35  35  23  18  33  10
4296   4289   12253  76.6  ACGGACGGGATGTCCCAAAGAATC   35  35  27  28   6   4
4297   4290   12254  78.7  ACGGACGGTCCCTCTGGGTACAGC   35  35  28   8  18  31
4298   4291   12256  80.1  ACGGACGGCAGCTTGACGAATCGT   35  35  31   1  16  10
4299   4292   12258  82.9  ACGGACGGGTGCCTGTCGAACACG   35  35  33  14  16  30
4300   4293   12259  80.8  ACGGACGGAGCCGCTTGTCTAGCC   35  35  36  17  19  36
4301   4294   16761  76.7  ACGGAGCCTTAGCTTGGACCGGTA   35  36   3  11  32  18
4302   4295   12262  78.1  ACGGAGCCAATCGTCTATCGGCAA   35  36   4  19  24  21
4303   4296   22383  77.5  ACGGAGCCTGTCCGAAGCAACTGT   35  36   9  16  21  14
4304   4297   12265  76.7  ACGGAGCCTCGTGGTATGATTCCC   35  36  10  18   2  28
4305   4298   12268  76.7  ACGGAGCCCTGTTCCCAATCAATC   35  36  14  28   4   4
4306   4299   41247  79.7  ACGGAGCCCGAAGATGGGTAAGCC   35  36  16  27  18  36
4307   4300   12270  79.6  ACGGAGCCAGTGGGACTGTCGGAC   35  36  22  34   9  34
4308   4301   41251  77.1  ACGGAGCCCCTATACATCCCCCAT   35  36  26   7  28  15
4309   4302   12274  77.6  ACGGAGCCGATGAATCAGGAATCG   35  36  27   4  25  24
4310   4303   12275  80.7  ACGGAGCCTCCCGCAAGGTAGTGC   35  36  28  21  18  33
4311   4304   12277  82.1  ACGGAGCCCAGCGATGTTGAACGG   35  36  31  27   1  35
4312   4305   12278  81.1  ACGGAGCCGACCCCTATGTCCACG   35  36  32  26   9  30
4313   4306   12279  83.1  ACGGAGCCGGACGATGCTGTCACG   35  36  34  27  14  30
4314   4307   12280  79.8  ACGGAGCCACGGTTGACGTTCCAT   35  36  35   1  12  15
4315   4308   22393  76.3  AGCCTTGAAAAGTGCGCGAAAGTG   36   1   6  29  16  22
4316   4309   41252  78    AGCCTTGATCGTGCTTGCAAAGCC   36   1  10  17  21  36
4317   4310   30972  77.9  AGCCTTGACGTTCTCAAGCCCACG   36   1  12  13  36  30
4318   4311   41253  79.8  AGCCTTGAGCTTGTGCACGGGACC   36   1  17  33  35  32
4319   4312   30973  77.3  AGCCTTGAGCAATGTCGATGCGAA   36   1  21   9  27  16
4320   4313   41254  76.6  AGCCTTGAAGGAACCTGGACCGAA   36   1  25  23  34  16
4321   4314   12288  80.2  AGCCTTGAGATGTGCGACGGCGTT   36   1  27  29  35  12
4322   4315   12293  78.8  AGCCTTGAGGACGCAACTTGTGCG   36   1  34  21  11  29
4323   4316   30974  76.9  AGCCTGATGCTTACGGTGTCTGCG   36   2  17  35   9  29
4324   4318   12308  75.4  AGCCTTAGGCTTCAGCGATGGATG   36   3  17  31  27  27
4325   4319   12315  75.2  AGCCTTAGCAGCATCGCTTGGAGT   36   3  31  24  11  20
4326   4320   30976  78.2  AGCCAATCCGTTTGTCGTGCGAGT   36   4  12   9  33  20
4327   4321   41261  77.8  AGCCAATCGCAAGAGTACGGGTGC   36   4  21  20  35  33
4328   4322   12327  79.5  AGCCAATCAGTGAGCCACGGTCCC   36   4  22  36  35  28
4329   4323   30977  75.3  AGCCAATCAGGATGCGGCTTTTAG   36   4  25  29  17   3
4330   4324   30978  76.7  AGCCAATCCCTATGTCTCCCCACG   36   4  26   9  28  30
4331   4325   12329  75.5  AGCCAATCGATGAAAGTGCGGTCT   36   4  27   6  29  19
4332   4326   22403  75.6  AGCCAATCGGACTACACACGTCCC   36   4  34   7  30  28
4333   4327   12332  78.2  AGCCAATCAGCCCTGTACGGCTCA   36   4  36  14  35  13
4334   4328   41263  75.7  AGCCATACCGTTACGGTGTCCAGC   36   5  12  35   9  31
4335   4329   16784  75    AGCCATACGCTTCTCAATCGGCTT   36   5  17  13  24  17
```

FIG. 25HHHH

| SEQ ID NO: | 4,633 ID# | HEX ID# | Tm | ZIPCODE (5'-3') | TETRAMER NUMBERS | | | | |
|---|---|---|---|---|---|---|---|---|---|
| 4336 | 4330 | 12342 | 76.5 | AGCCATACACCTGGACCCATTCCC | 36 | 5 | 23 | 34 | 15 | 28 |
| 4337 | 4331 | 12343 | 78.3 | AGCCATACAGGATCCCGTGCGATG | 36 | 5 | 25 | 28 | 33 | 27 |
| 4338 | 4332 | 12346 | 79.1 | AGCCATACCAGCGACCGGACACCT | 36 | 5 | 31 | 32 | 34 | 23 |
| 4339 | 4333 | 30979 | 79 | AGCCATACGTGCCTCATGCGCCTA | 36 | 5 | 33 | 13 | 29 | 26 |
| 4340 | 4334 | 12351 | 77.9 | AGCCAAAGTGATTCCCGACCTCCC | 36 | 6 | 2 | 28 | 32 | 28 |
| 4341 | 4335 | 22406 | 78.2 | AGCCAAAGTCTGGCAAGCTTTGCG | 36 | 6 | 8 | 21 | 17 | 29 |
| 4342 | 4336 | 16789 | 77.2 | AGCCAAAGGCAAGGACAGTGAGCC | 36 | 6 | 21 | 34 | 22 | 36 |
| 4343 | 4337 | 12357 | 81.3 | AGCCAAAGAGTGGTGCGTGCACGG | 36 | 6 | 22 | 33 | 33 | 35 |
| 4344 | 4338 | 12358 | 75.2 | AGCCAAAGAGGACTCACGAAACGG | 36 | 6 | 25 | 13 | 16 | 35 |
| 4345 | 4339 | 41267 | 75 | AGCCAAAGCCTATGATTCCCATCG | 36 | 6 | 26 | 2 | 28 | 24 |
| 4346 | 4340 | 30980 | 77.1 | AGCCAAAGGACCTTGACACGAGCC | 36 | 6 | 32 | 1 | 30 | 36 |
| 4347 | 4341 | 41271 | 76.3 | AGCCTACATGCGATACTGCGCCAT | 36 | 7 | 29 | 5 | 29 | 15 |
| 4348 | 4342 | 30981 | 77.8 | AGCCTCTGCTTGTTGACACGCACG | 36 | 8 | 11 | 1 | 30 | 30 |
| 4349 | 4343 | 41272 | 78.9 | AGCCTCTGCTCAGACCGGACGCTT | 36 | 8 | 13 | 32 | 34 | 17 |
| 4350 | 4344 | 12372 | 75.5 | AGCCTCTGCTGTATCGCGAAGGAC | 36 | 8 | 14 | 24 | 16 | 34 |
| 4351 | 4345 | 12374 | 77.5 | AGCCTCTGGAGTCACGCGAACCAT | 36 | 8 | 20 | 30 | 16 | 15 |
| 4352 | 4346 | 12378 | 75.5 | AGCCTCTGGATGAAAGGATGGCAA | 36 | 8 | 27 | 6 | 27 | 21 |
| 4353 | 4347 | 30982 | 77.1 | AGCCTCTGGGACATCGAGCCAAAG | 36 | 8 | 34 | 24 | 36 | 6 |
| 4354 | 4349 | 12392 | 77.8 | AGCCTGTCTGCGCGAATACATCCC | 36 | 9 | 29 | 16 | 7 | 28 |
| 4355 | 4350 | 16797 | 77.8 | AGCCTGTCCAGCAAAGCAGCACCT | 36 | 9 | 31 | 6 | 31 | 23 |
| 4356 | 4351 | 30983 | 75.4 | AGCCTCGTTTGATGTCGCTTAGCC | 36 | 10 | 1 | 9 | 17 | 36 |
| 4357 | 4353 | 12398 | 75.9 | AGCCTCGTTGTCTACATGCGGACC | 36 | 10 | 9 | 7 | 29 | 32 |
| 4358 | 4354 | 12403 | 78 | AGCCTCGTGAGTGGACAGCCCTTG | 36 | 10 | 20 | 34 | 36 | 11 |
| 4359 | 4355 | 30984 | 76.6 | AGCCTCGTGCAACGAAGCAAGGTA | 36 | 10 | 21 | 16 | 21 | 18 |
| 4360 | 4356 | 30985 | 76.2 | AGCCTCGTACCTCGAAAGCCGAGT | 36 | 10 | 23 | 16 | 36 | 20 |
| 4361 | 4357 | 16802 | 80.3 | AGCCTCGTTCCCGACCCTTGAGGA | 36 | 10 | 28 | 32 | 11 | 25 |
| 4362 | 4358 | 12406 | 77.1 | AGCCTCGTTGCGATACTCGTTCCC | 36 | 10 | 29 | 5 | 10 | 28 |
| 4363 | 4359 | 12410 | 75.2 | AGCCCTTGTTGAGCTTGCAAGCTT | 36 | 11 | 1 | 17 | 21 | 17 |
| 4364 | 4360 | 41284 | 76.4 | AGCCCTTGCTCAAGGATTGAAGCC | 36 | 11 | 13 | 25 | 1 | 36 |
| 4365 | 4361 | 30986 | 75 | AGCCCTTGCTGTACCTACGGCCTA | 36 | 11 | 14 | 23 | 35 | 26 |
| 4366 | 4362 | 41286 | 76.2 | AGCCCTTGGTCTATCGCTTGGGAC | 36 | 11 | 19 | 24 | 11 | 34 |
| 4367 | 4363 | 30987 | 78.5 | AGCCCTTGGCAAAGCCTGTCCCTA | 36 | 11 | 21 | 36 | 9 | 26 |
| 4368 | 4364 | 41287 | 78.3 | AGCCCTTGAGTGATCGCGTTCGAA | 36 | 11 | 22 | 24 | 12 | 16 |
| 4369 | 4365 | 30989 | 75.2 | AGCCCTTGCCTAGTCTAGCCCCAT | 36 | 11 | 26 | 19 | 36 | 15 |
| 4370 | 4366 | 30990 | 80.5 | AGCCCTTGGACCGAGTTCCCGATG | 36 | 11 | 32 | 20 | 28 | 27 |
| 4371 | 4367 | 12422 | 76.6 | AGCCCTTGGGACTGTCCTTGCTGT | 36 | 11 | 34 | 9 | 11 | 14 |
| 4372 | 4368 | 30991 | 78.2 | AGCCCTTGAGCCAAAGGATGAGCC | 36 | 11 | 36 | 6 | 27 | 36 |
| 4373 | 4369 | 30992 | 77.6 | AGCCCGTTAATCGTGCGGGTAATCG | 36 | 12 | 4 | 33 | 18 | 24 |
| 4374 | 4370 | 41290 | 75.7 | AGCCCGTTTACAAATCCGTTCACG | 36 | 12 | 7 | 4 | 12 | 30 |
| 4375 | 4371 | 30994 | 75.6 | AGCCCGTTGGTACGAATACAACGG | 36 | 12 | 18 | 16 | 7 | 35 |
| 4376 | 4372 | 30995 | 75 | AGCCCGTTGAGTAAAGCGTTCGTT | 36 | 12 | 20 | 6 | 12 | 12 |
| 4377 | 4373 | 41293 | 76.4 | AGCCCGTTAGTGAAAGACGGAGCC | 36 | 12 | 22 | 6 | 35 | 36 |
| 4378 | 4374 | 12439 | 76.1 | AGCCCGTTATCGTGATTGCGTGAT | 36 | 12 | 24 | 2 | 29 | 2 |
| 4379 | 4375 | 12441 | 81.8 | AGCCCGTTTCCCGATGCCATGATG | 36 | 12 | 28 | 27 | 15 | 27 |
| 4380 | 4376 | 12442 | 83.1 | AGCCCGTTTGCGCGTTCTCACACG | 36 | 12 | 29 | 12 | 13 | 30 |
| 4381 | 4377 | 12444 | 77.3 | AGCCCGTTGACCATACTGCGACCT | 36 | 12 | 32 | 5 | 29 | 23 |
| 4382 | 4378 | 12445 | 77.6 | AGCCCGTTGTGCTACAATCGGACC | 36 | 12 | 33 | 7 | 24 | 32 |
| 4383 | 4379 | 41295 | 77.5 | AGCCCTCATTGATGTCTGCGGCTT | 36 | 13 | 1 | 9 | 29 | 17 |
| 4384 | 4380 | 12447 | 76.9 | AGCCCTCATGATCCATTGCGTTGA | 36 | 13 | 2 | 15 | 29 | 1 |
| 4385 | 4381 | 30996 | 78.9 | AGCCCTCAAAAGGCAAGCAAACGG | 36 | 13 | 6 | 21 | 21 | 35 |
| 4386 | 4382 | 41296 | 79.1 | AGCCCTCACTTGGAGTTGCGAGCC | 36 | 13 | 11 | 20 | 29 | 36 |

FIG. 25IIII

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 4387 | 4383 | 12453 | 77.4 | AGCCCTCACCATGGACGCTTCTGT | 36 | 13 | 15 | 34 | 17 | 14 |
| 4388 | 4384 | 30997 | 76.1 | AGCCCTGTTGATATCGGACCCCAT | 36 | 14 | 2 | 24 | 32 | 15 |
| 4389 | 4385 | 12467 | 77.3 | AGCCCTGTTGTCATACGTGCACGG | 36 | 14 | 9 | 5 | 33 | 35 |
| 4390 | 4386 | 30998 | 79 | AGCCCTGTCCATGCAAGTGCCTCA | 36 | 14 | 15 | 21 | 33 | 13 |
| 4391 | 4387 | 41303 | 78.2 | AGCCCTGTGCTTTCGTCACGGGTA | 36 | 14 | 17 | 10 | 30 | 18 |
| 4392 | 4388 | 41304 | 77.8 | AGCCCTGTGGTAGCAAAGCCGATG | 36 | 14 | 18 | 21 | 36 | 27 |
| 4393 | 4389 | 16828 | 77.6 | AGCCCTGTACCTCAGCGCAACGTT | 36 | 14 | 23 | 31 | 21 | 12 |
| 4394 | 4390 | 12474 | 75.9 | AGCCCTGTATCGCCTAACGGGAGT | 36 | 14 | 24 | 26 | 35 | 20 |
| 4395 | 4391 | 41306 | 80 | AGCCCTGTCACGGTGCCGTTCCTA | 36 | 14 | 30 | 33 | 12 | 26 |
| 4396 | 4392 | 31000 | 77.9 | AGCCCTGTAGCCCTTGGGTAACGG | 36 | 14 | 36 | 11 | 18 | 35 |
| 4397 | 4393 | 41308 | 75.8 | AGCCCCATTTGATTAGCGTTCACG | 36 | 15 | 1 | 3 | 12 | 30 |
| 4398 | 4394 | 41310 | 78.4 | AGCCCCATAATCCGAAGTGCGCTT | 36 | 15 | 4 | 16 | 33 | 17 |
| 4399 | 4395 | 31001 | 75.6 | AGCCCCATAAAGTCCCGATGACCT | 36 | 15 | 6 | 28 | 27 | 23 |
| 4400 | 4396 | 16834 | 76.2 | AGCCCCATTACATCGTGACCGATG | 36 | 15 | 7 | 10 | 32 | 27 |
| 4401 | 4397 | 16835 | 78.3 | AGCCCCATTGTCGTCTACGGGCTT | 36 | 15 | 9 | 19 | 35 | 17 |
| 4402 | 4398 | 12485 | 78.6 | AGCCCCATTCGTCTCAGATGCACG | 36 | 15 | 10 | 13 | 27 | 30 |
| 4403 | 4399 | 12486 | 76.3 | AGCCCCATCTCAGATGGGACCTGT | 36 | 15 | 13 | 27 | 34 | 14 |
| 4404 | 4400 | 16836 | 77.6 | AGCCCCATCGAACACGGTCTATCG | 36 | 15 | 16 | 30 | 19 | 24 |
| 4405 | 4401 | 31002 | 79.4 | AGCCCCATCAGCCCATAAAGCACG | 36 | 15 | 31 | 15 | 6 | 30 |
| 4406 | 4402 | 31004 | 79.1 | AGCCCCATACGGCCTACGAAGCAA | 36 | 15 | 35 | 26 | 16 | 21 |
| 4407 | 4403 | 41314 | 77.1 | AGCCCGAATTGAACCTCGTTCAGC | 36 | 16 | 1 | 23 | 12 | 31 |
| 4408 | 4404 | 12497 | 76 | AGCCCGAAATACCGAACTTGGGAC | 36 | 16 | 5 | 16 | 11 | 34 |
| 4409 | 4405 | 16840 | 75.4 | AGCCCGAAAAAGATACGTCTTGCG | 36 | 16 | 6 | 5 | 19 | 29 |
| 4410 | 4406 | 41315 | 76.8 | AGCCCGAATACACTTGGGACCAGC | 36 | 16 | 7 | 11 | 34 | 31 |
| 4411 | 4407 | 12501 | 78.4 | AGCCCGAATCGTGTGCATCGAATC | 36 | 16 | 10 | 33 | 24 | 4 |
| 4412 | 4408 | 31005 | 78.3 | AGCCCGAACTTGGGTATGCGGTCT | 36 | 16 | 11 | 18 | 29 | 19 |
| 4413 | 4409 | 31006 | 78 | AGCCCGAACTCAGTCTACGGCACG | 36 | 16 | 13 | 19 | 35 | 30 |
| 4414 | 4410 | 12503 | 78.1 | AGCCCGAACGAACTGTTCTGCAGC | 36 | 16 | 16 | 14 | 8 | 31 |
| 4415 | 4411 | 41317 | 77.1 | AGCCCGAAGCTTACGGAGTGGATG | 36 | 16 | 17 | 35 | 22 | 27 |
| 4416 | 4412 | 31007 | 77.9 | AGCCCGAAGAGTGTCTGCAAACGG | 36 | 16 | 20 | 19 | 21 | 35 |
| 4417 | 4413 | 12509 | 79.3 | AGCCCGAAATCGCTGTAGCCCTCA | 36 | 16 | 24 | 14 | 36 | 13 |
| 4418 | 4414 | 31008 | 78.8 | AGCCCGAAAGGATCTGACGGATCG | 36 | 16 | 25 | 8 | 35 | 24 |
| 4419 | 4415 | 16843 | 80.9 | AGCCCGAATGCGCGTTACCTTCGT | 36 | 16 | 29 | 12 | 23 | 10 |
| 4420 | 4416 | 12513 | 78 | AGCCCGAACACGTCCCAAAGTTGA | 36 | 16 | 30 | 28 | 6 | 1 |
| 4421 | 4417 | 12515 | 79 | AGCCCGAAGGACGGTATGTCCGAA | 36 | 16 | 34 | 18 | 9 | 16 |
| 4422 | 4418 | 12516 | 81.5 | AGCCCGAAACGGGGACTCTGGGAC | 36 | 16 | 35 | 34 | 8 | 34 |
| 4423 | 4419 | 41319 | 75.3 | AGCCGCTTTGATAGGAAGTGACGG | 36 | 17 | 2 | 25 | 22 | 35 |
| 4424 | 4420 | 31009 | 76.4 | AGCCGCTTTTAGGGTACGAAACGG | 36 | 17 | 3 | 18 | 16 | 35 |
| 4425 | 4421 | 16846 | 75 | AGCCGCTTATACTGTCAGCCCGTT | 36 | 17 | 5 | 9 | 36 | 12 |
| 4426 | 4422 | 12523 | 77.6 | AGCCGCTTTGTCGCTTGGTACGTT | 36 | 17 | 9 | 17 | 18 | 12 |
| 4427 | 4423 | 31010 | 77.3 | AGCCGCTTCTTGTGATGCAACGAA | 36 | 17 | 11 | 2 | 21 | 16 |
| 4428 | 4424 | 31011 | 78.7 | AGCCGCTTCTGTTCGTGATGACGG | 36 | 17 | 14 | 10 | 27 | 35 |
| 4429 | 4425 | 31012 | 78.8 | AGCCGCTTCCATTTGAGACCGACC | 36 | 17 | 15 | 1 | 32 | 32 |
| 4430 | 4426 | 31013 | 78 | AGCCGCTTGGTAGGACGTCTGTGC | 36 | 17 | 18 | 34 | 19 | 33 |
| 4431 | 4427 | 12533 | 82.8 | AGCCGCTTTGCGCTCAACGGTTGA | 36 | 17 | 29 | 13 | 35 | 1 |
| 4432 | 4428 | 12534 | 79.8 | AGCCGCTTCAGCGAGTACGGGATG | 36 | 17 | 31 | 20 | 35 | 27 |
| 4433 | 4429 | 12536 | 80.3 | AGCCGCTTGTGCCACGTCCCATAC | 36 | 17 | 33 | 30 | 28 | 5 |
| 4434 | 4430 | 41324 | 76.4 | AGCCGGTATTGATCCCCTCAAGGA | 36 | 18 | 1 | 28 | 13 | 25 |
| 4435 | 4431 | 31014 | 77.2 | AGCCGGTAAATCACCTGTGCCGTT | 36 | 18 | 4 | 23 | 33 | 12 |
| 4436 | 4432 | 41325 | 76.8 | AGCCGGTAAAGGTCTTGCGCTGT | 36 | 18 | 6 | 19 | 29 | 14 |
| 4437 | 4433 | 16852 | 76.6 | AGCCGGTATCTGCCATCTTGGCTT | 36 | 18 | 8 | 15 | 11 | 17 |

FIG. 25JJJJ

| SEQ ID NO: | 4,633 ID# | HEX ID# | Tm | ZIPCODE (5'-3') | TETRAMER NUMBERS | | | | |
|---|---|---|---|---|---|---|---|---|---|
| 4438 | 4434 | 12542 | 76.2 | AGCCGGTATCGTTTGACGTTCGAA | 36 | 18 | 10 | 1 | 12 | 16 |
| 4439 | 4435 | 22438 | 81.7 | AGCCGGTACTGTTCCCAGCCGCAA | 36 | 18 | 14 | 28 | 36 | 21 |
| 4440 | 4436 | 22439 | 75 | AGCCGGTAGGTACCATAGGATGCG | 36 | 18 | 18 | 15 | 25 | 29 |
| 4441 | 4437 | 31015 | 77.1 | AGCCGGTAGAGTCAGCATCGGGAC | 36 | 18 | 20 | 31 | 24 | 34 |
| 4442 | 4438 | 16861 | 78.5 | AGCCGGTATCCCCTTGTCGTACGG | 36 | 18 | 28 | 11 | 10 | 35 |
| 4443 | 4439 | 12559 | 79.4 | AGCCGTCTAATCGGACCCATTGCG | 36 | 19 | 4 | 34 | 15 | 29 |
| 4444 | 4440 | 12561 | 75.5 | AGCCGTCTTACAATCGATCGCCAT | 36 | 19 | 7 | 24 | 24 | 15 |
| 4445 | 4441 | 16866 | 75 | AGCCGTCTACCTTCGTAGCCCTCA | 36 | 19 | 23 | 10 | 36 | 13 |
| 4446 | 4442 | 12572 | 76.4 | AGCCGTCTGATGTCGTGCTTTCGT | 36 | 19 | 27 | 10 | 17 | 10 |
| 4447 | 4443 | 12574 | 78.6 | AGCCGTCTCACGATCGTGTCGGAC | 36 | 19 | 30 | 24 | 9 | 34 |
| 4448 | 4444 | 31017 | 79.3 | AGCCGTCTCAGCACGGCTTGTTGA | 36 | 19 | 31 | 35 | 11 | 1 |
| 4449 | 4445 | 12576 | 79.7 | AGCCGTCTGACCGAGTGACCGGAC | 36 | 19 | 32 | 20 | 32 | 34 |
| 4450 | 4447 | 31018 | 77 | AGCCGTCTAGCCAATCGCTTGCTT | 36 | 19 | 36 | 4 | 17 | 17 |
| 4451 | 4449 | 41333 | 80.3 | AGCCGAGTTGTCCACGCCATGGAC | 36 | 20 | 9 | 30 | 15 | 34 |
| 4452 | 4450 | 12582 | 76.4 | AGCCGAGTTCGTGAGTAGCCTCCC | 36 | 20 | 10 | 20 | 36 | 28 |
| 4453 | 4451 | 12586 | 77.7 | AGCCGAGTGTCTTACATGCGCACG | 36 | 20 | 19 | 7 | 29 | 30 |
| 4454 | 4452 | 31019 | 79.2 | AGCCGAGTATCGCAGCCTGTGCAA | 36 | 20 | 24 | 31 | 14 | 21 |
| 4455 | 4453 | 31020 | 75.7 | AGCCGAGTCCTATTGATCCCCGTT | 36 | 20 | 26 | 1 | 28 | 12 |
| 4456 | 4454 | 41335 | 77.4 | AGCCGAGTGATGTCCCGAGTCGTT | 36 | 20 | 27 | 28 | 20 | 12 |
| 4457 | 4455 | 22446 | 76.7 | AGCCGAGTTGCGTTGACTGTGGAC | 36 | 20 | 29 | 1 | 14 | 34 |
| 4458 | 4456 | 16874 | 79.2 | AGCCGAGTAGCCCAGCCTCACAGC | 36 | 20 | 36 | 31 | 13 | 31 |
| 4459 | 4457 | 41337 | 78 | AGCCGCAATTGAAGGAGCAACAGC | 36 | 21 | 1 | 25 | 21 | 31 |
| 4460 | 4458 | 31021 | 76.7 | AGCCGCAATGATAGCCTGATCACG | 36 | 21 | 2 | 36 | 2 | 30 |
| 4461 | 4459 | 12596 | 76.1 | AGCCGCAATTAGCGAATGCGATAC | 36 | 21 | 3 | 16 | 29 | 5 |
| 4462 | 4460 | 31022 | 76.8 | AGCCGCAATACAAGTGTCCCTCCC | 36 | 21 | 7 | 22 | 28 | 28 |
| 4463 | 4461 | 41338 | 78.3 | AGCCGCAATCTGGGTAGGACCGTT | 36 | 21 | 8 | 18 | 34 | 12 |
| 4464 | 4462 | 41339 | 79.3 | AGCCGCAACGTTTGCGTGATATCG | 36 | 21 | 12 | 29 | 2 | 24 |
| 4465 | 4463 | 31023 | 77.4 | AGCCGCAACTCAAGGAAGCCTCTG | 36 | 21 | 13 | 25 | 36 | 8 |
| 4466 | 4464 | 12602 | 77.4 | AGCCGCAACGAAGGTAATCGTCGT | 36 | 21 | 16 | 18 | 24 | 10 |
| 4467 | 4465 | 12603 | 79.5 | AGCCGCAAGCTTGAGTCACGCTCA | 36 | 21 | 17 | 20 | 30 | 13 |
| 4468 | 4466 | 41340 | 78.8 | AGCCGCAAGCAATCCCCTTGAATC | 36 | 21 | 21 | 28 | 11 | 4 |
| 4469 | 4467 | 12608 | 79.3 | AGCCGCAAATCGGCAAACCTCTGT | 36 | 21 | 24 | 21 | 23 | 14 |
| 4470 | 4468 | 12609 | 77.7 | AGCCGCAAAGGAGCAACGTTGAGT | 36 | 21 | 25 | 21 | 12 | 20 |
| 4471 | 4469 | 12610 | 81.4 | AGCCGCAATCCCGGTAAGTGCAGC | 36 | 21 | 28 | 18 | 22 | 31 |
| 4472 | 4470 | 12611 | 81.7 | AGCCGCAATGCGATCGCTCATTGA | 36 | 21 | 29 | 24 | 13 | 1 |
| 4473 | 4471 | 31024 | 83.2 | AGCCGCAACACGCTGTGTGCTCCC | 36 | 21 | 30 | 14 | 33 | 28 |
| 4474 | 4472 | 41342 | 80.3 | AGCCGCAAGTGCATACACGGGACC | 36 | 21 | 33 | 5 | 35 | 32 |
| 4475 | 4473 | 12615 | 80.7 | AGCCGCAAACGGCCTAGCTTGGAC | 36 | 21 | 35 | 26 | 17 | 34 |
| 4476 | 4474 | 12616 | 81.5 | AGCCGCAAAGCCCTGTCTTGACGG | 36 | 21 | 36 | 14 | 11 | 35 |
| 4477 | 4475 | 41343 | 77.2 | AGCCAGTGTCGTATCGCACGAGGA | 36 | 22 | 10 | 24 | 30 | 25 |
| 4478 | 4476 | 16878 | 77.8 | AGCCAGTGCTTGAGTGGGACGACC | 36 | 22 | 11 | 22 | 34 | 32 |
| 4479 | 4477 | 31025 | 78.7 | AGCCAGTGCTGTGATGACGGAGCC | 36 | 22 | 14 | 27 | 35 | 36 |
| 4480 | 4478 | 41345 | 79.8 | AGCCAGTGGGTACAGCAGCCAGCC | 36 | 22 | 18 | 31 | 36 | 36 |
| 4481 | 4479 | 12622 | 76.8 | AGCCAGTGACCTGCTTTCCCGTCT | 36 | 22 | 23 | 17 | 28 | 19 |
| 4482 | 4480 | 12623 | 77.9 | AGCCAGTGATCGGAGTACGGCAGC | 36 | 22 | 24 | 20 | 35 | 31 |
| 4483 | 4481 | 16881 | 78 | AGCCAGTGTGCGATACCACGCTCA | 36 | 22 | 29 | 5 | 30 | 13 |
| 4484 | 4482 | 12629 | 78.6 | AGCCAGTGGACCAGGAGCAACACG | 36 | 22 | 32 | 25 | 21 | 30 |
| 4485 | 4483 | 31027 | 78.9 | AGCCACCTTGTCAGGACACGGCAA | 36 | 23 | 9 | 25 | 30 | 21 |
| 4486 | 4484 | 41346 | 75.6 | AGCCACCTTCGTAAAGCCATCGAA | 36 | 23 | 10 | 6 | 15 | 16 |
| 4487 | 4485 | 31028 | 78.2 | AGCCACCTCGAATGTCCTTGCGAA | 36 | 23 | 16 | 9 | 11 | 16 |
| 4488 | 4486 | 12643 | 76.1 | AGCCACCTATCGACCTGATGGCAA | 36 | 23 | 24 | 23 | 27 | 21 |

FIG. 25KKKK

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 4489 | 4487 | 12644 | 76.1 | AGCCACCTAGGAAGTGCTCATGCG | 36 | 23 | 25 | 22 | 13 | 29 |
| 4490 | 4488 | 12646 | 77.3 | AGCCACCTCACGAATCTCCCAGGA | 36 | 23 | 30 | 4 | 28 | 25 |
| 4491 | 4489 | 12656 | 77.3 | AGCCATCGCGAATTGAGGACCCTA | 36 | 24 | 16 | 1 | 34 | 26 |
| 4492 | 4490 | 12661 | 77.6 | AGCCATCGGCAAAATCCAGCAATC | 36 | 24 | 21 | 4 | 31 | 4 |
| 4493 | 4491 | 31030 | 75.9 | AGCCATCGCCTAATACCCATTCCC | 36 | 24 | 26 | 5 | 15 | 28 |
| 4494 | 4492 | 12667 | 76.9 | AGCCAGGAATACGGTATCCCTGCG | 36 | 25 | 5 | 18 | 28 | 29 |
| 4495 | 4493 | 16892 | 76.8 | AGCCAGGAAAAGTTGACACGTGCG | 36 | 25 | 6 | 1 | 30 | 29 |
| 4496 | 4494 | 12669 | 77.5 | AGCCAGGATACATGCGCTCACACG | 36 | 25 | 7 | 29 | 13 | 30 |
| 4497 | 4495 | 12670 | 78.5 | AGCCAGGATCTGCACGCTGTGCTT | 36 | 25 | 8 | 30 | 14 | 17 |
| 4498 | 4496 | 41354 | 77.3 | AGCCAGGACGTTTGTCTCCCGGTA | 36 | 25 | 12 | 9 | 28 | 18 |
| 4499 | 4497 | 12671 | 76.7 | AGCCAGGACTCAAGCCGAGTCCAT | 36 | 25 | 13 | 36 | 20 | 15 |
| 4500 | 4498 | 16893 | 77.8 | AGCCAGGACCATTTGAGTGCCAGC | 36 | 25 | 15 | 1 | 33 | 31 |
| 4501 | 4499 | 12677 | 75.5 | AGCCAGGAGCAAATACGATGCCAT | 36 | 25 | 21 | 5 | 27 | 15 |
| 4502 | 4500 | 16895 | 79.8 | AGCCAGGATGCGCGAAGGTAGTGC | 36 | 25 | 29 | 16 | 18 | 33 |
| 4503 | 4501 | 12681 | 77.8 | AGCCAGGACAGCCTTGAATCACGG | 36 | 25 | 31 | 11 | 4 | 35 |
| 4504 | 4502 | 12682 | 76.2 | AGCCAGGAGACCTCGTCTCATCCC | 36 | 25 | 32 | 10 | 13 | 28 |
| 4505 | 4503 | 31031 | 78.1 | AGCCAGGAGGACAAAGGTGCTCCC | 36 | 25 | 34 | 6 | 33 | 28 |
| 4506 | 4504 | 31032 | 79.8 | AGCCAGGAACGGCCATAATCGCAA | 36 | 25 | 35 | 15 | 4 | 21 |
| 4507 | 4505 | 31033 | 75.2 | AGCCCCTATGATAGCCGATGCTTG | 36 | 26 | 2 | 36 | 27 | 11 |
| 4508 | 4506 | 31034 | 79.2 | AGCCCCTATGTCAGCCCACGCTGT | 36 | 26 | 9 | 36 | 30 | 14 |
| 4509 | 4507 | 41356 | 76.4 | AGCCCCTACTTGAGGACAGCCAGC | 36 | 26 | 11 | 25 | 31 | 31 |
| 4510 | 4508 | 41357 | 76 | AGCCCCTACTCACTCAATCGCACG | 36 | 26 | 13 | 13 | 24 | 30 |
| 4511 | 4509 | 16902 | 77.6 | AGCCCCTAGAGTGCAATGCGAGGA | 36 | 26 | 20 | 21 | 29 | 25 |
| 4512 | 4510 | 41358 | 77.4 | AGCCCCTAGCAACCATGTGCGAGT | 36 | 26 | 21 | 15 | 33 | 20 |
| 4513 | 4511 | 31035 | 75 | AGCCCCTAACCTTCTGGCTTAGCC | 36 | 26 | 23 | 8 | 17 | 36 |
| 4514 | 4512 | 12695 | 77.7 | AGCCCCTAGATGGCAATCGTGTGC | 36 | 26 | 27 | 21 | 10 | 33 |
| 4515 | 4513 | 12697 | 75.6 | AGCCCCTACACGAATCAATCACGG | 36 | 26 | 30 | 4 | 4 | 35 |
| 4516 | 4514 | 12699 | 79.6 | AGCCCCTAACGGCACGCTGTTGTC | 36 | 26 | 35 | 30 | 14 | 9 |
| 4517 | 4515 | 12700 | 76.8 | AGCCGATGTGATCTTGATCGCAGC | 36 | 27 | 2 | 11 | 24 | 31 |
| 4518 | 4516 | 12701 | 75.3 | AGCCGATGTTAGTTGATGCGCTCA | 36 | 27 | 3 | 1 | 29 | 13 |
| 4519 | 4517 | 12703 | 77.2 | AGCCGATGTACATGTCGACCCACG | 36 | 27 | 7 | 9 | 32 | 30 |
| 4520 | 4518 | 12704 | 75.9 | AGCCGATGTCTGAATCGCAAGGAC | 36 | 27 | 8 | 4 | 21 | 34 |
| 4521 | 4519 | 31036 | 82.3 | AGCCGATGTGTCAGCCTGCGGGAC | 36 | 27 | 9 | 36 | 29 | 34 |
| 4522 | 4520 | 41363 | 78.8 | AGCCGATGCTCAACCTGCTTCACG | 36 | 27 | 13 | 23 | 17 | 30 |
| 4523 | 4521 | 22465 | 77.3 | AGCCGATGGCTTAGCCTTAGTGCG | 36 | 27 | 17 | 36 | 3 | 29 |
| 4524 | 4522 | 16908 | 76.3 | AGCCGATGACCTCAGCCCTAGACC | 36 | 27 | 23 | 31 | 26 | 32 |
| 4525 | 4523 | 41364 | 78.2 | AGCCGATGCCTACCATGTGCGTCT | 36 | 27 | 26 | 15 | 33 | 19 |
| 4526 | 4524 | 31038 | 77.6 | AGCCTCCCTTGAACCTTCCCAGGA | 36 | 28 | 1 | 23 | 28 | 25 |
| 4527 | 4525 | 31039 | 77 | AGCCTCCCATACTGCGCTCAGCTT | 36 | 28 | 5 | 29 | 13 | 17 |
| 4528 | 4526 | 41367 | 77 | AGCCTCCCTACAACCTTGCGGATG | 36 | 28 | 7 | 23 | 29 | 27 |
| 4529 | 4527 | 16911 | 76.8 | AGCCTCCCTGTCAAAGGTGCGAGT | 36 | 28 | 9 | 6 | 33 | 20 |
| 4530 | 4528 | 12724 | 75.1 | AGCCTCCCTCGTACGGGGTAGAGT | 36 | 28 | 10 | 35 | 18 | 20 |
| 4531 | 4529 | 12725 | 76.9 | AGCCTCCCCTTGTTGAAGTGACGG | 36 | 28 | 11 | 1 | 22 | 35 |
| 4532 | 4530 | 22467 | 76.7 | AGCCTCCCCCATCCTAGGACCTGT | 36 | 28 | 15 | 26 | 34 | 14 |
| 4533 | 4531 | 31040 | 80.2 | AGCCTCCCCGAATCTGGTGCCTGT | 36 | 28 | 16 | 8 | 33 | 14 |
| 4534 | 4532 | 41368 | 77.8 | AGCCTCCCGTCTGGTAGGACGCTT | 36 | 28 | 19 | 18 | 34 | 17 |
| 4535 | 4533 | 31041 | 76.9 | AGCCTCCCGAGTCCTATCCCGAGT | 36 | 28 | 20 | 26 | 28 | 20 |
| 4536 | 4534 | 16914 | 79 | AGCCTCCAGTGCTTGCTTGGACC | 36 | 28 | 22 | 11 | 11 | 32 |
| 4537 | 4535 | 12733 | 76.8 | AGCCTCCCATCGTTGAAATCGGAC | 36 | 28 | 24 | 1 | 4 | 34 |
| 4538 | 4536 | 22471 | 76.6 | AGCCTCCCAGGACCTATCGTCGAA | 36 | 28 | 25 | 26 | 10 | 16 |
| 4539 | 4537 | 22472 | 75.3 | AGCCTCCCCCTACTGTCTCATCCC | 36 | 28 | 26 | 14 | 13 | 28 |

FIG. 25LLLL

| SEQ ID NO: | 4,633 ID# | HEX ID# | Tm | ZIPCODE (5'-3') | TETRAMER NUMBERS | | | | |
|---|---|---|---|---|---|---|---|---|---|
| 4540 | 4538 | 12734 | 78.9 | AGCCTCCCGATGGATGGCAATGAT | 36 | 28 | 27 | 27 | 21 | 2 |
| 4541 | 4539 | 12735 | 80.6 | AGCCTCCCTCCCGCAAACCTGATG | 36 | 28 | 28 | 21 | 23 | 27 |
| 4542 | 4540 | 12736 | 80.5 | AGCCTCCCGTGCATCGTTGACAGC | 36 | 28 | 33 | 24 | 1 | 31 |
| 4543 | 4541 | 12737 | 81.8 | AGCCTCCCACGGCCATGAGTCGAA | 36 | 28 | 35 | 15 | 20 | 16 |
| 4544 | 4542 | 12738 | 78.6 | AGCCTCCCAGCCAAAGTCGTTCGT | 36 | 28 | 36 | 6 | 10 | 10 |
| 4545 | 4543 | 12739 | 77.5 | AGCCTGCGAATCGGTAAGTGCGTT | 36 | 29 | 4 | 18 | 22 | 12 |
| 4546 | 4544 | 31042 | 76.7 | AGCCTGCGAAAGTCTGTCCCCCTA | 36 | 29 | 6 | 8 | 28 | 26 |
| 4547 | 4546 | 22477 | 81.2 | AGCCTGCGCTCACTTGGCAAGCAA | 36 | 29 | 13 | 11 | 21 | 21 |
| 4548 | 4547 | 12745 | 79.3 | AGCCTGCGCTGTGTCTTGTCCGAA | 36 | 29 | 14 | 19 | 9 | 16 |
| 4549 | 4548 | 12748 | 78.5 | AGCCTGCGGAGTGATGCTGTGCTT | 36 | 29 | 20 | 27 | 14 | 17 |
| 4550 | 4549 | 31043 | 79.7 | AGCCTGCGAGTGGAGTTCCCATCG | 36 | 29 | 22 | 20 | 28 | 24 |
| 4551 | 4550 | 31044 | 77.6 | AGCCTGCGAGGAGCTTCCTATCCC | 36 | 29 | 25 | 17 | 26 | 28 |
| 4552 | 4551 | 12751 | 79.5 | AGCCTGCGTGCGAAAGCCTATCGT | 36 | 29 | 29 | 6 | 26 | 10 |
| 4553 | 4552 | 12752 | 83.6 | AGCCTGCGCACGCTCATCTGCAGC | 36 | 29 | 30 | 13 | 8 | 31 |
| 4554 | 4553 | 12753 | 82.9 | AGCCTGCGGTGCGATGAGCCTTGA | 36 | 29 | 33 | 27 | 36 | 1 |
| 4555 | 4554 | 31045 | 80.1 | AGCCCACGAATCGACCGGTACACG | 36 | 30 | 4 | 32 | 18 | 30 |
| 4556 | 4555 | 41379 | 77.4 | AGCCCACGTACACTCAATCGTGCG | 36 | 30 | 7 | 13 | 24 | 29 |
| 4557 | 4556 | 12760 | 79.2 | AGCCCACGCTTGGCAAGGTATCGT | 36 | 30 | 11 | 21 | 18 | 10 |
| 4558 | 4557 | 22487 | 76.2 | AGCCCACGGTCTAGGAGGTAACGG | 36 | 30 | 19 | 25 | 18 | 35 |
| 4559 | 4558 | 16921 | 78.6 | AGCCCACGACCTTCCCCTCATGTC | 36 | 30 | 23 | 28 | 13 | 9 |
| 4560 | 4559 | 31047 | 78.3 | AGCCCACGCCTACGTTGCTTTTGA | 36 | 30 | 26 | 12 | 17 | 1 |
| 4561 | 4560 | 12769 | 82.9 | AGCCCACGCAGCGGACTTGAGCAA | 36 | 30 | 31 | 34 | 1 | 21 |
| 4562 | 4561 | 12770 | 81.8 | AGCCCACGGACCGCTTGCAACTGT | 36 | 30 | 32 | 17 | 21 | 14 |
| 4563 | 4562 | 12772 | 82 | AGCCCACGACGGCTCAAGGAGCAA | 36 | 30 | 35 | 13 | 25 | 21 |
| 4564 | 4563 | 41381 | 77.6 | AGCCCAGCTGATCCTAGACCGCAA | 36 | 31 | 2 | 26 | 32 | 21 |
| 4565 | 4564 | 22490 | 77.8 | AGCCCAGCTTAGAGTGCAGCCGAA | 36 | 31 | 3 | 22 | 31 | 16 |
| 4566 | 4565 | 31048 | 79.6 | AGCCCAGCAAAGGACCAGTGACGG | 36 | 31 | 6 | 32 | 22 | 35 |
| 4567 | 4566 | 31049 | 77.7 | AGCCCAGCTACAGATGTCCCCACG | 36 | 31 | 7 | 27 | 28 | 30 |
| 4568 | 4567 | 16923 | 78.5 | AGCCCAGCTCGTGCTTGCTTGGTA | 36 | 31 | 10 | 17 | 17 | 18 |
| 4569 | 4568 | 12780 | 78.8 | AGCCCAGCCCATTTGAAGGAGTGC | 36 | 31 | 15 | 1 | 25 | 33 |
| 4570 | 4569 | 12781 | 77.7 | AGCCCAGCGCTTACCTATCGCTCA | 36 | 31 | 17 | 23 | 24 | 13 |
| 4571 | 4570 | 31050 | 76.3 | AGCCCAGCGTCTATACCAGCTCCC | 36 | 31 | 19 | 5 | 31 | 28 |
| 4572 | 4571 | 31051 | 79.3 | AGCCCAGCAGGACTGTTCCCCTCA | 36 | 31 | 25 | 14 | 28 | 13 |
| 4573 | 4572 | 12787 | 81.5 | AGCCCAGCGACCCTCAACCTCACG | 36 | 31 | 32 | 13 | 23 | 30 |
| 4574 | 4573 | 12789 | 80 | AGCCCAGCAGCCCCATCCTACCAT | 36 | 31 | 36 | 15 | 26 | 15 |
| 4575 | 4574 | 22495 | 75.2 | AGCCGACCTTGAGGTACGAAATCG | 36 | 32 | 1 | 18 | 16 | 24 |
| 4576 | 4575 | 41384 | 79 | AGCCGACCTGATGGACGCAACTCA | 36 | 32 | 2 | 34 | 21 | 13 |
| 4577 | 4576 | 12794 | 79.1 | AGCCGACCAAAGCAGCTCCCTGTC | 36 | 32 | 6 | 31 | 28 | 9 |
| 4578 | 4577 | 12796 | 76.8 | AGCCGACCCTTGAAAGCTGTCGTT | 36 | 32 | 11 | 6 | 14 | 12 |
| 4579 | 4578 | 12798 | 76.2 | AGCCGACCCTCACCTAGGACCTTG | 36 | 32 | 13 | 26 | 34 | 11 |
| 4580 | 4579 | 41385 | 80.3 | AGCCGACCGTCTGATGTCCCATCG | 36 | 32 | 19 | 27 | 28 | 24 |
| 4581 | 4580 | 12801 | 79.7 | AGCCGACCGCAACTCAAATCCAGC | 36 | 32 | 21 | 13 | 4 | 31 |
| 4582 | 4581 | 12802 | 75.5 | AGCCGACCAGTGTTAGGTGCCCTA | 36 | 32 | 22 | 3 | 33 | 26 |
| 4583 | 4582 | 31052 | 79.8 | AGCCGACCATCGTCTGGCAACCAT | 36 | 32 | 24 | 8 | 21 | 15 |
| 4584 | 4583 | 16926 | 77.8 | AGCCGACCAGGAAGTGCGTTATCG | 36 | 32 | 25 | 22 | 12 | 24 |
| 4585 | 4584 | 12807 | 81.4 | AGCCGACCCACGAGTGCTGTCACG | 36 | 32 | 30 | 22 | 14 | 30 |
| 4586 | 4585 | 12809 | 80.4 | AGCCGACCGTGCATCGAAAGATCG | 36 | 32 | 33 | 24 | 6 | 24 |
| 4587 | 4587 | 31053 | 77.4 | AGCCGTGCAATCTCGTTCCCTGAT | 36 | 33 | 4 | 10 | 28 | 2 |
| 4588 | 4588 | 31054 | 78.5 | AGCCGTGCATACCCTACAGCACGG | 36 | 33 | 5 | 26 | 31 | 35 |
| 4589 | 4589 | 12814 | 77.6 | AGCCGTGCTCTGAGTGCCATGATG | 36 | 33 | 8 | 22 | 15 | 27 |
| 4590 | 4590 | 12816 | 78.1 | AGCCGTGCTCGTTCGTGTCTAGCC | 36 | 33 | 10 | 10 | 19 | 36 |

FIG. 25MMMM

| SEQ ID NO: | 4,633 ID# | HEX ID# | Tm | ZIPCODE (5'-3') | TETRAMER NUMBERS | | | | |
|---|---|---|---|---|---|---|---|---|---|
| 4591 | 4591 | 12817 | 79.3 | AGCCGTGCCTTGGAGTGCAAACCT | 36 | 33 | 11 | 20 | 21 | 23 |
| 4592 | 4592 | 12818 | 80.9 | AGCCGTGCCGAAGCAATGTCAGGA | 36 | 33 | 16 | 21 | 9 | 25 |
| 4593 | 4593 | 12819 | 81.8 | AGCCGTGCGCTTGTGCTCGTGGTA | 36 | 33 | 17 | 33 | 10 | 18 |
| 4594 | 4594 | 31055 | 79.9 | AGCCGTGCGTCTGCTTTCCCTGTC | 36 | 33 | 19 | 17 | 28 | 9 |
| 4595 | 4595 | 12821 | 82.1 | AGCCGTGCATCGGCAACTGTCACG | 36 | 33 | 24 | 21 | 14 | 30 |
| 4596 | 4596 | 12824 | 82.4 | AGCCGTGCGGACCTTGTCGTCAGC | 36 | 33 | 34 | 11 | 10 | 31 |
| 4597 | 4597 | 31056 | 75.5 | AGCCGGACTTAGTACAAGCCTGCG | 36 | 34 | 3 | 7 | 36 | 29 |
| 4598 | 4598 | 12830 | 75.9 | AGCCGGACTGTCTCGTGGTAATCG | 36 | 34 | 9 | 10 | 18 | 24 |
| 4599 | 4599 | 12831 | 79.9 | AGCCGGACCGTTTGTCGACCTTGA | 36 | 34 | 12 | 9 | 32 | 1 |
| 4600 | 4600 | 12833 | 79.6 | AGCCGGACCCATCAGCGAGTTGTC | 36 | 34 | 15 | 31 | 20 | 9 |
| 4601 | 4601 | 16931 | 79.5 | AGCCGGACGCTTCTTGCTCACGTT | 36 | 34 | 17 | 11 | 13 | 12 |
| 4602 | 4602 | 12836 | 76.6 | AGCCGGACACCTCTTGACCTTCGT | 36 | 34 | 23 | 11 | 23 | 10 |
| 4603 | 4603 | 12837 | 79.3 | AGCCGGACATCGCGTTTCTGACCT | 36 | 34 | 24 | 12 | 8 | 23 |
| 4604 | 4604 | 22502 | 75.1 | AGCCGGACAGGACCTACAGCAATC | 36 | 34 | 25 | 26 | 31 | 4 |
| 4605 | 4605 | 12840 | 78.7 | AGCCGGACTCCCTACACACGGGAC | 36 | 34 | 28 | 7 | 30 | 34 |
| 4606 | 4606 | 12842 | 82.6 | AGCCGGACGTGCGAGTGACCGGTA | 36 | 34 | 33 | 20 | 32 | 18 |
| 4607 | 4607 | 12843 | 80.7 | AGCCGGACGGACGACCCAGCTTAG | 36 | 34 | 34 | 32 | 31 | 3 |
| 4608 | 4608 | 12846 | 76.7 | AGCCACGGAATCTGATGCTTCACG | 36 | 35 | 4 | 2 | 17 | 30 |
| 4609 | 4609 | 12847 | 77.7 | AGCCACGGATACCAGCTCGTACGG | 36 | 35 | 5 | 31 | 10 | 35 |
| 4610 | 4610 | 41393 | 76.9 | AGCCACGGAAAGAAAGGATGGTGC | 36 | 35 | 6 | 6 | 27 | 33 |
| 4611 | 4611 | 31057 | 75.5 | AGCCACGGTACACCTATCCCGATG | 36 | 35 | 7 | 26 | 28 | 27 |
| 4612 | 4612 | 12849 | 78.9 | AGCCACGGTCTGGATGCGTTTTGA | 36 | 35 | 8 | 27 | 12 | 1 |
| 4613 | 4613 | 31058 | 81.2 | AGCCACGGTGTCGGACATCGCTTG | 36 | 35 | 9 | 34 | 24 | 11 |
| 4614 | 4614 | 31059 | 81.2 | AGCCACGGGCTTGCTTCACGACCT | 36 | 35 | 17 | 17 | 30 | 23 |
| 4615 | 4615 | 31060 | 81.3 | AGCCACGGGTCTGTCTGTGCCACG | 36 | 35 | 19 | 19 | 33 | 30 |
| 4616 | 4616 | 12856 | 79.3 | AGCCACGGATCGGCTTTCGTGAGT | 36 | 35 | 24 | 17 | 10 | 20 |
| 4617 | 4617 | 12859 | 80.9 | AGCCACGGGACCAGTGGACCCTGT | 36 | 35 | 32 | 22 | 32 | 14 |
| 4618 | 4618 | 12860 | 80.5 | AGCCACGGGTGCTACAGGACGTGC | 36 | 35 | 33 | 7 | 34 | 33 |
| 4619 | 4619 | 16934 | 81 | AGCCACGGACGGCCTAAGTGCGTT | 36 | 35 | 35 | 26 | 22 | 12 |
| 4620 | 4620 | 31061 | 75.3 | AGCCAGCCTGATACCTAGCCATCG | 36 | 36 | 2 | 23 | 36 | 24 |
| 4621 | 4621 | 41394 | 76.8 | AGCCAGCCAAAGACCTACGGCTGT | 36 | 36 | 6 | 23 | 35 | 14 |
| 4622 | 4622 | 12866 | 78.6 | AGCCAGCCTCTGGACCAGGATCGT | 36 | 36 | 8 | 32 | 25 | 10 |
| 4623 | 4623 | 41395 | 77 | AGCCAGCCTCGTAGTGGGTAACGG | 36 | 36 | 10 | 22 | 18 | 35 |
| 4624 | 4624 | 12867 | 77.8 | AGCCAGCCCTTGTGTCCGAACTTG | 36 | 36 | 11 | 9 | 16 | 11 |
| 4625 | 4625 | 12868 | 78.1 | AGCCAGCCCGTTCGTTTCGTTACA | 36 | 36 | 12 | 12 | 10 | 7 |
| 4626 | 4626 | 16936 | 76.9 | AGCCAGCCCTCAGCTTCTTGGGTA | 36 | 36 | 13 | 17 | 11 | 18 |
| 4627 | 4627 | 12870 | 79.1 | AGCCAGCCGCTTAGTGCAGCAGTG | 36 | 36 | 17 | 22 | 31 | 22 |
| 4628 | 4628 | 12872 | 77.2 | AGCCAGCCGTCTTTGAGGACCTTG | 36 | 36 | 19 | 1 | 34 | 11 |
| 4629 | 4629 | 12874 | 78.5 | AGCCAGCCATCGTGATGATGAGCC | 36 | 36 | 24 | 2 | 27 | 36 |
| 4630 | 4630 | 12876 | 81.1 | AGCCAGCCTCCCCAGCGATGTGAT | 36 | 36 | 28 | 31 | 27 | 2 |
| 4631 | 4631 | 12878 | 82.6 | AGCCAGCCCACGCCATGCAACTGT | 36 | 36 | 30 | 15 | 21 | 14 |
| 4632 | 4632 | 12879 | 81.6 | AGCCAGCCGACCCAGCAGGAGATG | 36 | 36 | 32 | 31 | 25 | 27 |
| 4633 | 4633 | 12880 | 80.2 | AGCCAGCCGGACGGTAATCGGTCT | 36 | 36 | 34 | 18 | 24 | 19 |

FIG. 26A

| SEQ ID NO: | 4,633 ID# | HEX ID# | Tm | ZIPCODE (5'-3') | TETRAMER NUMBERS | | | | |
|---|---|---|---|---|---|---|---|---|---|
| 1 | 3 | 8 | 77.6 | TTGAAATCCAGCGCAAAATCTGCG | 1 | 4 | 31 | 21 | 4 | 29 |
| 2 | 5 | 15 | 77.2 | TTGAAAAGCCTACACGACGGCGAA | 1 | 6 | 26 | 30 | 35 | 16 |
| 3 | 7 | 22 | 76.5 | TTGATCTGCCATACGGGCTTACGG | 1 | 8 | 15 | 35 | 17 | 35 |
| 4 | 15 | 45 | 80.6 | TTGACTTGTCCCCAGCACGGCCAT | 1 | 11 | 28 | 31 | 35 | 15 |
| 5 | 17 | 56 | 80.4 | TTGACGTTGACCAGCCCGTTGCAA | 1 | 12 | 32 | 36 | 12 | 21 |
| 6 | 20 | 72 | 76.4 | TTGACGAAGCTTTCCCCCATGATG | 1 | 16 | 17 | 28 | 15 | 27 |
| 7 | 24 | 90 | 81.2 | TTGAGCAAGGACGACCGCAAACGG | 1 | 21 | 34 | 32 | 21 | 35 |
| 8 | 30 | 126 | 82.4 | TTGAGATGACGGACGGTGCGGCAA | 1 | 27 | 35 | 35 | 29 | 21 |
| 9 | 33 | 140 | 76.3 | TTGATCCCATCGAAAGGGACGATG | 1 | 28 | 24 | 6 | 34 | 27 |
| 10 | 36 | 150 | 80.1 | TTGATGCGTCTGGGACGTGCCTTG | 1 | 29 | 8 | 34 | 33 | 11 |
| 11 | 44 | 166 | 80.3 | TTGACACGTCGTCAGCTCCCGTGC | 1 | 30 | 10 | 31 | 28 | 33 |
| 12 | 48 | 180 | 80 | TTGACAGCCTGTTGCGGTGCGTCT | 1 | 31 | 14 | 29 | 33 | 19 |
| 13 | 52 | 202 | 76.5 | TTGAGTGCGGTACTTGCAGCGATG | 1 | 33 | 18 | 11 | 31 | 27 |
| 14 | 55 | 222 | 81.2 | TTGAACGGTCTGCACGTCCCAGCC | 1 | 35 | 8 | 30 | 28 | 36 |
| 15 | 67 | 269 | 82.2 | TGATTCTGGTGCGTGCCAGCCAGC | 2 | 8 | 33 | 33 | 31 | 31 |
| 16 | 69 | 274 | 76.8 | TGATTGTCGCTTTCTGACGGAGCC | 2 | 9 | 17 | 8 | 35 | 36 |
| 17 | 73 | 294 | 77.9 | TGATCGTTTGCGGGTATCCCTCGT | 2 | 12 | 29 | 18 | 28 | 10 |
| 18 | 75 | 310 | 77.9 | TGATCGAAAGGACAGCAGCCTCCC | 2 | 16 | 25 | 31 | 36 | 28 |
| 19 | 79 | 328 | 76.9 | TGATGCAAGCAACGAACACGCTGT | 2 | 21 | 21 | 16 | 30 | 14 |
| 20 | 92 | 372 | 79.5 | TGATTGCGAGTGGACCATCGCCAT | 2 | 29 | 22 | 32 | 24 | 15 |
| 21 | 94 | 379 | 80 | TGATCACGCTTGCCATGGACGGAC | 2 | 30 | 11 | 15 | 34 | 34 |
| 22 | 104 | 418 | 82 | TGATGTGCCTCAACGGGTGCAGCC | 2 | 33 | 13 | 35 | 33 | 36 |
| 23 | 111 | 431 | 75.6 | TGATGGACCGTTAGCCGATGTTGA | 2 | 34 | 12 | 36 | 27 | 1 |
| 24 | 118 | 444 | 79.5 | TGATACGGAGGAGGACTGCGTGCG | 2 | 35 | 25 | 34 | 29 | 29 |
| 25 | 129 | 555 | 79.9 | TTAGGATGAGCCAGCCTGCGAGCC | 3 | 27 | 36 | 36 | 29 | 36 |
| 26 | 151 | 690 | 77.7 | AATCTCGTCGTTTCCCCTCATGCG | 4 | 10 | 12 | 28 | 13 | 29 |
| 27 | 166 | 805 | 77.4 | AATCGCAACTGTCGTTCACGGTGC | 4 | 21 | 14 | 12 | 30 | 33 |
| 28 | 167 | 842 | 81.4 | AATCAGGACACGCAGCGACCTGCG | 4 | 25 | 30 | 31 | 32 | 29 |
| 29 | 183 | 926 | 76.7 | AATCGACCCTGTGTCTGCTTTGCG | 4 | 32 | 14 | 19 | 17 | 29 |
| 30 | 197 | 983 | 76.9 | AATCAGCCAAAGCGAAGTGCGATG | 4 | 36 | 6 | 16 | 33 | 27 |
| 31 | 216 | 1111 | 76.2 | ATACGACCTCGTGAGTTCCCGCAA | 5 | 32 | 10 | 20 | 28 | 21 |
| 32 | 226 | 1207 | 75.4 | AAAGCTTGACCTATCGAGCCGTGC | 6 | 11 | 23 | 24 | 36 | 33 |
| 33 | 268 | 1503 | 75.5 | AAAGAGCCGCTTGAGTCGAAATCG | 6 | 36 | 17 | 20 | 16 | 24 |
| 34 | 297 | 1649 | 75.7 | TCTGCTTGCTCACCTACCATTGCG | 8 | 11 | 13 | 26 | 15 | 29 |
| 35 | 332 | 1771 | 75 | TCTGATCGCCTAGGTAACGGGGAC | 8 | 24 | 26 | 18 | 35 | 34 |
| 36 | 358 | 1847 | 76.9 | TCTGCAGCGGTACTGTGGACCCAT | 8 | 31 | 18 | 14 | 34 | 15 |
| 37 | 375 | 1912 | 75.8 | TCTGAGCCACCTAATCTCCCACGG | 8 | 36 | 23 | 4 | 28 | 35 |
| 38 | 385 | 1941 | 77.4 | TGTCTCGTTCCCACCTCCATTCCC | 9 | 10 | 28 | 23 | 15 | 28 |
| 39 | 442 | 2093 | 81.4 | TGTCATCGCAGCGAGTCAGCCACG | 9 | 24 | 31 | 20 | 31 | 30 |
| 40 | 445 | 2103 | 77.7 | TGTCCCTAACCTGATGGTGCGCAA | 9 | 26 | 23 | 27 | 33 | 21 |
| 41 | 461 | 2143 | 77.3 | TGTCTGCGGTCTCCATATCGGTGC | 9 | 29 | 19 | 15 | 24 | 33 |
| 42 | 469 | 2154 | 76.2 | TGTCCACGCGTTACCTTGTCGATG | 9 | 30 | 12 | 23 | 9 | 27 |
| 43 | 487 | 2196 | 79.1 | TGTCGTGCTCTGACCTTGCGCTCA | 9 | 33 | 8 | 23 | 29 | 13 |
| 44 | 508 | 2231 | 81.7 | TGTCACGGAATCGTGCTGCGGCTT | 9 | 35 | 4 | 33 | 29 | 17 |
| 45 | 527 | 2307 | 77.4 | TCGTTCTGGCTTGGACGCTTCTCA | 10 | 8 | 17 | 34 | 17 | 13 |
| 46 | 602 | 2543 | 80 | TCGTTGCGTGTCGGACCTTGGATG | 10 | 29 | 9 | 34 | 11 | 27 |
| 47 | 686 | 2755 | 78.3 | CTTGCGTTGATGCGAATCGTCGAA | 11 | 12 | 27 | 16 | 10 | 16 |
| 48 | 973 | 3831 | 77.7 | CTGTCACGCTCAACCTTCCCCGTT | 14 | 30 | 13 | 23 | 28 | 12 |
| 49 | 987 | 3866 | 77.6 | CTGTGTGCCGTTTCGTGTGCAGTG | 14 | 33 | 12 | 10 | 33 | 22 |
| 50 | 1053 | 4127 | 77 | CCATGCAATCCCAGGATGTCGGTA | 15 | 21 | 28 | 25 | 9 | 18 |
| 51 | 1093 | 4232 | 78.7 | CCATCAGCTCTGGCAATGCGGAGT | 15 | 31 | 8 | 21 | 29 | 20 |

FIG. 26B

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 52 | 1142 | 4394 | 75.4 | CGAATCTGGGTAAGGAAGCCATCG | 16 | 8 | 18 | 25 | 36 | 24 |
| 53 | 1145 | 20638 | 77.7 | CGAATGTCCTGTCCATCGAATGCG | 16 | 9 | 14 | 15 | 16 | 29 |
| 54 | 1159 | 4453 | 75.2 | CGAACGTTTACATGCGTCGTAGCC | 16 | 12 | 7 | 29 | 10 | 36 |
| 55 | 1193 | 4568 | 78.3 | CGAAAGTGAGCCGCAACTTGGGAC | 16 | 22 | 36 | 21 | 11 | 34 |
| 56 | 1246 | 4751 | 78.9 | CGAAGGACAGTGAGTGTGCGCACG | 16 | 34 | 22 | 22 | 29 | 30 |
| 57 | 1560 | 6171 | 75.4 | GCAAAGCCATACCTTGGCTTGCTT | 21 | 36 | 5 | 11 | 17 | 17 |
| 58 | 1641 | 6531 | 75.7 | ACCTCTTGCCTACGAACAGCCGAA | 23 | 11 | 26 | 16 | 31 | 16 |
| 59 | 1655 | 6599 | 78.8 | ACCTGCAAGTGCCCATGTGCCCTA | 23 | 21 | 33 | 15 | 33 | 26 |
| 60 | 1919 | 7289 | 80.1 | AGGATCTGGACCGGACTCCCCGAA | 25 | 8 | 32 | 34 | 28 | 16 |
| 61 | 1982 | 7538 | 78 | AGGAACGGCAGCTACACACGAGCC | 25 | 35 | 31 | 7 | 30 | 36 |
| 62 | 2081 | 8056 | 78.1 | GATGGACCACCTCAGCGCTTGACC | 27 | 32 | 23 | 31 | 17 | 32 |
| 63 | 2105 | 8145 | 77.8 | TCCCTTAGGACCCAGCGTCTGTGC | 28 | 3 | 32 | 31 | 19 | 33 |
| 64 | 2623 | 8944 | 75.5 | TGCGCCATAAAGGACCTTAGCCAT | 29 | 15 | 6 | 32 | 3 | 15 |
| 65 | 2755 | 9114 | 75.8 | TGCGAGGACCATGGTAGGTAAGCC | 29 | 25 | 15 | 18 | 18 | 36 |
| 66 | 12 | 42 | 81.5 | TTGATCGTGGACACGGCACGCTCA | 1 | 10 | 34 | 35 | 30 | 13 |
| 67 | 26 | 94 | 78.2 | TTGAAGTGCAGCCACGAAAGCGAA | 1 | 22 | 31 | 30 | 6 | 16 |
| 68 | 29 | 112 | 79.3 | TTGAATCGGAGTTGCGCGTTGGAC | 1 | 24 | 20 | 29 | 12 | 34 |
| 69 | 82 | 346 | 80.9 | TGATGATGGCTTCAGCTGCGCGAA | 2 | 27 | 17 | 31 | 29 | 16 |
| 70 | 86 | 351 | 79.2 | TGATTCCCTTGAACGGTCCCGGAC | 2 | 28 | 1 | 35 | 28 | 34 |
| 71 | 124 | 521 | 78.3 | TTAGGCAATTGATCCCGACCGTGC | 3 | 21 | 1 | 28 | 32 | 33 |
| 72 | 132 | 567 | 78.2 | TTAGTCCCACGGGATGCGTTGACC | 3 | 28 | 35 | 27 | 12 | 32 |
| 73 | 191 | 962 | 77.5 | AATCGGACATCGAGTGTCCCCAGC | 4 | 34 | 24 | 22 | 28 | 31 |
| 74 | 210 | 1078 | 75.8 | ATACTGCGCGTTCTGTGAGTTGCG | 5 | 29 | 12 | 14 | 20 | 29 |
| 75 | 325 | 1744 | 78.5 | TCTGGTCTGCAATCGTCACGCAGC | 8 | 19 | 21 | 10 | 30 | 31 |
| 76 | 436 | 2073 | 79.4 | TGTCAGTGCACGGCTTCTGTTGCG | 9 | 22 | 30 | 17 | 14 | 29 |
| 77 | 551 | 2365 | 77.2 | TCGTCTCAGCTTGACCGCTTCAGC | 10 | 13 | 17 | 32 | 17 | 31 |
| 78 | 629 | 2593 | 76.7 | TCGTCAGCCCTAATCGACCTGTGC | 10 | 31 | 26 | 24 | 23 | 33 |
| 79 | 644 | 2624 | 75.5 | TCGTGTGCGCTTAATACACGGAATC | 10 | 33 | 17 | 4 | 35 | 4 |
| 80 | 804 | 3213 | 76.4 | CGTTCGAAGTCTCTTGACGGACGG | 12 | 16 | 19 | 11 | 35 | 35 |
| 81 | 836 | 3345 | 75.7 | CGTTTCCCAATCATCGGCAAGTCT | 12 | 28 | 4 | 24 | 21 | 19 |
| 82 | 872 | 3431 | 77.5 | CGTTGTGCTGATGCAAATCGGCTT | 12 | 33 | 2 | 21 | 24 | 17 |
| 83 | 949 | 3748 | 79.9 | CTGTCTTGGTGCGCAAAGGATGCG | 14 | 11 | 33 | 21 | 25 | 29 |
| 84 | 1148 | 4415 | 77.1 | CGAATCGTTTGAGCAAGACCCACG | 16 | 10 | 1 | 21 | 32 | 30 |
| 85 | 1235 | 4695 | 76.7 | CGAACAGCTGCGAATCGTCTAGCC | 16 | 31 | 29 | 4 | 19 | 36 |
| 86 | 1406 | 5575 | 75.8 | GAGTTCGTGCTTACGGCTTGAGCC | 20 | 10 | 17 | 35 | 11 | 36 |
| 87 | 1603 | 6332 | 75.6 | AGTGTCCCGAGTACCTGGACACGG | 22 | 28 | 20 | 23 | 34 | 35 |
| 88 | 2216 | 8362 | 76.3 | TCCCGCTTTGATTCTGTCGTTCGT | 28 | 17 | 2 | 8 | 10 | 10 |
| 89 | 2286 | 8468 | 75 | TCCCACCTGTCTACCTAGCCGACC | 28 | 23 | 19 | 23 | 36 | 32 |
| 90 | 2364 | 8591 | 77.1 | TCCCCACGATACACCTTTGATGCG | 28 | 30 | 5 | 23 | 1 | 29 |
| 91 | 2556 | 30603 | 76.3 | TGCGCTTGATACTGTCGCTTCGAA | 29 | 11 | 5 | 9 | 17 | 16 |
| 92 | 2587 | 8909 | 75.8 | TGCGCTCAATACAGCCTCGTATCG | 29 | 13 | 5 | 36 | 10 | 24 |
| 93 | 2741 | 9095 | 79.8 | TGCGATCGCGAAGCAATGATCGTT | 29 | 24 | 16 | 21 | 2 | 12 |
| 94 | 2793 | 9168 | 77.9 | TGCGTCCCTCTGTGATCACGAGGA | 29 | 28 | 8 | 2 | 30 | 25 |
| 95 | 2821 | 9200 | 80.5 | TGCGCACGAGGAATCGCTTGAGTG | 29 | 30 | 25 | 24 | 11 | 22 |
| 96 | 3120 | 9759 | 76.9 | CACGGTGCTACAGTGCAAAGCACG | 30 | 33 | 7 | 33 | 6 | 30 |
| 97 | 6 | 18 | 79.1 | TTGAAAAGGGACGTGCGCTTCGAA | 1 | 6 | 34 | 33 | 17 | 16 |
| 98 | 8 | 25 | 79.5 | TTGATCTGCACGCGTTGTGCGGTA | 1 | 8 | 30 | 12 | 33 | 18 |
| 99 | 9 | 29 | 80.3 | TTGATGTCCCATTCCCCACGCGTT | 1 | 9 | 15 | 28 | 30 | 12 |
| 100 | 13 | 43 | 79.2 | TTGATCGTAGCCGGTATGCGACGG | 1 | 10 | 36 | 18 | 29 | 35 |
| 101 | 18 | 64 | 79.7 | TTGACCATGCTTCGAAACGGCGAA | 1 | 15 | 17 | 16 | 35 | 16 |
| 102 | 21 | 75 | 77.4 | TTGACGAAATCGGCAACCTATGCG | 1 | 16 | 24 | 21 | 26 | 29 |

FIG. 26C

| SEQ ID NO: | 4,633 ID# | HEX ID# | Tm | ZIPCODE (5'-3') | TETRAMER NUMBERS | | | | |
|---|---|---|---|---|---|---|---|---|---|
| 103 | 32 | 12925 | 75.7 | TTGATCCCGGTATTAGAGCCCACG | 1 | 28 | 18 | 3 | 36 30 |
| 104 | 42 | 161 | 80.7 | TTGATGCGTGCGCTCAATCGAGGA | 1 | 29 | 29 | 13 | 24 25 |
| 105 | 43 | 165 | 80.1 | TTGATGCGAGCCGATGCCATCTTG | 1 | 29 | 36 | 27 | 15 11 |
| 106 | 49 | 186 | 79.1 | TTGACAGCACGGGACCCCTACACG | 1 | 31 | 35 | 32 | 26 30 |
| 107 | 53 | 208 | 80.3 | TTGAGTGCTCCCGCAACGTTGTGC | 1 | 33 | 28 | 21 | 12 33 |
| 108 | 58 | 230 | 76.8 | TTGAACGGGCAAACCTCTTGCTTG | 1 | 35 | 21 | 23 | 11 11 |
| 109 | 59 | 232 | 78.7 | TTGAACGGGATGGCAAGGACCTCA | 1 | 35 | 27 | 21 | 34 13 |
| 110 | 60 | 238 | 81.2 | TTGAAGCCTGTCCGTTTGCGACGG | 1 | 36 | 9 | 12 | 29 35 |
| 111 | 62 | 12961 | 75.5 | TTGAAGCCAGGATCCCAAAGCCTA | 1 | 36 | 25 | 28 | 6 26 |
| 112 | 68 | 270 | 78.4 | TGATTCTGACGGTCCCGCTTACGG | 2 | 8 | 35 | 28 | 17 35 |
| 113 | 70 | 275 | 82.6 | TGATTGTCCACGTGCGGGACACGG | 2 | 9 | 30 | 29 | 34 35 |
| 114 | 76 | 311 | 82.5 | TGATCGAAGTGCCACGCACGCGTT | 2 | 16 | 33 | 30 | 30 12 |
| 115 | 78 | 322 | 78.2 | TGATGGTAACGGCTCAAGCCGCTT | 2 | 18 | 35 | 13 | 36 17 |
| 116 | 81 | 335 | 80.5 | TGATGCAAAGCCGTGCAGCCTCTG | 2 | 21 | 36 | 33 | 36 8 |
| 117 | 84 | 349 | 80.6 | TGATGATGGTGCGCTTAGCCGCAA | 2 | 27 | 33 | 17 | 36 21 |
| 118 | 88 | 361 | 77.3 | TGATTCCCTCCCGGTATCGTACGG | 2 | 28 | 28 | 18 | 10 35 |
| 119 | 89 | 362 | 80.2 | TGATTCCCCACGGAGTGGACCAGC | 2 | 28 | 30 | 20 | 34 31 |
| 120 | 95 | 386 | 80.8 | TGATCACGATCGGGACGCAACACG | 2 | 30 | 24 | 34 | 21 30 |
| 121 | 96 | 388 | 77.8 | TGATCACGTCCCTTGAGACCGCAA | 2 | 30 | 28 | 1 | 32 21 |
| 122 | 98 | 404 | 80.2 | TGATCAGCCACGGGACAGCCAGTG | 2 | 31 | 30 | 34 | 36 22 |
| 123 | 99 | 405 | 76.7 | TGATCAGCGGACTTAGTCCCGTGC | 2 | 31 | 34 | 3 | 28 33 |
| 124 | 100 | 409 | 76.4 | TGATGACCCGAATGATTGTCGCAA | 2 | 32 | 16 | 2 | 9 21 |
| 125 | 101 | 411 | 79.7 | TGATGACCATCGAGCCCACGAGGA | 2 | 32 | 24 | 36 | 30 25 |
| 126 | 105 | 420 | 77.3 | TGATGTGCCGAAGAGTCACGGGAC | 2 | 33 | 16 | 20 | 30 34 |
| 127 | 106 | 421 | 80.4 | TGATGTGCGTCTACGGAGCCTGCG | 2 | 33 | 19 | 35 | 36 29 |
| 128 | 107 | 422 | 79.7 | TGATGTGCGAGTACGGACGGCGTT | 2 | 33 | 20 | 35 | 35 12 |
| 129 | 109 | 426 | 76.6 | TGATGTGCTGCGAAAGAGGATCCC | 2 | 33 | 29 | 6 | 25 28 |
| 130 | 112 | 435 | 78.3 | TGATGGACGACCCGAAGGACCTTG | 2 | 34 | 32 | 16 | 34 11 |
| 131 | 114 | 437 | 80.1 | TGATGGACAGCCGCTTGACCGATG | 2 | 34 | 36 | 17 | 32 27 |
| 132 | 125 | 532 | 76.8 | TTAGGCAATGCGCTGTCCTAACGG | 3 | 21 | 29 | 14 | 26 35 |
| 133 | 126 | 539 | 75.3 | TTAGATCGCACGTCTGCTTGCCAT | 3 | 24 | 30 | 8 | 11 15 |
| 134 | 135 | 599 | 75.7 | TTAGCAGCGCAATACAGGACCACG | 3 | 31 | 21 | 7 | 34 30 |
| 135 | 140 | 627 | 76.2 | TTAGGGACCTGTGTGCCTTGCGTT | 3 | 34 | 14 | 33 | 11 12 |
| 136 | 145 | 636 | 77.2 | TTAGGGACGGACAATCGATGCACG | 3 | 34 | 34 | 4 | 27 30 |
| 137 | 150 | 683 | 76.5 | AATCTCTGCGTTCCTATGCGCAA | 4 | 8 | 12 | 26 | 29 16 |
| 138 | 153 | 714 | 76 | AATCCGTTTCCCATACGATGCGAA | 4 | 12 | 28 | 5 | 27 16 |
| 139 | 157 | 743 | 77.7 | AATCCGAATCTGTCCCTCCCGGAC | 4 | 16 | 8 | 28 | 28 34 |
| 140 | 159 | 748 | 76.5 | AATCCGAAGCAAACGGTGTCGATG | 4 | 16 | 21 | 35 | 9 27 |
| 141 | 161 | 756 | 78.2 | AATCCGAACACGGACCGGACAGTG | 4 | 16 | 30 | 32 | 34 22 |
| 142 | 162 | 762 | 76 | AATCGCTTTTAGGATGCAGCACGG | 4 | 17 | 3 | 27 | 31 35 |
| 143 | 163 | 768 | 75.4 | AATCGCTTCCATCGAAGACCGGTA | 4 | 17 | 15 | 16 | 32 18 |
| 144 | 165 | 793 | 79.6 | AATCGAGTCGAATGCGTCCCAGCC | 4 | 20 | 16 | 29 | 28 36 |
| 145 | 168 | 843 | 76.7 | AATCAGGAACGGCGTTCTTGGCTT | 4 | 25 | 35 | 12 | 11 17 |
| 146 | 171 | 877 | 76.6 | AATCTGCGTCGTTCTGTCCCGATG | 4 | 29 | 10 | 8 | 28 27 |
| 147 | 179 | 919 | 77.2 | AATCCAGCGATGGGACGAGTCGTT | 4 | 31 | 27 | 34 | 20 12 |
| 148 | 189 | 949 | 76.8 | AATCGTGCAGGACTCAGGACTGCG | 4 | 33 | 25 | 13 | 34 29 |
| 149 | 192 | 966 | 78.9 | AATCGGACTGCGCCATACCTGCAA | 4 | 34 | 29 | 15 | 23 21 |
| 150 | 201 | 993 | 78 | AATCAGCCATCGCTGTGCTTGCAA | 4 | 36 | 24 | 14 | 17 21 |
| 151 | 203 | 999 | 79.5 | AATCAGCCGTGCGGTAGACCGGAC | 4 | 36 | 33 | 18 | 32 34 |
| 152 | 205 | 1040 | 79 | ATACGCTTGGACGAGTTGCGGCAA | 5 | 17 | 34 | 20 | 29 21 |
| 153 | 206 | 1047 | 79.6 | ATACGCAAGACCATCGCACGGCAA | 5 | 21 | 32 | 24 | 30 21 |

*FIG. 26D*

```
SEQ    4,633  HEX            ZIPCODE (5'-3')           TETRAMER NUMBERS
ID NO: ID#    ID#    Tm
154    214    1104   77.1   ATACCAGCCTCAAGCCCGAAGTGC   5   31  13  36  16  33
155    218    1122   80.3   ATACGTGCTCGTGCTTTGCGTGCG   5   33  10  17  29  29
156    228    1217   76.3   AAAGCGTTTGTCCTTGGATGCGAA   6   12   9  11  27  16
157    231    1229   77.1   AAAGCTCATCGTGGACCGAAAGCC   6   13  10  34  16  36
158    234    1271   75.1   AAAGCGAACTGTAGTGCAGCACGG   6   16  14  22  31  35
159    242    1333   76.6   AAAGATCGCTTGCTGTACGGCGAA   6   24  11  14  35  16
160    243    1337   76.5   AAAGATCGGGTATGCGCACGTGTC   6   24  18  29  30   9
161    248    1393   76     AAAGTGCGATCGAGGACTCAACGG   6   29  24  25  13  35
162    255    1441   75.6   AAAGGACCGCAACTGTTCGTGCTT   6   32  21  14  10  17
163    264    1474   76.7   AAAGGGACCGAAAGTGCCATGGAC   6   34  16  22  15  34
164    271    1519   80.5   TACACCATTCCCTCCCCAGCGCAA   7   15  28  28  31  21
165    272    1533   81.8   TACATCCCCTTGCGAATGCGTGCG   7   28  11  16  29  29
166    281    1587   76.8   TACAACGGCTGTTCGTTGTCGCAA   7   35  14  10   9  21
167    282    1590   76.1   TACAACGGGCTTTGTCCACGGAGT   7   35  17   9  30  20
168    286    1602   78.6   TACAACGGACGGCCATCCATGCTT   7   35  35  15  15  17
169    289    1620   78.5   TCTGTTGAAGCCCGTTCGAAACGG   8    1  36  12  16  35
170    290    1621   78.2   TCTGTGATTGCGCTTGGGACGATG   8    2  29  11  34  27
171    291    1624   78.6   TCTGAATCTGCGCGAATGTCTGCG   8    4  29  16   9  29
172    292    1625   76.4   TCTGAATCCACGTTAGTGCGCACG   8    4  30   3  29  30
173    298    1650   76.5   TCTGCTTGCTGTGCTTTCCCCCTA   8   11  14  17  28  26
174    299    1651   75.1   TCTGCTTGGCTTAGTGGCTTCACG   8   11  17  22  17  30
175    300    1653   80.1   TCTGCTTGGATGCCATACGGTGCG   8   11  27  15  35  29
176    301    1656   79.8   TCTGCTTGGACCCTGTCACGGCAA   8   11  32  14  30  21
177    304    1670   78.8   TCTGCGTTATCGCACGGAGTGCAA   8   12  24  30  20  21
178    306    1678   79.5   TCTGCGTTAGCCGGACCTGTCACG   8   12  36  34  14  30
179    313    1698   80.3   TCTGCCATGACCGACCTCCCCTTG   8   15  32  32  28  11
180    317    1722   80.4   TCTGCTTTGTCCAGCGCAATCCC    8   17   9  31  21  28
181    321    1733   80     TCTGGCTTGTGCGTCTGTGCCGTT   8   17  33  19  33  12
182    322    1735   76.9   TCTGGGTACGTTCGAATCCCCCAT   8   18  12  16  28  15
183    324    1740   76.5   TCTGGGTAGTGCATCGCGAAGCTT   8   18  33  24  16  17
184    331    1765   79.3   TCTGACCTACGGGTGCCGTTGTGC   8   23  35  33  12  33
185    333    1772   79.4   TCTGATCGTGCGGTCTACGGGTGC   8   24  29  19  35  33
186    335    1776   80.3   TCTGATCGGGACCAGCATCGGACC   8   24  34  31  24  32
187    340    1800   79.3   TCTGTCCCCTGTGACCAGCCGATG   8   28  14  32  36  27
188    346    1811   79.1   TCTGTGCGAAAGGGACCAGCAGGA   8   29   6  34  31  25
189    353    1833   77.3   TCTGCACGACCTTTGATCCCGATG   8   30  23   1  28  27
190    363    1865   82.1   TCTGGTGCAATCGACCCACGCAGC   8   33   4  32  30  31
191    376    1917   77.7   TCTGAGCCGACCTCGTGATGCTTG   8   36  32  10  27  11
192    387    1945   79.7   TGTCTCGTGTGCTCGTGACCGCAA   9   10  33  10  32  21
193    392    1960   77.2   TGTCCGTTTGAGGACGACCATCG    9   12   1  34  32  24
194    393    1961   78.6   TGTCCGTTTGATTCCCCTTGGCAA   9   12   2  28  11  21
195    395    1974   79.8   TGTCCGTTGTGCCGTTCAGCCTGT   9   12  33  12  31  14
196    399    1983   77.6   TGTCCCATTTGAAAAGCAGCTGCG   9   15   1   6  31  29
197    418    2028   75.5   TGTCGCTTACGGATACAGCCGATG   9   17  35   5  36  27
198    422    2035   79     TGTCGGTAGGACATCGGGACCACG   9   18  34  24  34  30
199    425    2049   81.3   TGTCGAGTGCTTGTGCGTGCGACC   9   20  17  33  33  32
200    430    2057   79.5   TGTCGCAACTTGCTTGGTGCTCCC   9   21  11  11  33  28
201    431    2058   77.8   TGTCGCAACCATCACGGTCTGCTT   9   21  15  30  19  17
202    432    2061   76.6   TGTCGCAAGGTAAATCTGCGTCCC   9   21  18   4  29  28
203    443    2094   78.4   TGTCATCGGACCAATCATCGCGAA   9   24  32   4  24  16
204    444    2097   79.5   TGTCAGGACGAATCCCATCGGCAA   9   25  16  28  24  21
```

*FIG. 26E*

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 205 | 448 | 2109 | 76.6 | TGTCGATGCTTGTACATCCCGCAA | 9 | 27 | 11 | 7 | 28 | 21 |
| 206 | 449 | 2114 | 81.9 | TGTCGATGGATGGACCTGCGACGG | 9 | 27 | 27 | 32 | 29 | 35 |
| 207 | 450 | 2115 | 78.3 | TGTCGATGTCCCTCGTGCTTGTGC | 9 | 27 | 28 | 10 | 17 | 33 |
| 208 | 451 | 2116 | 79.2 | TGTCGATGTGCGCCTACAGCATCG | 9 | 27 | 29 | 26 | 31 | 24 |
| 209 | 452 | 2117 | 76.1 | TGTCGATGCACGACCTTTAGCGAA | 9 | 27 | 30 | 23 | 3 | 16 |
| 210 | 464 | 2147 | 75.8 | TGTCTGCGCCTATGATCTTGCAGC | 9 | 29 | 26 | 2 | 11 | 31 |
| 211 | 472 | 2158 | 75.9 | TGTCCACGGCAAAAAGCCTAGACC | 9 | 30 | 21 | 6 | 26 | 32 |
| 212 | 473 | 2163 | 78.8 | TGTCCACGCAGCAATCAGCCTTGA | 9 | 30 | 31 | 4 | 36 | 1 |
| 213 | 476 | 2174 | 79.6 | TGTCCAGCATCGCCATGATGGCTT | 9 | 31 | 24 | 15 | 27 | 17 |
| 214 | 477 | 2176 | 79.2 | TGTCCAGCCAGCCTTGCGAACTGT | 9 | 31 | 31 | 11 | 16 | 14 |
| 215 | 480 | 2181 | 80.9 | TGTCGACCAAAGAGCCAGCCCGAA | 9 | 32 | 6 | 36 | 36 | 16 |
| 216 | 481 | 2185 | 76.4 | TGTCGACCGGTAAGCCGACCATAC | 9 | 32 | 18 | 36 | 32 | 5 |
| 217 | 482 | 2186 | 81.6 | TGTCGACCAGTGCAGCGATGGCAA | 9 | 32 | 22 | 31 | 27 | 21 |
| 218 | 484 | 2189 | 80.6 | TGTCGACCTCCCGACCTCGTCAGC | 9 | 32 | 28 | 32 | 10 | 31 |
| 219 | 485 | 2191 | 79 | TGTCGACCGTGCTGTCAATCCACG | 9 | 32 | 33 | 9 | 4 | 30 |
| 220 | 488 | 2197 | 78.1 | TGTCGTGCTGTCTCGTAGCCCGAA | 9 | 33 | 9 | 10 | 36 | 16 |
| 221 | 495 | 2208 | 77.1 | TGTCGTGCCCTATCTGTGCGGTCT | 9 | 33 | 26 | 8 | 29 | 19 |
| 222 | 497 | 2212 | 79.2 | TGTCGTGCCAGCCCATAGGAATCG | 9 | 33 | 31 | 15 | 25 | 24 |
| 223 | 498 | 2215 | 80.1 | TGTCGGACAAAGTGCGACGGATCG | 9 | 34 | 6 | 29 | 35 | 24 |
| 224 | 499 | 2217 | 77.4 | TGTCGGACCTCAATACGTGCCAGC | 9 | 34 | 13 | 5 | 33 | 31 |
| 225 | 501 | 2219 | 78.4 | TGTCGGACCCATGACCCTCACCAT | 9 | 34 | 15 | 32 | 13 | 15 |
| 226 | 510 | 2234 | 75.9 | TGTCACGGCGTTAAAGTGTCCGAA | 9 | 35 | 12 | 6 | 9 | 16 |
| 227 | 515 | 2247 | 77.9 | TGTCAGCCCTTGCAGCAAAGCTTG | 9 | 36 | 11 | 31 | 6 | 11 |
| 228 | 525 | 2301 | 76.3 | TCGTAAAGACGGTGTCGCAACACG | 10 | 6 | 35 | 9 | 21 | 30 |
| 229 | 537 | 2336 | 77.2 | TCGTCTTGCTTGCGTTATCGCCAT | 10 | 11 | 11 | 12 | 24 | 15 |
| 230 | 545 | 2353 | 76.4 | TCGTCGTTGCAACTCAGGTATGCG | 10 | 12 | 21 | 13 | 18 | 29 |
| 231 | 547 | 2355 | 76.3 | TCGTCGTTAGGAACCTACGGCGAA | 10 | 12 | 25 | 23 | 35 | 16 |
| 232 | 548 | 2359 | 77.1 | TCGTCGTTCACGTACATCGTTGCG | 10 | 12 | 30 | 7 | 10 | 29 |
| 233 | 554 | 2371 | 81 | TCGTCTGTTCGTGACCACGGTGCG | 10 | 14 | 10 | 32 | 35 | 29 |
| 234 | 557 | 2382 | 79.3 | TCGTCCATATCGCAGCCCATCAGC | 10 | 15 | 24 | 31 | 15 | 31 |
| 235 | 560 | 2390 | 78.4 | TCGTCCATGGACCGAAGCAAGACC | 10 | 15 | 34 | 16 | 21 | 32 |
| 236 | 581 | 2470 | 82 | TCGTACCTGTGCCAGCCACGGTGC | 10 | 23 | 33 | 31 | 30 | 33 |
| 237 | 582 | 2475 | 75.7 | TCGTATCGCTGTACCTCGTTTGCG | 10 | 24 | 14 | 23 | 12 | 29 |
| 238 | 588 | 2502 | 75.9 | TCGTCCTAACGGATCGTTGAAGCC | 10 | 26 | 35 | 24 | 1 | 36 |
| 239 | 589 | 2509 | 81.8 | TCGTGATGATCGGTGCACGGTCCC | 10 | 27 | 24 | 33 | 35 | 28 |
| 240 | 591 | 2523 | 77.1 | TCGTTCCCCTCAAGTGGACCACCT | 10 | 28 | 13 | 22 | 32 | 23 |
| 241 | 596 | 2531 | 79.5 | TCGTTCCCAGTGGATGGGACCCAT | 10 | 28 | 22 | 27 | 34 | 15 |
| 242 | 597 | 2534 | 77.9 | TCGTTCCCGATGAGGAACGGTGAT | 10 | 28 | 27 | 25 | 35 | 2 |
| 243 | 599 | 2536 | 80.5 | TCGTTCCCCAGCCGTTGTCTCAGC | 10 | 28 | 31 | 12 | 19 | 31 |
| 244 | 606 | 2549 | 80.7 | TCGTTGCGGCAATGATCCATCACG | 10 | 29 | 21 | 2 | 15 | 30 |
| 245 | 609 | 2555 | 81.8 | TCGTTGCGTCCCCTCAGTGCCTCA | 10 | 29 | 28 | 13 | 33 | 13 |
| 246 | 610 | 2557 | 80.5 | TCGTTGCGCACGTGATCGTTCCAT | 10 | 29 | 30 | 2 | 12 | 15 |
| 247 | 613 | 2560 | 80.9 | TCGTTGCGGTGCTGATGGACATCG | 10 | 29 | 33 | 2 | 34 | 24 |
| 248 | 638 | 2611 | 81.5 | TCGTGACCGACCGATGTCCCAGGA | 10 | 32 | 32 | 27 | 28 | 25 |
| 249 | 649 | 2631 | 80.4 | TCGTGTGCGATGGAGTGTGCCCAT | 10 | 33 | 27 | 20 | 33 | 15 |
| 250 | 650 | 2633 | 78.1 | TCGTGTGCGACCTGATATCGGTGC | 10 | 33 | 32 | 2 | 24 | 33 |
| 251 | 657 | 2649 | 77.5 | TCGTGGACAGGAGATGGCTTGTGC | 10 | 34 | 25 | 27 | 17 | 33 |
| 252 | 663 | 2659 | 81 | TCGTACGGTGATCACGCAGCACGG | 10 | 35 | 2 | 30 | 31 | 35 |
| 253 | 667 | 2674 | 76.2 | TCGTACGGGACAAAGCGTTGTCT | 10 | 35 | 34 | 6 | 12 | 19 |
| 254 | 678 | 2722 | 81.6 | CTTGTGTCGTGCACGGCTGTTGCG | 11 | 9 | 33 | 35 | 14 | 29 |
| 255 | 679 | 2725 | 75.8 | CTTGTCGTCCATAGCCTCCCGGTA | 11 | 10 | 15 | 36 | 28 | 18 |

FIG. 26F

| SEQ ID NO: | 4,633 ID# | H3X ID# | Tm | ZIPCODE (5'-3') | T3TRAMER NUMBERS | | | | | |
|---|---|---|---|---|---|---|---|---|---|---|
| 256 | 692 | 2779 | 79 | CTTGCCATGTCTTGCGGCTTACGG | 11 | 15 | 19 | 29 | 17 | 35 |
| 257 | 695 | 2808 | 76.3 | CTTGGCTTTCGTCCATCTTGGTGC | 11 | 17 | 10 | 15 | 11 | 33 |
| 258 | 711 | 2878 | 79.6 | CTTGAGGAGCTTTGCGCCATGCAA | 11 | 25 | 17 | 29 | 15 | 21 |
| 259 | 721 | 2907 | 77.2 | CTTGTCCCAAAGGCTTGCAATCCC | 11 | 28 | 6 | 17 | 21 | 28 |
| 260 | 726 | 2928 | 75.6 | CTTGTGCGCTTGAAAGCGAATCTG | 11 | 29 | 11 | 6 | 16 | 8 |
| 261 | 727 | 2931 | 77.5 | CTTGTGCGGAGTTGTCAGCCGGTA | 11 | 29 | 20 | 9 | 36 | 18 |
| 262 | 731 | 2945 | 80.3 | CTTGCACGTGTCTCCCAGCCCCAT | 11 | 30 | 9 | 28 | 36 | 15 |
| 263 | 733 | 2948 | 75.6 | CTTGCACGCTGTCGAATTAGCAGC | 11 | 30 | 14 | 16 | 3 | 31 |
| 264 | 749 | 3014 | 78.3 | CTTGGGACACCTCTGTGTGCGCAA | 11 | 34 | 23 | 14 | 33 | 21 |
| 265 | 753 | 3027 | 79.5 | CTTGACGGAGTGACGGCGAACGAA | 11 | 35 | 22 | 35 | 16 | 16 |
| 266 | 759 | 3038 | 78.5 | CTTGAGCCAATCTGCGGCAACCAT | 11 | 36 | 4 | 29 | 21 | 15 |
| 267 | 760 | 3045 | 75 | CTTGAGCCGTCTCCTAATCGAGCC | 11 | 36 | 19 | 26 | 24 | 36 |
| 268 | 762 | 3048 | 78.2 | CTTGAGCCAGTGAAAGTGCGCACG | 11 | 36 | 22 | 6 | 29 | 30 |
| 269 | 773 | 3108 | 80.7 | CGTTTCTGTCGTTCCCGTGCGGAC | 12 | 8 | 10 | 28 | 33 | 34 |
| 270 | 784 | 3142 | 78.7 | CGTTTCGTGTCTGGACCACGTCCC | 12 | 10 | 19 | 34 | 30 | 28 |
| 271 | 809 | 3232 | 79.6 | CGTTGCTTTGCGGATGTCGTACGG | 12 | 17 | 29 | 27 | 10 | 35 |
| 272 | 810 | 3238 | 75.4 | CGTTGGTAAAAGTCGTTCCCAGCC | 12 | 18 | 6 | 10 | 28 | 36 |
| 273 | 811 | 3245 | 80.4 | CGTTGGTACACGCCATCAGCCACG | 12 | 18 | 30 | 15 | 31 | 30 |
| 274 | 832 | 3321 | 78.9 | CGTTCCTACACGCTTGTGCGGACC | 12 | 26 | 30 | 11 | 29 | 32 |
| 275 | 837 | 3349 | 76.4 | CGTTTCCCCGTTGGTAAATCCCAT | 12 | 28 | 12 | 18 | 4 | 15 |
| 276 | 838 | 3351 | 77.5 | CGTTTCCCCATTGTCGAGTCGTT | 12 | 28 | 15 | 9 | 20 | 12 |
| 277 | 843 | 3364 | 79.4 | CGTTTCCCGTGCTGCGAGTGTGAT | 12 | 28 | 33 | 29 | 22 | 2 |
| 278 | 844 | 3366 | 76.1 | CGTTTGCGTTAGAGTGCACGATCG | 12 | 29 | 3 | 22 | 30 | 24 |
| 279 | 857 | 3398 | 77.8 | CGTTCACGCACGTGTCAAAGTCCC | 12 | 30 | 30 | 9 | 6 | 28 |
| 280 | 867 | 3420 | 76.8 | CGTTGACCCTTGGCAATACAACGG | 12 | 32 | 11 | 21 | 7 | 35 |
| 281 | 878 | 3451 | 80.1 | CGTTGTGCACGGCTTGTGTCCGTT | 12 | 33 | 35 | 11 | 9 | 12 |
| 282 | 898 | 3516 | 76.1 | CTCAAAAGTGCGTCGTTGATTGCG | 13 | 6 | 29 | 10 | 2 | 29 |
| 283 | 899 | 3518 | 75.4 | CTCAAAAGGACCTCTGCAGCCGTT | 13 | 6 | 32 | 8 | 31 | 12 |
| 284 | 901 | 3530 | 78.5 | CTCATCGTGCAACGTTGACCACGG | 13 | 10 | 21 | 12 | 32 | 35 |
| 285 | 923 | 3620 | 77.7 | CTCATCCCGGACAGGAGTGCACCT | 13 | 28 | 34 | 25 | 33 | 23 |
| 286 | 961 | 3798 | 80 | CTGTGATGCAGCCGAAATCGCAGC | 14 | 27 | 31 | 16 | 24 | 31 |
| 287 | 965 | 3809 | 77.1 | CTGTTCCCTGCGTTGAGGTATGCG | 14 | 28 | 29 | 1 | 18 | 29 |
| 288 | 972 | 3829 | 79.1 | CTGTTGCGACGGGCAACCATTGAT | 14 | 29 | 35 | 21 | 15 | 2 |
| 289 | 982 | 3856 | 77.2 | CTGTGACCCCATCTTGATCGGCAA | 14 | 32 | 15 | 11 | 24 | 21 |
| 290 | 989 | 3872 | 80.5 | CTGTGTGCATCGGACCACCTTGCG | 14 | 33 | 24 | 32 | 23 | 29 |
| 291 | 991 | 3873 | 77.2 | CTGTGTGCCACGATACGGACCGTT | 14 | 33 | 30 | 5 | 34 | 12 |
| 292 | 993 | 3878 | 77 | CTGTGGACCCTACCATTCCCAGCC | 14 | 34 | 26 | 15 | 28 | 36 |
| 293 | 994 | 3882 | 81 | CTGTGGACCACGGTGCGATGCTCA | 14 | 34 | 30 | 33 | 27 | 13 |
| 294 | 1016 | 3987 | 76.6 | CCATTGTCCAGCTTGAACGGCTGT | 15 | 9 | 31 | 1 | 35 | 14 |
| 295 | 1018 | 3993 | 75.1 | CCATTCGTTCGTCGTTGCTTATCG | 15 | 10 | 10 | 12 | 17 | 24 |
| 296 | 1020 | 3999 | 80.8 | CCATTCGTGAGTCACGTGCGCAGC | 15 | 10 | 20 | 30 | 29 | 31 |
| 297 | 1074 | 4202 | 79.8 | CCATTGCGATACGGACATCGGCAA | 15 | 29 | 5 | 34 | 24 | 21 |
| 298 | 1077 | 4209 | 80 | CCATTGCGCGAAGATGCTCACAGC | 15 | 29 | 16 | 27 | 13 | 31 |
| 299 | 1085 | 4220 | 79.4 | CCATCACGAATCGCTTGTGCGCTT | 15 | 30 | 4 | 17 | 33 | 17 |
| 300 | 1099 | 4243 | 77.3 | CCATCAGCAGCCAAAGGTCTTCCC | 15 | 31 | 36 | 6 | 19 | 28 |
| 301 | 1126 | 14325 | 76.8 | CGAATTGATCCCAATCCGAATCCC | 16 | 1 | 28 | 4 | 16 | 28 |
| 302 | 1129 | 4341 | 77 | CGAATTAGCACGGGTACAGCACGG | 16 | 3 | 30 | 18 | 31 | 35 |
| 303 | 1147 | 30238 | 79.8 | CGAATGTCTCCCGTGCCCATAGCC | 16 | 9 | 28 | 33 | 15 | 36 |
| 304 | 1151 | 4428 | 75.9 | CGAATCGTACCTTGCGGTCTCGTT | 16 | 10 | 23 | 29 | 19 | 12 |
| 305 | 1152 | 14366 | 76.5 | CGAATCGTCCTAAGGATCCCAGCC | 16 | 10 | 26 | 25 | 28 | 36 |
| 306 | 1162 | 4467 | 80.7 | CGAACTCACGTTCACGCGTTTGCG | 16 | 13 | 12 | 30 | 12 | 29 |

FIG. 26G

| SEQ ID NO: | 4,633 ID# | HEX ID# | Tm | ZIPCODE (5'-3') | TETRAMER NUMBERS | | | | |
|---|---|---|---|---|---|---|---|---|---|
| 307 | 1167 | 4480 | 77.4 | CGAACCATTGATCTTGCACGCGTT | 16 | 15 | 2 | 11 | 30 | 12 |
| 308 | 1172 | 4490 | 78.2 | CGAACCATCAGCGACCGTCTAGCC | 16 | 15 | 31 | 32 | 19 | 36 |
| 309 | 1179 | 4518 | 78.4 | CGAAGCTTCTGTTCCCCGTTTCCC | 16 | 17 | 14 | 28 | 12 | 28 |
| 310 | 1200 | 4598 | 76.4 | CGAAATCGACCTTCTGGATGCAGC | 16 | 24 | 23 | 8 | 27 | 31 |
| 311 | 1201 | 4604 | 79 | CGAAATCGACGGGAGTTGTCTGCG | 16 | 24 | 35 | 20 | 9 | 29 |
| 312 | 1221 | 4659 | 76.6 | CGAATGCGGCTTCGTTAAAGCTTG | 16 | 29 | 17 | 12 | 6 | 11 |
| 313 | 1222 | 4660 | 76.6 | CGAATGCGGGTAATACTGCGTCGT | 16 | 29 | 18 | 5 | 29 | 10 |
| 314 | 1249 | 4759 | 76.7 | CGAAGGACGTGCACCTCCTACGAA | 16 | 34 | 33 | 23 | 26 | 16 |
| 315 | 1251 | 4761 | 77.2 | CGAAACGGTTAGCTGTCAGCACGG | 16 | 35 | 3 | 14 | 31 | 35 |
| 316 | 1259 | 4782 | 79.8 | CGAACGGAGCCGTCTCGTTGCTT | 16 | 35 | 36 | 19 | 12 | 17 |
| 317 | 1263 | 4793 | 79.1 | CGAAAGCCGCAAAGTGAATCGTGC | 16 | 36 | 21 | 22 | 4 | 33 |
| 318 | 1284 | 4872 | 76.1 | GCTTTCGTCGAAGTCTCACGCCAT | 17 | 10 | 16 | 19 | 30 | 15 |
| 319 | 1290 | 4896 | 76.5 | GCTTCTTGACGGAGCCTTGACACG | 17 | 11 | 35 | 36 | 1 | 30 |
| 320 | 1375 | 5432 | 77.1 | GTCTCTTGCGTTTGCGCCTAGCAA | 19 | 11 | 12 | 29 | 26 | 21 |
| 321 | 1398 | 5534 | 78.6 | GTCTGTGCGGACCCTAACGGCTCA | 19 | 33 | 34 | 26 | 35 | 13 |
| 322 | 1424 | 5680 | 79 | GAGTGACCCAGCTGTCGGACCACG | 20 | 32 | 31 | 9 | 34 | 30 |
| 323 | 1427 | 5684 | 79.5 | GAGTGTGCCTTGTGCGCGAACGTT | 20 | 33 | 11 | 29 | 16 | 12 |
| 324 | 1439 | 5787 | 80.7 | GCAATACATCCCGGACACGGGCAA | 21 | 7 | 28 | 34 | 35 | 21 |
| 325 | 1454 | 5821 | 78.8 | GCAATCGTGATGGTCTTGCGTCCC | 21 | 10 | 27 | 19 | 29 | 28 |
| 326 | 1462 | 5855 | 78 | GCAACGTTGGACCTTGCTGTTCCC | 21 | 12 | 34 | 11 | 14 | 28 |
| 327 | 1463 | 5859 | 75.3 | GCAACTCAACCTCCATTCGTTCCC | 21 | 13 | 23 | 15 | 10 | 28 |
| 328 | 1465 | 5862 | 80.8 | GCAACTCATGCGCACGTCTGGTGC | 21 | 13 | 29 | 30 | 8 | 33 |
| 329 | 1479 | 5941 | 77.6 | GCAAGCAATTAGCACGCCATCGAA | 21 | 21 | 3 | 30 | 15 | 16 |
| 330 | 1485 | 5962 | 76.9 | GCAAAGTGTCGTTTGATGCGGGAC | 21 | 22 | 10 | 1 | 29 | 34 |
| 331 | 1489 | 5980 | 77.9 | GCAAACCTCTCATGCGTGATTGCG | 21 | 23 | 13 | 29 | 2 | 29 |
| 332 | 1496 | 14968 | 78.2 | GCAAATCGATCGCGAACGAAGGAC | 21 | 24 | 24 | 16 | 16 | 34 |
| 333 | 1499 | 6008 | 75.1 | GCAAATCGAGCCAATCGGTAACCT | 21 | 24 | 36 | 4 | 18 | 23 |
| 334 | 1550 | 6148 | 77.1 | GCAAGGACGTCTTGTCCGTTCACG | 21 | 34 | 19 | 9 | 12 | 30 |
| 335 | 1561 | 6173 | 78.4 | GCAAAGCCCGTTCAGCACCTTCTG | 21 | 36 | 12 | 31 | 23 | 8 |
| 336 | 1580 | 6250 | 76.9 | AGTGCGAACTTGTCTGGGACTGCG | 22 | 16 | 11 | 8 | 34 | 29 |
| 337 | 1632 | 6471 | 75.2 | ACCTTTAGCGTTTGTCTGCGTCCC | 23 | 3 | 12 | 9 | 29 | 28 |
| 338 | 1647 | 6557 | 75.4 | ACCTCGAACCATTACATGCGGCTT | 23 | 16 | 15 | 7 | 29 | 17 |
| 339 | 1650 | 6572 | 76.2 | ACCTGCTTCGAAGTGCCTGTCAGC | 23 | 17 | 16 | 33 | 14 | 31 |
| 340 | 1675 | 6706 | 78.3 | ACCTGTGCTTGACACGATCGCACG | 23 | 33 | 1 | 30 | 24 | 30 |
| 341 | 1700 | 6802 | 76.1 | ATCGAAAGCTCAGTGCGCAAGCTT | 24 | 6 | 13 | 33 | 21 | 17 |
| 342 | 1710 | 6845 | 77.1 | ATCGCTTGTGTCTGCGAGCCTCTG | 24 | 11 | 9 | 29 | 36 | 8 |
| 343 | 1712 | 6850 | 75.7 | ATCGCTTGCGAAAAAGCTGTCCAT | 24 | 11 | 16 | 6 | 14 | 15 |
| 344 | 1724 | 6870 | 75.1 | ATCGCGTTGAGTAGGAGGACGGAC | 24 | 12 | 20 | 25 | 34 | 34 |
| 345 | 1730 | 6882 | 81.7 | ATCGCTCATCTGGTGCGGACGCAA | 24 | 13 | 8 | 33 | 34 | 21 |
| 346 | 1737 | 6903 | 80.1 | ATCGCTGTGATGCGTTACGGCACG | 24 | 14 | 27 | 12 | 35 | 30 |
| 347 | 1743 | 6911 | 77.2 | ATCGCCATAATCCAGCCAGCACCT | 24 | 15 | 4 | 31 | 31 | 23 |
| 348 | 1766 | 6956 | 75.7 | ATCGGCTTCAGCAAAGTCTGCCAT | 24 | 17 | 31 | 6 | 8 | 15 |
| 349 | 1781 | 6994 | 79.4 | ATCGGAGTGGACCACGCTTGGGAC | 24 | 20 | 34 | 30 | 11 | 34 |
| 350 | 1794 | 7018 | 76.4 | ATCGAGTGCTCAAGGAATCGGCAA | 24 | 22 | 13 | 25 | 24 | 21 |
| 351 | 1813 | 7068 | 76.9 | ATCGCCTAGATGTGCGAGGATCCC | 24 | 26 | 27 | 29 | 25 | 28 |
| 352 | 1831 | 7104 | 80.2 | ATCGTCCCAGCCCTGTGATGGTGC | 24 | 28 | 36 | 14 | 27 | 33 |
| 353 | 1877 | 7191 | 76.6 | ATCGGGACTACAATCGCAGCGATG | 24 | 34 | 7 | 24 | 31 | 27 |
| 354 | 1889 | 7213 | 79.4 | ATCGACGGTGTCCGAACCATGCAA | 24 | 35 | 9 | 16 | 15 | 21 |
| 355 | 1904 | 7235 | 76.7 | ATCGAGCCGAGTTTGACGAACACG | 24 | 36 | 20 | 1 | 16 | 30 |
| 356 | 1923 | 7302 | 78.5 | AGGATCGTGACCAGGACAGCACGG | 25 | 10 | 32 | 25 | 31 | 35 |
| 357 | 1940 | 7357 | 78.7 | AGGAGCTTGATGTCCCGCAATCCC | 25 | 17 | 27 | 28 | 21 | 28 |

FIG. 26H

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 358 | 1944 | 7388 | 76.7 | AGGAAGTGGGTAGCAATCCCCACG | 25 | 22 | 18 | 21 | 28 | 30 |
| 359 | 1975 | 7510 | 79.3 | AGGAGTGCGTGCCTTGGACCACCT | 25 | 33 | 33 | 11 | 32 | 23 |
| 360 | 2007 | 7750 | 78.7 | CCTACAGCAGGAGACCGACCGCAA | 26 | 31 | 25 | 32 | 32 | 21 |
| 361 | 2029 | 7882 | 77.9 | GATGCCATGCAACAGCAGGACAGC | 27 | 15 | 21 | 31 | 25 | 31 |
| 362 | 2083 | 8075 | 79.2 | GATGGGACCTTGCACGTCGTCGAA | 27 | 34 | 11 | 30 | 10 | 16 |
| 363 | 2098 | 8128 | 78.2 | TCCCTGATTCCCCGAACGTTGATG | 28 | 2 | 28 | 16 | 12 | 27 |
| 364 | 2128 | 15756 | 76.4 | TCCCTACATGCGTTAGGACCCACG | 28 | 7 | 29 | 3 | 32 | 30 |
| 365 | 2134 | 8207 | 79.3 | TCCCTCTGGATGCACGAATCGTGC | 28 | 8 | 27 | 30 | 4 | 33 |
| 366 | 2158 | 8259 | 79.9 | TCCCCTTGTGCGATCGCTGTCTCA | 28 | 11 | 29 | 24 | 14 | 13 |
| 367 | 2174 | 8284 | 78.8 | TCCCCGTTACGGAGTGGTCTGCAA | 28 | 12 | 35 | 22 | 19 | 21 |
| 368 | 2177 | 8289 | 79.4 | TCCCCTCATACAACGGCCATGCAA | 28 | 13 | 7 | 35 | 15 | 21 |
| 369 | 2179 | 8294 | 76.8 | TCCCCTCACTGTCCTATCCCAGCC | 28 | 13 | 14 | 26 | 28 | 36 |
| 370 | 2183 | 8299 | 75.3 | TCCCCTCACCTAATACACGGCGTT | 28 | 13 | 26 | 5 | 35 | 12 |
| 371 | 2197 | 8327 | 78.3 | TCCCCCATATACGCAACAGCAGCC | 28 | 15 | 5 | 21 | 31 | 36 |
| 372 | 2207 | 8344 | 76.9 | TCCCCGAATGATGCTTCGTTTTGA | 28 | 16 | 2 | 17 | 12 | 1 |
| 373 | 2237 | 8396 | 78.7 | TCCCGGTAGACCCCATGACCACCT | 28 | 18 | 32 | 15 | 32 | 23 |
| 374 | 2243 | 8403 | 78.1 | TCCCGTCTCTGTGATGAGCCCGTT | 28 | 19 | 14 | 27 | 36 | 12 |
| 375 | 2254 | 40508 | 82.8 | TCCCGAGTTGTCGACCCCATTGCG | 28 | 20 | 9 | 32 | 15 | 29 |
| 376 | 2271 | 8440 | 79.1 | TCCCGCAAAGGAGAGTGATGCGAA | 28 | 21 | 25 | 20 | 27 | 16 |
| 377 | 2293 | 8479 | 76.5 | TCCCATCGTGTCTGATAGCCAGCC | 28 | 24 | 9 | 2 | 36 | 36 |
| 378 | 2304 | 8502 | 77.7 | TCCCAGGACTGTTTGACACGGCAA | 28 | 25 | 14 | 1 | 30 | 21 |
| 379 | 2365 | 8592 | 76.3 | TCCCCACGTACAGGACAATCAGCC | 28 | 30 | 7 | 34 | 4 | 36 |
| 380 | 2369 | 8597 | 80 | TCCCCACGGCTTCTTGACCTCGAA | 28 | 30 | 17 | 11 | 23 | 16 |
| 381 | 2403 | 8640 | 80.9 | TCCCGACCGCTTGGGTACCATGTGC | 28 | 32 | 17 | 18 | 15 | 33 |
| 382 | 2421 | 8665 | 77.3 | TCCCGGACTGATCGTTGATGCTTG | 28 | 34 | 2 | 12 | 27 | 11 |
| 383 | 2422 | 8666 | 76.9 | TCCCGGACTTAGCGAACTTGTCCC | 28 | 34 | 3 | 16 | 11 | 28 |
| 384 | 2440 | 8695 | 79.7 | TCCCACGGCGAATGTCCCTACGTT | 28 | 35 | 16 | 9 | 26 | 12 |
| 385 | 2444 | 8703 | 81.8 | TCCCACGGTCCCGAGTGGTAACGG | 28 | 35 | 28 | 20 | 18 | 35 |
| 386 | 2452 | 8710 | 77.1 | TCCCAGCCTACATGTCACGGGATG | 28 | 36 | 7 | 9 | 35 | 27 |
| 387 | 2461 | 8720 | 80.4 | TCCCAGCCGATGGATGATCGGGTA | 28 | 36 | 27 | 27 | 24 | 18 |
| 388 | 2468 | 8728 | 79.2 | TGCGTTGACTTGAGTGACGGCACG | 29 | 1 | 11 | 22 | 35 | 30 |
| 389 | 2471 | 15876 | 76.1 | TGCGTTGAACCTACGGGGACTGAT | 29 | 1 | 23 | 35 | 34 | 2 |
| 390 | 2477 | 40574 | 78.8 | TGCGTGATCGTTCTCACAGCCGAA | 29 | 2 | 12 | 13 | 31 | 16 |
| 391 | 2479 | 8749 | 79.4 | TGCGTGATGTCTCACGCGAACAGC | 29 | 2 | 19 | 30 | 16 | 31 |
| 392 | 2482 | 8752 | 77 | TGCGTGATGATGTGTCCGAAGTGC | 29 | 2 | 27 | 9 | 16 | 33 |
| 393 | 2497 | 8775 | 77.2 | TGCGAATCCTGTTGTCCAGCGTCT | 29 | 4 | 14 | 9 | 31 | 19 |
| 394 | 2503 | 8788 | 75.3 | TGCGATACGTCTGAGTAGCCCGAA | 29 | 5 | 19 | 20 | 36 | 16 |
| 395 | 2507 | 8796 | 76.1 | TGCGAAAGTGATAGCCAGTGGCAA | 29 | 6 | 2 | 36 | 22 | 21 |
| 396 | 2515 | 8808 | 77.9 | TGCGAAAGGTGCAGGAGAGTTCCC | 29 | 6 | 33 | 25 | 20 | 28 |
| 397 | 2517 | 15901 | 77.1 | TGCGTACATCGTACGGCTCACACG | 29 | 7 | 10 | 35 | 13 | 30 |
| 398 | 2520 | 8817 | 78.5 | TGCGTACAGGACTGCGAAAGTGCG | 29 | 7 | 34 | 29 | 6 | 29 |
| 399 | 2546 | 8864 | 75.1 | TGCGTCGTGGTACCTATGTCGCTT | 29 | 10 | 18 | 26 | 9 | 17 |
| 400 | 2578 | 8901 | 76.5 | TGCGCGTTCCTAAAAGCCATCTGT | 29 | 12 | 26 | 6 | 15 | 14 |
| 401 | 2592 | 15912 | 78.2 | TGCGCTCACTCAGACCAAAGGCAA | 29 | 13 | 13 | 32 | 6 | 21 |
| 402 | 2594 | 15913 | 78.7 | TGCGCTCACGAACCATCGTTTTGA | 29 | 13 | 16 | 15 | 12 | 1 |
| 403 | 2595 | 30609 | 77.9 | TGCGCTCAGAGTTTAGCACGACGG | 29 | 13 | 20 | 3 | 30 | 35 |
| 404 | 2599 | 8923 | 79.3 | TGCGCTCAAGCCAGGAGCTTGGTA | 29 | 13 | 36 | 25 | 17 | 18 |
| 405 | 2600 | 8924 | 76.6 | TGCGCTGTTTGAGTGCTCGTATCG | 29 | 14 | 1 | 33 | 10 | 24 |
| 406 | 2608 | 21521 | 76.7 | TGCGCTGTCGTTAGGATCTGTCCC | 29 | 14 | 12 | 25 | 8 | 28 |
| 407 | 2614 | 30613 | 77.9 | TGCGCTGTGAGTCTGTCGAAAGCC | 29 | 14 | 20 | 14 | 16 | 36 |
| 408 | 2624 | 40623 | 77.7 | TGCGCCATCTGTAGCCTGATCAGC | 29 | 15 | 14 | 36 | 2 | 31 |

FIG. 26I

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 409 | 2641 | 8968 | 79.5 | TGCGCGAAGACCACCTCTGTACGG | 29 | 16 | 32 | 23 | 14 | 35 |
| 410 | 2642 | 8970 | 80.4 | TGCGCGAAGGACGCAATTAGTCCC | 29 | 16 | 34 | 21 | 3 | 28 |
| 411 | 2643 | 8973 | 77.3 | TGCGGCTTAATCCTCAGCAACGAA | 29 | 17 | 4 | 13 | 21 | 16 |
| 412 | 2655 | 8991 | 79.4 | TGCGGGTATCTGCTGTGACCCAGC | 29 | 18 | 8 | 14 | 32 | 31 |
| 413 | 2663 | 9004 | 77.7 | TGCGGGTAGATGCCTAGACCGACC | 29 | 18 | 27 | 26 | 32 | 32 |
| 414 | 2687 | 21565 | 80.5 | TGCGGAGTGAGTGCTTCAGCACGG | 29 | 20 | 20 | 17 | 31 | 35 |
| 415 | 2690 | 9040 | 80.1 | TGCGGAGTTGCGAGTGCGAACTGT | 29 | 20 | 29 | 22 | 16 | 14 |
| 416 | 2691 | 30634 | 78.6 | TGCGGAGTCACGTCCCTACAAGCC | 29 | 20 | 30 | 28 | 7 | 36 |
| 417 | 2708 | 9054 | 82.1 | TGCGAGTGAATCGGACGGACGTGC | 29 | 22 | 4 | 34 | 34 | 33 |
| 418 | 2721 | 9070 | 76.7 | TGCGACCTTCTGTACAGTGCTGCG | 29 | 23 | 8 | 7 | 33 | 29 |
| 419 | 2748 | 9104 | 81.3 | TGCGATCGGTGCGAGTTTGAAGCC | 29 | 24 | 33 | 20 | 1 | 36 |
| 420 | 2762 | 40657 | 78.4 | TGCGCCTATTAGAGCCGTGCCTGT | 29 | 26 | 3 | 36 | 33 | 14 |
| 421 | 2763 | 9128 | 77.3 | TGCGCCTAAATCCTGTCTTGCGAA | 29 | 26 | 4 | 14 | 11 | 16 |
| 422 | 2770 | 9139 | 77.3 | TGCGCCTAAGTGCGAAACCTTTGA | 29 | 26 | 22 | 16 | 23 | 1 |
| 423 | 2784 | 9156 | 76.9 | TGCGGATGAGGATTGATCGTTCGT | 29 | 27 | 25 | 1 | 10 | 10 |
| 424 | 2791 | 30649 | 78.8 | TGCGTCCCATACTGATGTGCCACG | 29 | 28 | 5 | 2 | 33 | 30 |
| 425 | 2802 | 9177 | 78 | TGCGTCCCAGGAGTGCTTAGAGCC | 29 | 28 | 25 | 33 | 3 | 36 |
| 426 | 2843 | 9222 | 77.7 | TGCGGACCTTAGCTCACCATTCCC | 29 | 32 | 3 | 13 | 15 | 28 |
| 427 | 2861 | 9247 | 78.9 | TGCGGTGCAGTGGGTATCTGGCTT | 29 | 33 | 22 | 18 | 8 | 17 |
| 428 | 2876 | 9264 | 78.6 | TGCGGGACGGTAACGGTGATCCTA | 29 | 34 | 18 | 35 | 2 | 26 |
| 429 | 2886 | 9275 | 79.1 | TGCGACGGAAAGGGTATGTCACGG | 29 | 35 | 6 | 18 | 9 | 35 |
| 430 | 2904 | 9292 | 77.7 | TGCGAGCCCTGTTTAGGATGTCCC | 29 | 36 | 14 | 3 | 27 | 28 |
| 431 | 3018 | 9551 | 79.4 | CACGGAGTGATGAGCCCTTGCGAA | 30 | 20 | 27 | 36 | 11 | 16 |
| 432 | 3021 | 9556 | 75.2 | CACGGCAAATACTCTGGAGTTGCG | 30 | 21 | 5 | 8 | 20 | 29 |
| 433 | 3045 | 9608 | 77.8 | CACGATCGGCAAATCGTCGTCTTG | 30 | 24 | 21 | 24 | 10 | 11 |
| 434 | 3053 | 9626 | 80 | CACGAGGAAGTGGCAACACGCAGC | 30 | 25 | 22 | 21 | 30 | 31 |
| 435 | 3057 | 9633 | 79 | CACGAGGAGACCCTCACGAATGCG | 30 | 25 | 32 | 13 | 16 | 29 |
| 436 | 3103 | 9728 | 79.9 | CACGCAGCGCTTGCTTTCTGAGGA | 30 | 31 | 17 | 17 | 8 | 25 |
| 437 | 3153 | 9818 | 76.1 | CACGAGCCGGTACGTTGGTAGGAC | 30 | 36 | 18 | 12 | 18 | 34 |
| 438 | 3171 | 9864 | 77.6 | CAGCATACGTGCTCCCAGGAGCAA | 31 | 5 | 33 | 28 | 25 | 21 |
| 439 | 3256 | 10059 | 78.4 | CAGCGAGTCCATGGACAGTGCGAA | 31 | 20 | 15 | 34 | 22 | 16 |
| 440 | 3258 | 10060 | 76.6 | CAGCGAGTGGTAATCGTCCCCTCA | 31 | 20 | 18 | 24 | 28 | 13 |
| 441 | 3273 | 10091 | 80.3 | CAGCAGTGATCGCTTGAGCCTGCG | 31 | 22 | 24 | 11 | 36 | 29 |
| 442 | 3342 | 10220 | 76.4 | CAGCCAGCAAAGCCTAAGGAGCAA | 31 | 31 | 6 | 26 | 25 | 21 |
| 443 | 3343 | 10221 | 77 | CAGCCAGCTACAAGCCAGGACGAA | 31 | 31 | 7 | 36 | 25 | 16 |
| 444 | 3473 | 10530 | 76.7 | GACCGCAAACCTGTCTATCGCGAA | 32 | 21 | 23 | 19 | 24 | 16 |
| 445 | 3492 | 16297 | 76.5 | GACCGATGCGAATACAGACCCGAA | 32 | 27 | 16 | 7 | 32 | 16 |
| 446 | 3493 | 10589 | 78.5 | GACCGATGGAGTGATGGACCACGG | 32 | 27 | 20 | 27 | 32 | 35 |
| 447 | 3501 | 30792 | 79.6 | GACCTCCCGCAAGTCTGGACCGAA | 32 | 28 | 21 | 19 | 34 | 16 |
| 448 | 3653 | 10942 | 75.6 | GTGCGCTTCCTAACGGGATGAAAG | 33 | 17 | 26 | 35 | 27 | 6 |
| 449 | 3678 | 30832 | 77 | GTGCGCAACGTTGCTTTTAGCGTT | 33 | 21 | 12 | 17 | 3 | 12 |
| 450 | 3711 | 11060 | 78.1 | GTGCAGGACCTAAGCCATCGACGG | 33 | 25 | 26 | 36 | 24 | 35 |
| 451 | 3822 | 11330 | 76.4 | GGACCTTGAGGATGTCGATGGCAA | 34 | 11 | 25 | 9 | 27 | 21 |
| 452 | 3920 | 11597 | 77.6 | GGACCAGCCGTTTTGAGATGCCAT | 34 | 31 | 12 | 1 | 27 | 15 |
| 453 | 3967 | 11693 | 79.2 | ACGGTTGATTGAATCGCGTTTGCG | 35 | 1 | 1 | 24 | 12 | 29 |
| 454 | 4057 | 41152 | 78.3 | ACGGCTCAGGACATACCCATTGCG | 35 | 13 | 34 | 5 | 15 | 29 |
| 455 | 4062 | 11897 | 75.6 | ACGGCTGTGGTACTCATCGTTCCC | 35 | 14 | 18 | 13 | 10 | 28 |
| 456 | 4145 | 12041 | 77.8 | ACGGAGTGGCTTGTCTGACCAGCC | 35 | 22 | 17 | 19 | 32 | 36 |
| 457 | 4162 | 30941 | 78 | ACGGATCGTCTGTCTGGACCCGAA | 35 | 24 | 8 | 8 | 32 | 16 |
| 458 | 4174 | 12091 | 75.6 | ACGGAGGATGATACCTCACGGTGC | 35 | 25 | 2 | 23 | 30 | 33 |
| 459 | 4317 | 16775 | 75.8 | AGCCTTAGCCATTCTGCGAACGAA | 36 | 3 | 15 | 8 | 16 | 16 |

FIG. 26J

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 460 | 4348 | 12389 | 75.5 | AGCCTGTCGCAAATACCGTTCGTT | 36 | 9 | 21 | 5 | 12 | 12 |
| 461 | 4352 | 12396 | 75 | AGCCTCGTTTAGTCGTTGCGGTCT | 36 | 10 | 3 | 10 | 29 | 19 |
| 462 | 4446 | 12578 | 76.8 | AGCCGTCTGGACTGATTCTGCACG | 36 | 19 | 34 | 2 | 8 | 30 |
| 463 | 4448 | 12580 | 76.2 | AGCCGAGTTTAGCCTACACGTGCG | 36 | 20 | 3 | 26 | 30 | 29 |
| 464 | 4545 | 12741 | 75.7 | AGCCTGCGTACACTGTCCATTCCC | 36 | 29 | 7 | 14 | 15 | 28 |
| 465 | 4586 | 12811 | 77.8 | AGCCGACCAGCCTTAGGGACGAGT | 36 | 32 | 36 | 3 | 34 | 20 |

FIG. 27A

| SEQ ID NO: | 4,633 ID# | HEX ID# | Tm | ZIPCODE (5'-3') | TETRAMER NUMBERS | | | | |
|---|---|---|---|---|---|---|---|---|---|
| 1 | 3 | 8 | 77.6 | TTGAAATCCAGCGCAAAATCTGCG | 1 | 4 | 31 | 21 | 4 | 29 |
| 2 | 5 | 15 | 77.2 | TTGAAAAGCCTACACGACGGCGAA | 1 | 6 | 26 | 30 | 35 | 16 |
| 3 | 7 | 22 | 76.5 | TTGATCTGCCATACGGGCTTACGG | 1 | 8 | 15 | 35 | 17 | 35 |
| 4 | 15 | 45 | 80.6 | TTGACTTGTCCCCAGCACGGCCAT | 1 | 11 | 28 | 31 | 35 | 15 |
| 5 | 17 | 56 | 80.4 | TTGACGTTGACCAGCCCGTTGCAA | 1 | 12 | 32 | 36 | 12 | 21 |
| 6 | 20 | 72 | 76.4 | TTGACGAAGCTTTCCCCCATGATG | 1 | 16 | 17 | 28 | 15 | 27 |
| 7 | 24 | 90 | 81.2 | TTGAGCAAGGACGACCGCAAACGG | 1 | 21 | 34 | 32 | 21 | 35 |
| 8 | 30 | 126 | 82.4 | TTGAGATGACGGACGGTGCGGCAA | 1 | 27 | 35 | 35 | 29 | 21 |
| 9 | 33 | 140 | 76.3 | TTGATCCCATCGAAAGGGACGATG | 1 | 28 | 24 | 6 | 34 | 27 |
| 10 | 36 | 150 | 80.1 | TTGATGCGTCTGGGACGTGCCTTG | 1 | 29 | 8 | 34 | 33 | 11 |
| 11 | 44 | 166 | 80.3 | TTGACACGTCGTCAGCTCCCGTGC | 1 | 30 | 10 | 31 | 28 | 33 |
| 12 | 48 | 180 | 80 | TTGACAGCCTGTTGCGGTGCGTCT | 1 | 31 | 14 | 29 | 33 | 19 |
| 13 | 52 | 202 | 76.5 | TTGAGTGCGGTACTTGCAGCGATG | 1 | 33 | 18 | 11 | 31 | 27 |
| 14 | 55 | 222 | 81.2 | TTGAACGGTCTGCACGTCCCAGCC | 1 | 35 | 8 | 30 | 28 | 36 |
| 15 | 67 | 269 | 82.2 | TGATTCTGGTGCGTGCCAGCCAGC | 2 | 8 | 33 | 33 | 31 | 31 |
| 16 | 69 | 274 | 76.8 | TGATTGTCGCTTTCTGACGGAGCC | 2 | 9 | 17 | 8 | 35 | 36 |
| 17 | 73 | 294 | 77.9 | TGATCGTTTGCGGGTATCCCTCGT | 2 | 12 | 29 | 18 | 28 | 10 |
| 18 | 75 | 310 | 77.9 | TGATCGAAAGGACAGCAGCCTCCC | 2 | 16 | 25 | 31 | 36 | 28 |
| 19 | 79 | 328 | 76.9 | TGATGCAAGCAACGAACACGCTGT | 2 | 21 | 21 | 16 | 30 | 14 |
| 20 | 92 | 372 | 79.5 | TGATTGCGAGTGGACCATCGCCAT | 2 | 29 | 22 | 32 | 24 | 15 |
| 21 | 94 | 379 | 80 | TGATCACGCTTGCCATGGACGGAC | 2 | 30 | 11 | 15 | 34 | 34 |
| 22 | 104 | 418 | 82 | TGATGTGCCTCAACGGGTGCAGCC | 2 | 33 | 13 | 35 | 33 | 36 |
| 23 | 111 | 431 | 75.6 | TGATGGACCGTTAGCCGATGTTGA | 2 | 34 | 12 | 36 | 27 | 1 |
| 24 | 118 | 444 | 79.5 | TGATACGGAGGAGGACTGCGTGCG | 2 | 35 | 25 | 34 | 29 | 29 |
| 25 | 129 | 555 | 79.9 | TTAGGATGAGCCAGCCTGCGAGCC | 3 | 27 | 36 | 36 | 29 | 36 |
| 26 | 151 | 690 | 77.7 | AATCTCGTCGTTTCCCCTCATGCG | 4 | 10 | 12 | 28 | 13 | 29 |
| 27 | 166 | 805 | 77.4 | AATCGCAACTGTCGTTCACGGTGC | 4 | 21 | 14 | 12 | 30 | 33 |
| 28 | 167 | 842 | 81.4 | AATCAGGACACGCAGCGACCTGCG | 4 | 25 | 30 | 31 | 32 | 29 |
| 29 | 183 | 926 | 76.7 | AATCGACCCTGTGTCTGCTTTGCG | 4 | 32 | 14 | 19 | 17 | 29 |
| 30 | 197 | 983 | 76.9 | AATCAGCCAAAGCGAAGTGCGATG | 4 | 36 | 6 | 16 | 33 | 27 |
| 31 | 216 | 1111 | 76.2 | ATACGACCTCGTGAGTTCCCGCAA | 5 | 32 | 10 | 20 | 28 | 21 |
| 32 | 226 | 1207 | 75.4 | AAAGCTTGACCTATCGAGCCGTGC | 6 | 11 | 23 | 24 | 36 | 33 |
| 33 | 268 | 1503 | 75.5 | AAAGAGCCGCTTGAGTCGAAATCG | 6 | 36 | 17 | 20 | 16 | 24 |
| 34 | 297 | 1649 | 75.7 | TCTGCTTGCTCACCTACCATTGCG | 8 | 11 | 13 | 26 | 15 | 29 |
| 35 | 332 | 1771 | 75 | TCTGATCGCCTAGGTAACGGGGAC | 8 | 24 | 26 | 18 | 35 | 34 |
| 36 | 358 | 1847 | 76.9 | TCTGCAGCGGTACTGTGGACCCAT | 8 | 31 | 18 | 14 | 34 | 15 |
| 37 | 375 | 1912 | 75.8 | TCTGAGCCACCTAATCTCCCACGG | 8 | 36 | 23 | 4 | 28 | 35 |
| 38 | 385 | 1941 | 77.4 | TGTCTCGTTCCCACCTCCATTCCC | 9 | 10 | 28 | 23 | 15 | 28 |
| 39 | 442 | 2093 | 81.4 | TGTCATCGCAGCGAGTCAGCCACG | 9 | 24 | 31 | 20 | 31 | 30 |
| 40 | 445 | 2103 | 77.7 | TGTCCCTAACCTGATGGTGCGCAA | 9 | 26 | 23 | 27 | 33 | 21 |
| 41 | 461 | 2143 | 77.3 | TGTCTGCGGTCTCCATATCGGTGC | 9 | 29 | 19 | 15 | 24 | 33 |
| 42 | 469 | 2154 | 76.2 | TGTCCACGCGTTACCTTGTCGATG | 9 | 30 | 12 | 23 | 9 | 27 |
| 43 | 487 | 2196 | 79.1 | TGTCGTGCTCTGACCTTGCGCTCA | 9 | 33 | 8 | 23 | 29 | 13 |
| 44 | 508 | 2231 | 81.7 | TGTCACGGAATCGTGCTGCGGCTT | 9 | 35 | 4 | 33 | 29 | 17 |
| 45 | 527 | 2307 | 77.4 | TCGTTCTGGCTTGGACGCTTCTCA | 10 | 8 | 17 | 34 | 17 | 13 |
| 46 | 602 | 2543 | 80 | TCGTTGCGTGTCGGACCTTGGATG | 10 | 29 | 9 | 34 | 11 | 27 |
| 47 | 686 | 2755 | 78.3 | CTTGCGTTGATGCGAATCGTCGAA | 11 | 12 | 27 | 16 | 10 | 16 |
| 48 | 973 | 3831 | 77.7 | CTGTCACGCTCAACCTTCCCCGTT | 14 | 30 | 13 | 23 | 28 | 12 |
| 49 | 987 | 3866 | 77.6 | CTGTGTGCCGTTTCGTGTGCAGTG | 14 | 33 | 12 | 10 | 33 | 22 |
| 50 | 1053 | 4127 | 77 | CCATGCAATCCCAGGATGTCGGTA | 15 | 21 | 28 | 25 | 9 | 18 |
| 51 | 1093 | 4232 | 78.7 | CCATCAGCTCTGGCAATGCGGAGT | 15 | 31 | 8 | 21 | 29 | 20 |

FIG. 27B

| SEQ ID NO: | 4,633 ID# | HEX ID# | Tm | ZIPCODE (5'-3') | TETRAMER NUMBERS | | | | |
|---|---|---|---|---|---|---|---|---|---|
| 52 | 1142 | 4394 | 75.4 | CGAATCTGGGTAAGGAAGCCATCG | 16 | 8 | 18 | 25 | 36 | 24 |
| 53 | 1145 | 20638 | 77.7 | CGAATGTCCTGTCCATCGAATGCG | 16 | 9 | 14 | 15 | 16 | 29 |
| 54 | 1159 | 4453 | 75.2 | CGAACGTTTACATGCGTCGTAGCC | 16 | 12 | 7 | 29 | 10 | 36 |
| 55 | 1193 | 4568 | 78.3 | CGAAAGTGAGCCGCAACTTGGGAC | 16 | 22 | 36 | 21 | 11 | 34 |
| 56 | 1246 | 4751 | 78.9 | CGAAGGACAGTGAGTGTGCGCACG | 16 | 34 | 22 | 22 | 29 | 30 |
| 57 | 1560 | 6171 | 75.4 | GCAAAGCCATACCTTGGCTTGCTT | 21 | 36 | 5 | 11 | 17 | 17 |
| 58 | 1641 | 6531 | 75.7 | ACCTCTTGCCTACGAACAGCCGAA | 23 | 11 | 26 | 16 | 31 | 16 |
| 59 | 1655 | 6599 | 78.8 | ACCTGCAAGTGCCCATGTGCCCTA | 23 | 21 | 33 | 15 | 33 | 26 |
| 60 | 1919 | 7289 | 80.1 | AGGATCTGGACCGGACTCCCCGAA | 25 | 8 | 32 | 34 | 28 | 16 |
| 61 | 1982 | 7538 | 78 | AGGAACGGCAGCTACACACGAGCC | 25 | 35 | 31 | 7 | 30 | 36 |
| 62 | 2081 | 8056 | 78.1 | GATGGACCACCTCAGCGCTTGACC | 27 | 32 | 23 | 31 | 17 | 32 |
| 63 | 2105 | 8145 | 77.8 | TCCCTTAGGACCCAGCGTCTGTGC | 28 | 3 | 32 | 31 | 19 | 33 |
| 64 | 2623 | 8944 | 75.5 | TGCGCCATAAAGGACCTTAGCCAT | 29 | 15 | 6 | 32 | 3 | 15 |
| 65 | 2755 | 9114 | 75.8 | TGCGAGGACCATGGTAGGTAAGCC | 29 | 25 | 15 | 18 | 18 | 36 |
| 66 | 12 | 42 | 81.5 | TTGATCGTGGACACGGCACGCTCA | 1 | 10 | 34 | 35 | 30 | 13 |
| 67 | 26 | 94 | 78.2 | TTGAAGTGCAGCCACGAAAGCGAA | 1 | 22 | 31 | 30 | 6 | 16 |
| 68 | 29 | 112 | 79.3 | TTGAATCGGAGTTGCGCGTTGGAC | 1 | 24 | 20 | 29 | 12 | 34 |
| 69 | 82 | 346 | 80.9 | TGATGATGGCTTCAGCTGCGCGAA | 2 | 27 | 17 | 31 | 29 | 16 |
| 70 | 86 | 351 | 79.2 | TGATTCCCTTGAACGGTCCCGGAC | 2 | 28 | 1 | 35 | 28 | 34 |
| 71 | 124 | 521 | 78.3 | TTAGGCAATTGATCCCGACCGTGC | 3 | 21 | 1 | 28 | 32 | 33 |
| 72 | 132 | 567 | 78.2 | TTAGTCCCACGGGATGCGTTGACC | 3 | 28 | 35 | 27 | 12 | 32 |
| 73 | 191 | 962 | 77.5 | AATCGGACATCGAGTGTCCCCAGC | 4 | 34 | 24 | 22 | 28 | 31 |
| 74 | 210 | 1078 | 75.8 | ATACTGCGCGTTCTGTGAGTTGCG | 5 | 29 | 12 | 14 | 20 | 29 |
| 75 | 325 | 1744 | 78.5 | TCTGGTCTGCAATCGTCACGCAGC | 8 | 19 | 21 | 10 | 30 | 31 |
| 76 | 436 | 2073 | 79.4 | TGTCAGTGCACGGCTTCTGTTGCG | 9 | 22 | 30 | 17 | 14 | 29 |
| 77 | 551 | 2365 | 77.2 | TCGTCTCAGCTTGACCGCTTCAGC | 10 | 13 | 17 | 32 | 17 | 31 |
| 78 | 629 | 2593 | 76.7 | TCGTCAGCCCTAATCGACCTGTGC | 10 | 31 | 26 | 24 | 23 | 33 |
| 79 | 644 | 2624 | 75.5 | TCGTGTGCGCTTAATCACGGAATC | 10 | 33 | 17 | 4 | 35 | 4 |
| 80 | 804 | 3213 | 76.4 | CGTTCGAAGTCTCTTGACGGACGG | 12 | 16 | 19 | 11 | 35 | 35 |
| 81 | 836 | 3345 | 75.7 | CGTTTCCCAATCATCGGCAAGTCT | 12 | 28 | 4 | 24 | 21 | 19 |
| 82 | 872 | 3431 | 77.5 | CGTTGTGCTGATGCAAATCGGCTT | 12 | 33 | 2 | 21 | 24 | 17 |
| 83 | 949 | 3748 | 79.9 | CTGTCTTGGTGCGCAAAGGATGCG | 14 | 11 | 33 | 21 | 25 | 29 |
| 84 | 1148 | 4415 | 77.1 | CGAATCGTTTGAGCAAGACCCACG | 16 | 10 | 1 | 21 | 32 | 30 |
| 85 | 1235 | 4695 | 76.7 | CGAACAGCTGCGAATCGTCTAGCC | 16 | 31 | 29 | 4 | 19 | 36 |
| 86 | 1406 | 5575 | 75.8 | GAGTTCGTGCTTACGGCTTGAGCC | 20 | 10 | 17 | 35 | 11 | 36 |
| 87 | 1603 | 6332 | 75.6 | AGTGTCCCGAGTACCTGGACACGG | 22 | 28 | 20 | 23 | 34 | 35 |
| 88 | 2216 | 8362 | 76.3 | TCCCGCTTTGATTCTGTCGTTCGT | 28 | 17 | 2 | 8 | 10 | 10 |
| 89 | 2286 | 8468 | 75 | TCCCACCTGTCTACCTAGCCGACC | 28 | 23 | 19 | 23 | 36 | 32 |
| 90 | 2364 | 8591 | 77.1 | TCCCCACGATACACCTTTGATGCG | 28 | 30 | 5 | 23 | 1 | 29 |
| 91 | 2556 | 30603 | 76.3 | TGCGCTTGATACTGTCGCTTCGAA | 29 | 11 | 5 | 9 | 17 | 16 |
| 92 | 2587 | 8909 | 75.8 | TGCGCTCAATACAGCCTCGTATCG | 29 | 13 | 5 | 36 | 10 | 24 |
| 93 | 2741 | 9095 | 79.8 | TGCGATCGCGAAGCAATGATCGTT | 29 | 24 | 16 | 21 | 2 | 12 |
| 94 | 2793 | 9168 | 77.9 | TGCGTCCCTCTGTGATCACGAGGA | 29 | 28 | 8 | 2 | 30 | 25 |
| 95 | 2821 | 9200 | 80.5 | TGCGCACGAGGAATCGCTTGAGTG | 29 | 30 | 25 | 24 | 11 | 22 |
| 96 | 3120 | 9759 | 76.9 | CACGGTGCTACAGTGCAAAGCACG | 30 | 33 | 7 | 33 | 6 | 30 |

FIG. 28A

| SEQ ID NO: | 4,633 ID# | HEX ID# | Tm | ZIPCODE (5'-3') | TETRAMER NUMBERS | | | | |
|---|---|---|---|---|---|---|---|---|---|
| 1 | 3 | 8 | 77.6 | TTGAAATCCAGCGCAAAATCTGCG | 1 | 4 | 31 | 21 | 4 29 |
| 2 | 5 | 15 | 77.2 | TTGAAAAGCCTACACGACGGCGAA | 1 | 6 | 26 | 30 | 35 16 |
| 3 | 7 | 22 | 76.5 | TTGATCTGCCATACGGGCTTACGG | 1 | 8 | 15 | 35 | 17 35 |
| 4 | 15 | 45 | 80.6 | TTGACTTGTCCCCAGCACGGCCAT | 1 | 11 | 28 | 31 | 35 15 |
| 5 | 17 | 56 | 80.4 | TTGACGTTGACCAGCCCGTTGCAA | 1 | 12 | 32 | 36 | 12 21 |
| 6 | 20 | 72 | 76.4 | TTGACGAAGCTTTCCCCCATGATG | 1 | 16 | 17 | 28 | 15 27 |
| 7 | 24 | 90 | 81.2 | TTGAGCAAGGACGACCGCAAACGG | 1 | 21 | 34 | 32 | 21 35 |
| 8 | 30 | 126 | 82.4 | TTGAGATGACGGACGGTGCGGCAA | 1 | 27 | 35 | 35 | 29 21 |
| 9 | 33 | 140 | 76.3 | TTGATCCCATCGAAAGGGACGATG | 1 | 28 | 24 | 6 | 34 27 |
| 10 | 36 | 150 | 80.1 | TTGATGCGTCTGGGACGTGCCTTG | 1 | 29 | 8 | 34 | 33 11 |
| 11 | 44 | 166 | 80.3 | TTGACACGTCGTCAGCTCCCGTGC | 1 | 30 | 10 | 31 | 28 33 |
| 12 | 48 | 180 | 80 | TTGACAGCCTGTTGCGGTGCGTCT | 1 | 31 | 14 | 29 | 33 19 |
| 13 | 52 | 202 | 76.5 | TTGAGTGCGGTACTTGCAGCGATG | 1 | 33 | 18 | 11 | 31 27 |
| 14 | 55 | 222 | 81.2 | TTGAACGGTCTGCACGTCCCAGCC | 1 | 35 | 8 | 30 | 28 36 |
| 15 | 67 | 269 | 82.2 | TGATTCTGGTGCGTGCCAGCCAGC | 2 | 8 | 33 | 33 | 31 31 |
| 16 | 69 | 274 | 76.8 | TGATTGTCGCTTTCTGACGGAGCC | 2 | 9 | 17 | 8 | 35 36 |
| 17 | 73 | 294 | 77.9 | TGATCGTTTGCGGGTATCCCTCGT | 2 | 12 | 29 | 18 | 28 10 |
| 18 | 75 | 310 | 77.9 | TGATCGAAAGGACAGCAGCCTCCC | 2 | 16 | 25 | 31 | 36 28 |
| 19 | 79 | 328 | 76.9 | TGATGCAAGCAACGAACACGCTGT | 2 | 21 | 21 | 16 | 30 14 |
| 20 | 92 | 372 | 79.5 | TGATTGCGAGTGGACCATCGCCAT | 2 | 29 | 22 | 32 | 24 15 |
| 21 | 94 | 379 | 80 | TGATCACGCTTGCCATGGACGGAC | 2 | 30 | 11 | 15 | 34 34 |
| 22 | 104 | 418 | 82 | TGATGTGCCTCAACGGGTGCAGCC | 2 | 33 | 13 | 35 | 33 36 |
| 23 | 111 | 431 | 75.6 | TGATGGACCGTTAGCCGATGTTGA | 2 | 34 | 12 | 36 | 27 1 |
| 24 | 118 | 444 | 79.5 | TGATACGGAGGAGGACTGCGTGCG | 2 | 35 | 25 | 34 | 28 29 |
| 25 | 129 | 555 | 79.9 | TTAGGATGAGCCAGCCTGCGAGCC | 3 | 27 | 36 | 36 | 29 36 |
| 26 | 151 | 690 | 77.7 | AATCTCGTCGTTTCCCCTCATGCG | 4 | 10 | 12 | 28 | 13 29 |
| 27 | 166 | 805 | 77.4 | AATCGCAACTGTCGTTCACGGTGC | 4 | 21 | 14 | 12 | 30 33 |
| 28 | 167 | 842 | 81.4 | AATCAGGACACGCAGCGACCTGCG | 4 | 25 | 30 | 31 | 32 29 |
| 29 | 183 | 926 | 76.7 | AATCGACCCTGTGTCTGCTTTGCG | 4 | 32 | 14 | 19 | 17 29 |
| 30 | 197 | 983 | 76.9 | AATCAGCCAAAGCGAAGTGCGATG | 4 | 36 | 6 | 16 | 33 27 |
| 31 | 216 | 1111 | 76.2 | ATACGACCTCGTGAGTTCCCGCAA | 5 | 32 | 10 | 20 | 28 21 |
| 32 | 226 | 1207 | 75.4 | AAAGCTTGACCTATCGAGCCGTGC | 6 | 11 | 23 | 24 | 36 33 |
| 33 | 268 | 1503 | 75.5 | AAAGAGCCGCTTGAGTCGAAATCG | 6 | 36 | 17 | 20 | 16 24 |
| 34 | 297 | 1649 | 75.7 | TCTGCTTGCTCACCTACCATTGCG | 8 | 11 | 13 | 26 | 15 29 |
| 35 | 332 | 1771 | 75 | TCTGATCGCCTAGGTAACGGGGAC | 8 | 24 | 26 | 18 | 35 34 |
| 36 | 358 | 1847 | 76.9 | TCTGCAGCGGGTACTGTGGACCCAT | 8 | 31 | 18 | 14 | 34 15 |
| 37 | 375 | 1912 | 75.8 | TCTGAGCCACCTAATCTCCCACGG | 8 | 36 | 23 | 4 | 28 35 |
| 38 | 385 | 1941 | 77.4 | TGTCTCGTTCCCACCTCCATTCCC | 9 | 10 | 28 | 23 | 15 28 |
| 39 | 442 | 2093 | 81.4 | TGTCATCGCAGCGAGTCAGCCACG | 9 | 24 | 31 | 20 | 31 30 |
| 40 | 445 | 2103 | 77.7 | TGTCCCTAACCTGATGGTGCGCAA | 9 | 26 | 23 | 27 | 33 21 |
| 41 | 461 | 2143 | 77.3 | TGTCTGCGGTCTCCATATCGGTGC | 9 | 29 | 19 | 15 | 24 33 |
| 42 | 469 | 2154 | 76.2 | TGTCCACGCGTTACCTTGTCGATG | 9 | 30 | 12 | 23 | 9 27 |
| 43 | 487 | 2196 | 79.1 | TGTCGTGCTCTGACCCTTGCGCTCA | 9 | 33 | 8 | 23 | 29 13 |
| 44 | 508 | 2231 | 81.7 | TGTCACGGAATCGTGCTGCGGCTT | 9 | 35 | 4 | 33 | 29 17 |
| 45 | 527 | 2307 | 77.4 | TCGTTCTGGCTTGGACGCTTCTCA | 10 | 8 | 17 | 34 | 17 13 |
| 46 | 602 | 2543 | 80 | TCGTTGCGTGTCGGACCTTGGATG | 10 | 29 | 9 | 34 | 11 27 |
| 47 | 686 | 2755 | 78.3 | CTTGCGTTGATGCGAATCGTCGAA | 11 | 12 | 27 | 16 | 10 16 |
| 48 | 973 | 3831 | 77.7 | CTGTCACGCTCAACCTTCCCCGTT | 14 | 30 | 13 | 23 | 28 12 |
| 49 | 987 | 3866 | 77.6 | CTGTGTGCCGTTTCGTGTGCAGTG | 14 | 33 | 12 | 10 | 33 22 |
| 50 | 1053 | 4127 | 77 | CCATGCAATCCCAGGATGTCGGTA | 15 | 21 | 28 | 25 | 9 18 |
| 51 | 1093 | 4232 | 78.7 | CCATCAGCTCTGGCAATGCGGAGT | 15 | 31 | 8 | 21 | 29 20 |

FIG. 28B

| SEQ ID NO: | 4,633 ID# | HEX ID# | Tm | ZIPCODE (5'-3') | TETRAMER NUMBERS | | | | | |
|---|---|---|---|---|---|---|---|---|---|---|
| 52 | 1142 | 4394 | 75.4 | CGAATCTGGGTAAGGAAGCCATCG | 16 | 8 | 18 | 25 | 36 | 24 |
| 53 | 1145 | 20638 | 77.7 | CGAATGTCCTGTCCATCGAATGCG | 16 | 9 | 14 | 15 | 16 | 29 |
| 54 | 1159 | 4453 | 75.2 | CGAACGTTTACATGCGTCGTAGCC | 16 | 12 | 7 | 29 | 10 | 36 |
| 55 | 1193 | 4568 | 78.3 | CGAAAGTGAGCCGCAACTTGGGAC | 16 | 22 | 36 | 21 | 11 | 34 |
| 56 | 1246 | 4751 | 78.9 | CGAAGGACAGTGAGTGTGCGCACG | 16 | 34 | 22 | 22 | 29 | 30 |
| 57 | 1560 | 6171 | 75.4 | GCAAAGCCATACCTTGGCTTGCTT | 21 | 36 | 5 | 11 | 17 | 17 |
| 58 | 1641 | 6531 | 75.7 | ACCTCTTGCCTACGAACAGCCGAA | 23 | 11 | 26 | 16 | 31 | 16 |
| 59 | 1655 | 6599 | 78.8 | ACCTGCAAGTGCCCATGTGCCCTA | 23 | 21 | 33 | 15 | 33 | 26 |
| 60 | 1919 | 7289 | 80.1 | AGGATCTGGACCGGACTCCCCGAA | 25 | 8 | 32 | 34 | 28 | 16 |
| 61 | 1982 | 7538 | 78 | AGGAACGGCAGCTACACACGAGCC | 25 | 35 | 31 | 7 | 30 | 36 |
| 62 | 2081 | 8056 | 78.1 | GATGGACCACCTCAGCGCTTGACC | 27 | 32 | 23 | 31 | 17 | 32 |
| 63 | 2105 | 8145 | 77.8 | TCCCTTAGGACCCAGCGTCTGTGC | 28 | 3 | 32 | 31 | 19 | 33 |
| 64 | 2623 | 8944 | 75.5 | TGCGCCATAAAGGACCTTAGCCAT | 29 | 15 | 6 | 32 | 3 | 15 |
| 65 | 2755 | 9114 | 75.8 | TGCGAGGACCATGGTAGGTAAGCC | 29 | 25 | 15 | 18 | 18 | 36 |

FIG. 29A

| SEQ ID NO: | ZIP ID# | 4,633 ID# | HEX ID# | Tm | ZIPCODE (NH2 -> CONH2) | T3TRAMER NUMBERS | | | | "UNALLOWED DIMERS" |
|---|---|---|---|---|---|---|---|---|---|---|
| 4634 | 1 | 3 | 8 | 70.8 | AATCCAGCGCAAAATCTGCG | 4 | 31 | 21 | 4 | 29 | 0 |
| 4635 | 2 | 5 | 15 | 70.4 | AAAGCCTACACGACGGCGAA | 6 | 26 | 30 | 35 | 16 | 0 |
| 4636 | 3 | 7 | 22 | 70.6 | TCTGCCATACGGGCTTACGG | 8 | 15 | 35 | 17 | 35 | 0 |
| 4637 | 4 | 15 | 45 | 74.6 | CTTGTCCCCAGCACGGCCAT | 11 | 28 | 31 | 35 | 15 | 1 |
| 4638 | 5 | 17 | 56 | 74.4 | CGTTGACCAGCCCGTTGCAA | 12 | 32 | 36 | 12 | 21 | 0 |
| 4639 | 6 | 20 | 72 | 69.8 | CGAAGCTTTCCCCCATGATG | 16 | 17 | 28 | 15 | 27 | 0 |
| 4640 | 7 | 24 | 90 | 75.3 | GCAAGGACGACCGCAAACGG | 21 | 34 | 32 | 21 | 35 | 0 |
| 4641 | 8 | 30 | 126 | 76.5 | GATGACGGACGGTGCGGCAA | 27 | 35 | 35 | 29 | 21 | 0 |
| 4642 | 9 | 33 | 140 | 70 | TCCCATCGAAAGGGACGATG | 28 | 24 | 6 | 34 | 27 | 0 |
| 4643 | 10 | 36 | 150 | 74.4 | TGCGTCTGGGACGTGCCTTG | 29 | 8 | 34 | 33 | 11 | 0 |
| 4644 | 11 | 44 | 166 | 74 | CACGTCGTCAGCTCCCGTGC | 30 | 10 | 31 | 28 | 33 | 0 |
| 4645 | 12 | 48 | 180 | 73.8 | CAGCCTGTTGCGGTGCGTCT | 31 | 14 | 29 | 33 | 19 | 0 |
| 4646 | 13 | 52 | 202 | 69.6 | GTGCGGTACTTGCAGCGATG | 33 | 18 | 11 | 31 | 27 | 0 |
| 4647 | 14 | 55 | 222 | 74.7 | ACGGTCTGCACGTCCCAGCC | 35 | 8 | 30 | 28 | 36 | 0 |
| 4648 | 15 | 67 | 269 | 76.9 | TCTGGTGCGTGCCAGCCAGC | 8 | 33 | 33 | 31 | 31 | 0 |
| 4649 | 16 | 69 | 274 | 70.6 | TGTCGCTTTCTGACGGAGCC | 9 | 17 | 8 | 35 | 36 | 0 |
| 4650 | 17 | 73 | 294 | 71.7 | CGTTTGCGGGTATCCCTCGT | 12 | 29 | 18 | 28 | 10 | 0 |
| 4651 | 18 | 75 | 310 | 71.5 | CGAAAGGACAGCAGCCTCCC | 16 | 25 | 31 | 36 | 28 | 0 |
| 4652 | 19 | 79 | 328 | 69.2 | GCAAGCAACGAACACGCTGT | 21 | 21 | 16 | 30 | 14 | 0 |
| 4653 | 20 | 92 | 372 | 73.7 | TGCGAGTGGACCATCGCCAT | 29 | 22 | 32 | 24 | 15 | 0 |
| 4654 | 21 | 94 | 379 | 73.8 | CACGCTTGCCATGGACGGAC | 30 | 11 | 15 | 34 | 34 | 0 |
| 4655 | 22 | 104 | 418 | 75.2 | GTGCCTCAACGGGTGCAGCC | 33 | 13 | 35 | 33 | 36 | 0 |
| 4656 | 23 | 111 | 431 | 68.7 | TGATGGACCGTTAGCCGATG | 2 | 34 | 12 | 36 | 27 | 0 |
| 4657 | 24 | 118 | 444 | 75 | ACGGAGGAGGACTGCGTGCG | 35 | 25 | 34 | 29 | 29 | 0 |
| 4658 | 25 | 129 | 555 | 74.7 | GATGAGCCAGCCTGCGAGCC | 27 | 36 | 36 | 29 | 36 | 0 |
| 4659 | 26 | 151 | 690 | 73.4 | TCGTCGTTTCCCCTCATGCG | 10 | 12 | 28 | 13 | 29 | 1 |
| 4660 | 27 | 166 | 805 | 69.1 | GCAACTGTCGTTCACGGTGC | 21 | 14 | 12 | 30 | 33 | 0 |
| 4661 | 28 | 167 | 842 | 76 | AGGACACGCAGCGACCTGCG | 25 | 30 | 31 | 32 | 29 | 0 |
| 4662 | 29 | 183 | 926 | 68.4 | GACCCTGTGTCTGCTTTGCG | 32 | 14 | 19 | 17 | 29 | 0 |
| 4663 | 30 | 197 | 983 | 70.8 | AGCCAAAGCGAAGTGCGATG | 36 | 6 | 16 | 33 | 27 | 0 |
| 4664 | 31 | 216 | 1111 | 70.2 | GACCTCGTGAGTTCCCGCAA | 32 | 10 | 20 | 28 | 21 | 0 |
| 4665 | 32 | 226 | 1207 | 67.8 | CTTGACCTATCGAGCCGTGC | 11 | 23 | 24 | 36 | 33 | 0 |
| 4666 | 33 | 268 | 1503 | 70 | AGCCGCTTGAGTCGAAATCG | 36 | 17 | 20 | 16 | 24 | 0 |
| 4667 | 34 | 297 | 1649 | 66.3 | CTTGCTCACCTACCATTGCG | 11 | 13 | 26 | 15 | 29 | 0 |
| 4668 | 35 | 332 | 1771 | 67.9 | ATCGCCTAGGTAACGGGGAC | 24 | 26 | 18 | 35 | 34 | 0 |
| 4669 | 36 | 358 | 1847 | 67.5 | CAGCGGTACTGTGGACCCAT | 31 | 18 | 14 | 34 | 15 | 0 |
| 4670 | 37 | 375 | 1912 | 68.5 | AGCCACCTAATCTCCCACGG | 36 | 23 | 4 | 28 | 35 | 0 |
| 4671 | 38 | 385 | 1941 | 71.2 | TCGTTCCCACCTCCATTCCC | 10 | 28 | 23 | 15 | 28 | 0 |
| 4672 | 39 | 442 | 2093 | 73.8 | ATCGCAGCGAGTCAGCCACG | 24 | 31 | 20 | 31 | 30 | 0 |
| 4673 | 40 | 445 | 2103 | 69 | CCTAACCTGATGGTGCGCAA | 26 | 23 | 27 | 33 | 21 | 0 |
| 4674 | 41 | 461 | 2143 | 71 | TGCGGTCTCCATATCGGTGC | 29 | 19 | 15 | 24 | 33 | 0 |
| 4675 | 42 | 469 | 2154 | 67 | CACGCGTTACCTTGTCGATG | 30 | 12 | 23 | 9 | 27 | 0 |
| 4676 | 43 | 487 | 2196 | 69.9 | TGTCGTGCTCTGACCTTGCG | 9 | 33 | 8 | 23 | 29 | 0 |
| 4677 | 44 | 508 | 2231 | 74.6 | ACGGAATCGTGCTGCGGCTT | 35 | 4 | 33 | 29 | 17 | 0 |
| 4678 | 45 | 527 | 2307 | 70.2 | TCGTTCTGGCTTGGACGCTT | 10 | 8 | 17 | 34 | 17 | 0 |
| 4679 | 46 | 602 | 2543 | 72 | TCGTTGCGTGTCGGACCTTG | 10 | 29 | 9 | 34 | 11 | 0 |
| 4680 | 47 | 686 | 2755 | 69.9 | CGTTGATGCGAATCGTCGAA | 12 | 27 | 16 | 10 | 16 | 0 |
| 4681 | 48 | 973 | 3831 | 71.7 | CACGCTCAACCTTCCCCGTT | 30 | 13 | 23 | 28 | 12 | 1 |

FIG. 29B

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 4682 | 49 | 987 | 3866 | 70.1 | CTGTGTGCCGTTTCGTGTGC | 14 | 33 | 12 | 10 | 33 | 0 |
| 4683 | 50 | 1053 | 4127 | 67.7 | CCATGCAATCCCAGGATGTC | 15 | 21 | 28 | 25 | 9 | 0 |
| 4684 | 51 | 1093 | 4232 | 71.8 | CCATCAGCTCTGGCAATGCG | 15 | 31 | 8 | 21 | 29 | 0 |
| 4685 | 52 | 1142 | 4394 | 67.2 | TCTGGGTAAGGAAGCCATCG | 8 | 18 | 25 | 36 | 24 | 0 |
| 4686 | 53 | 1145 | 20638 | 69.4 | TGTCCTGTCCATCGAATGCG | 9 | 14 | 15 | 16 | 29 | 0 |
| 4687 | 54 | 1159 | 4453 | 66.7 | CGAACGTTTACATGCGTCGT | 16 | 12 | 7 | 29 | 10 | 0 |
| 4688 | 55 | 1193 | 4568 | 69.5 | AGTGAGCCGCAACTTGGGAC | 22 | 36 | 21 | 11 | 34 | 0 |
| 4679 | 56 | 1246 | 4751 | 70 | GGACAGTGAGTGTGCGCACG | 34 | 22 | 22 | 29 | 30 | 0 |
| 4690 | 57 | 1560 | 6171 | 66.9 | GCAAAGCCATACCTTGGCTT | 21 | 36 | 5 | 11 | 17 | 0 |
| 4691 | 58 | 1641 | 6531 | 68.6 | CTTGCCTACGAACAGCCGAA | 11 | 26 | 16 | 31 | 16 | 0 |
| 4692 | 59 | 1655 | 6599 | 71.1 | GCAAGTGCCCATGTGCCCTA | 21 | 33 | 15 | 33 | 26 | 0 |
| 4693 | 60 | 1919 | 7289 | 74.1 | TCTGGACCGGACTCCCCGAA | 8 | 32 | 34 | 28 | 16 | 0 |
| 4694 | 61 | 1982 | 7538 | 70.5 | ACGGCAGCTACACACGAGCC | 35 | 31 | 7 | 30 | 36 | 0 |
| 4695 | 62 | 2081 | 8056 | 69.8 | GACCACCTCAGCGCTTGACC | 32 | 23 | 31 | 17 | 32 | 0 |
| 4696 | 63 | 2105 | 8145 | 68.2 | TCCCTTAGGACCCAGCGTCT | 28 | 3 | 32 | 31 | 19 | 0 |
| 4697 | 64 | 2623 | 8944 | 65.5 | TGCGCCATAAAGGACCTTAG | 29 | 15 | 6 | 32 | 3 | 0 |
| 4698 | 65 | 2755 | 9114 | 65.8 | TGCGAGGACCATGGTAGGTA | 29 | 25 | 15 | 18 | 18 | 0 |
| 4699 | 66 | 12 | 42 | 75.8 | TCGTGGACACGGCACGCTCA | 10 | 34 | 35 | 30 | 13 | 0 |
| 4700 | 67 | 26 | 94 | 71.3 | AGTGCAGCCACGAAAGCGAA | 22 | 31 | 30 | 6 | 16 | 0 |
| 4701 | 68 | 29 | 112 | 72.6 | ATCGGAGTTGCGCGTTGGAC | 24 | 20 | 29 | 12 | 34 | 0 |
| 4702 | 69 | 82 | 346 | 74 | GATGGCTTCAGCTGCGCGAA | 27 | 17 | 31 | 29 | 16 | 0 |
| 4703 | 70 | 86 | 351 | 73.6 | TCCCTTGAACGGTCCCGGAC | 28 | 1 | 35 | 28 | 34 | 1 |
| 4704 | 71 | 124 | 521 | 72.8 | GCAATTGATCCCGACCGTGC | 21 | 1 | 28 | 32 | 33 | 0 |
| 4705 | 72 | 132 | 567 | 75.3 | TCCCACGGGATGCGTTGACC | 28 | 35 | 27 | 12 | 32 | 0 |
| 4706 | 73 | 191 | 962 | 69.3 | GGACATCGAGTGTCCCCAGC | 34 | 24 | 22 | 28 | 31 | 1 |
| 4707 | 74 | 210 | 1078 | 73.4 | TGCGCGTTCTGTGAGTTGCG | 29 | 12 | 14 | 20 | 29 | 0 |
| 4708 | 75 | 325 | 1744 | 69.4 | GTCTGCAATCGTCACGCAGC | 19 | 21 | 10 | 30 | 31 | 0 |
| 4709 | 76 | 436 | 2073 | 71.6 | AGTGCACGGCTTCTGTTGCG | 22 | 30 | 17 | 14 | 29 | 0 |
| 4700 | 77 | 551 | 2365 | 68.1 | CTCAGCTTGACCGCTTCAGC | 13 | 17 | 32 | 17 | 31 | 0 |
| 4711 | 78 | 629 | 2593 | 67.6 | CAGCCCTAATCGACCTGTGC | 31 | 26 | 24 | 23 | 33 | 0 |
| 4712 | 79 | 644 | 2624 | 70 | TCGTGTGCGCTTAATCACGG | 10 | 33 | 17 | 4 | 35 | 0 |
| 4713 | 80 | 804 | 3213 | 67.6 | CGAAGTCTCTTGACGGACGG | 16 | 19 | 11 | 35 | 35 | 0 |
| 4714 | 81 | 836 | 3345 | 71.1 | CGTTTCCCAATCATCGGCAA | 12 | 28 | 4 | 24 | 21 | 1 |
| 4715 | 82 | 872 | 3431 | 68.2 | GTGCTGATGCAAAATCGGCTT | 33 | 2 | 21 | 24 | 17 | 0 |
| 4716 | 83 | 949 | 3748 | 74.2 | CTTGGTGCGCAAAGGATGCG | 11 | 33 | 21 | 25 | 29 | 0 |
| 4717 | 84 | 1148 | 4415 | 68.9 | TCGTTTGAGCAAGACCCACG | 10 | 1 | 21 | 32 | 30 | 0 |
| 4718 | 85 | 1235 | 4695 | 68.4 | CGAACAGCTGCGAATCGTCT | 16 | 31 | 29 | 4 | 19 | 0 |
| 4719 | 86 | 1406 | 5575 | 70.8 | TCGTGCTTACGGCTTGAGCC | 10 | 17 | 35 | 11 | 36 | 0 |
| 4720 | 87 | 1603 | 6332 | 69.9 | TCCCGAGTACCTGGACACGG | 28 | 20 | 23 | 34 | 35 | 0 |
| 4721 | 88 | 2216 | 8362 | 67.6 | TCCCGCTTTGATTCTGTCGT | 28 | 17 | 2 | 8 | 10 | 0 |
| 4722 | 89 | 2286 | 8468 | 63.7 | TCCCACCTGTCTACCTAGCC | 28 | 23 | 19 | 23 | 36 | 0 |
| 4723 | 90 | 2364 | 8591 | 65.6 | TCCCCACGATACACCTTTGA | 28 | 30 | 5 | 23 | 1 | 1 |
| 4724 | 91 | 2556 | 30603 | 66.6 | TGCGCTTGATACTGTCGCTT | 29 | 11 | 5 | 9 | 17 | 0 |
| 4725 | 92 | 2587 | 8909 | 68.9 | TGCGCTCAATACAGCCTCGT | 29 | 13 | 5 | 36 | 10 | 0 |
| 4726 | 93 | 2741 | 9095 | 71.9 | TGCGATCGCGAAGCAATGAT | 29 | 24 | 16 | 21 | 2 | 0 |
| 4727 | 94 | 2793 | 9168 | 69.4 | TGCGTCCCTCTGTGATCACG | 29 | 28 | 8 | 2 | 30 | 0 |
| 4728 | 95 | 2821 | 9200 | 74.8 | TGCGCACGAGGAATCGCTTG | 29 | 30 | 25 | 24 | 11 | 0 |
| 4729 | 96 | 3120 | 9759 | 64.8 | GTGCTACAGTGCAAAGCACG | 33 | 7 | 33 | 6 | 30 | 0 |

FIG. 29C

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 4730 | 97 | 6 | 18 | 72.6 | AAAGGGACGTGCGCTTCGAA | 6 | 34 | 33 | 17 | 16 | 0 |
| 4731 | 98 | 8 | 25 | 73.7 | TCTGCACGCGTTGTGCGGTA | 8 | 30 | 12 | 33 | 18 | 0 |
| 4732 | 99 | 9 | 29 | 74.9 | TGTCCCATTCCCCACGCGTT | 9 | 15 | 28 | 30 | 12 | 0 |
| 4733 | 100 | 13 | 43 | 73.6 | TCGTAGCCGGTATGCGACGG | 10 | 36 | 18 | 29 | 35 | 0 |
| 4734 | 101 | 18 | 64 | 73.7 | CCATGCTTCGAAACGGCGAA | 15 | 17 | 16 | 35 | 16 | 0 |
| 4735 | 102 | 21 | 75 | 71.1 | CGAAATCGGCAACCTATGCG | 16 | 24 | 21 | 26 | 29 | 0 |
| 4736 | 103 | 32 | 12925 | 69.6 | TCCCGGTATTAGAGCCCACG | 28 | 18 | 3 | 36 | 30 | 0 |
| 4737 | 104 | 42 | 161 | 75.2 | TGCGTGCGCTCAATCGAGGA | 29 | 29 | 13 | 24 | 25 | 0 |
| 4738 | 105 | 43 | 165 | 74.5 | TGCGAGCCGATGCCATCTTG | 29 | 36 | 27 | 15 | 11 | 0 |
| 4739 | 106 | 49 | 186 | 72.8 | CAGCACGGGACCCCTACACG | 31 | 35 | 32 | 26 | 30 | 0 |
| 4740 | 107 | 53 | 208 | 74 | GTGCTCCCGCAACGTTGTGC | 33 | 28 | 21 | 12 | 33 | 0 |
| 4741 | 108 | 58 | 230 | 69.8 | ACGGGCAAACCTCTTGCTTG | 35 | 21 | 23 | 11 | 11 | 0 |
| 4742 | 109 | 59 | 232 | 71.8 | ACGGGATGGCAAGGACCTCA | 35 | 27 | 21 | 34 | 13 | 0 |
| 4743 | 110 | 60 | 238 | 75 | AGCCTGTCCGTTTGCGACGG | 36 | 9 | 12 | 29 | 35 | 0 |
| 4744 | 111 | 62 | 12961 | 68.4 | AGCCAGGATCCCAAAGCCTA | 36 | 25 | 28 | 6 | 26 | 0 |
| 4745 | 112 | 68 | 270 | 72.7 | TCTGACGGTCCCGCTTACGG | 8 | 35 | 28 | 17 | 35 | 1 |
| 4746 | 113 | 70 | 275 | 77.2 | TGTCCACGTGCGGGACACGG | 9 | 30 | 29 | 34 | 35 | 0 |
| 4747 | 114 | 76 | 311 | 76.8 | CGAAGTGCCACGCACGCGTT | 16 | 33 | 30 | 30 | 12 | 0 |
| 4748 | 115 | 78 | 322 | 71.4 | GGTAACGGCTCAAGCCGCTT | 18 | 35 | 13 | 36 | 17 | 0 |
| 4749 | 116 | 81 | 335 | 74.6 | TGATGCAAAGCCGTGCAGCC | 2 | 21 | 36 | 33 | 36 | 0 |
| 4750 | 117 | 84 | 349 | 73.9 | GATGGTGCGCTTAGCCGCAA | 27 | 33 | 17 | 36 | 21 | 0 |
| 4751 | 118 | 88 | 361 | 71.5 | TCCCTCCCGGTATCGTACGG | 28 | 28 | 18 | 10 | 35 | 0 |
| 4752 | 119 | 89 | 362 | 74.5 | TCCCCACGGAGTGGACCAGC | 28 | 30 | 20 | 34 | 31 | 0 |
| 4753 | 120 | 95 | 386 | 74.7 | CACGATCGGGACGCAACACG | 30 | 24 | 34 | 21 | 30 | 0 |
| 4754 | 121 | 96 | 388 | 71.1 | CACGTCCCTTGAGACCGCAA | 30 | 28 | 1 | 32 | 21 | 0 |
| 4755 | 122 | 98 | 404 | 73.9 | CAGCCACGGGACAGCCAGTG | 31 | 30 | 34 | 36 | 22 | 0 |
| 4756 | 123 | 99 | 405 | 70.1 | CAGCGGACTTAGTCCCGTGC | 31 | 34 | 3 | 28 | 33 | 0 |
| 4757 | 124 | 100 | 409 | 68.6 | GACCCGAATGATTGTCGCAA | 32 | 16 | 2 | 9 | 21 | 0 |
| 4758 | 125 | 101 | 411 | 72.4 | GACCATCGAGCCCACGAGGA | 32 | 24 | 36 | 30 | 25 | 0 |
| 4759 | 126 | 105 | 420 | 69.6 | GTGCCGAAGAGTCACGGGAC | 33 | 16 | 20 | 30 | 34 | 0 |
| 4760 | 127 | 106 | 421 | 73.4 | GTGCGTCTACGGAGCCTGCG | 33 | 19 | 35 | 36 | 29 | 0 |
| 4761 | 128 | 107 | 422 | 72.8 | GTGCGAGTACGGACGGCGTT | 33 | 20 | 35 | 35 | 12 | 0 |
| 4762 | 129 | 109 | 426 | 69.1 | GTGCTGCGAAAGAGGATCCC | 33 | 29 | 6 | 25 | 28 | 0 |
| 4763 | 130 | 112 | 435 | 71 | GGACGACCCGAAGGACCTTG | 34 | 32 | 16 | 34 | 11 | 0 |
| 4764 | 131 | 114 | 437 | 73 | GGACAGCCGCTTGACCGATG | 34 | 36 | 17 | 32 | 27 | 0 |
| 4765 | 132 | 125 | 532 | 71.1 | GCAATGCGCTGTCCTAACGG | 21 | 29 | 14 | 26 | 35 | 0 |
| 4766 | 133 | 126 | 539 | 70.9 | ATCGCACGTCTGCTTGCCAT | 24 | 30 | 8 | 11 | 15 | 0 |
| 4767 | 134 | 135 | 599 | 69.4 | CAGCGCAATACAGGACCACG | 31 | 21 | 7 | 34 | 30 | 0 |
| 4768 | 135 | 140 | 627 | 70.2 | GGACCTGTGTGCCTTGCGTT | 34 | 14 | 33 | 11 | 12 | 0 |
| 4769 | 136 | 145 | 636 | 71.3 | GGACGGACAATCGATGCACG | 34 | 34 | 4 | 27 | 30 | 0 |
| 4770 | 137 | 150 | 683 | 72.2 | TCTGCGTTCCTATGCGCGAA | 8 | 12 | 26 | 29 | 16 | 0 |
| 4771 | 138 | 153 | 714 | 69 | CGTTTCCCATACGATGCGAA | 12 | 28 | 5 | 27 | 16 | 1 |
| 4772 | 139 | 157 | 743 | 71 | CGAATCTGTCCCTCCCGGAC | 16 | 8 | 28 | 28 | 34 | 0 |
| 4773 | 140 | 159 | 748 | 69.4 | CGAAGCAAACGGTGTCGATG | 16 | 21 | 35 | 9 | 27 | 0 |
| 4774 | 141 | 161 | 756 | 71.3 | AATCCGAACACGGACCGGAC | 4 | 16 | 30 | 32 | 34 | 0 |
| 4775 | 142 | 162 | 762 | 68.1 | GCTTTTAGGATGCAGCACGG | 17 | 3 | 27 | 31 | 35 | 0 |
| 4776 | 143 | 163 | 768 | 67.2 | GCTTCCATCGAAGACCGGTA | 17 | 15 | 16 | 32 | 18 | 0 |
| 4777 | 144 | 165 | 793 | 72.1 | GAGTCGAATGCGTCCCAGCC | 20 | 16 | 29 | 28 | 36 | 0 |

FIG. 29D

| SEQ ID NO: | ZIP ID# | 4,633 ID# | H3X ID# Tm | ZIPCOD3 (NH2 -> CONH2) | TETRAMER NUMBERS | | | | | "UNALLOWED DIMERS" |
|---|---|---|---|---|---|---|---|---|---|---|
| 4778 | 145 | 168 | 843 | 70.8 | AGGAACGGCGTTCTTGGCTT | 25 | 35 | 12 | 11 | 17 | 0 |
| 4779 | 146 | 171 | 877 | 72 | TGCGTCGTTCTGTCCCGATG | 29 | 10 | 8 | 28 | 27 | 0 |
| 4780 | 147 | 179 | 919 | 70.3 | CAGCGATGGGACGAGTCGTT | 31 | 27 | 34 | 20 | 12 | 0 |
| 4781 | 148 | 189 | 949 | 68.3 | GTGCAGGACTCAGGACTGCG | 33 | 25 | 13 | 34 | 29 | 0 |
| 4782 | 149 | 192 | 966 | 71.3 | GGACTGCGCCATACCTGCAA | 34 | 29 | 15 | 23 | 21 | 0 |
| 4783 | 150 | 201 | 993 | 72.1 | AGCCATCGCTGTGCTTGCAA | 36 | 24 | 14 | 17 | 21 | 0 |
| 4784 | 151 | 203 | 999 | 74 | AGCCGTGCGGTAGACCGGAC | 36 | 33 | 18 | 32 | 34 | 0 |
| 4785 | 152 | 205 | 1040 | 73.8 | GCTTGGACGAGTTGCGGCAA | 17 | 34 | 20 | 29 | 21 | 0 |
| 4786 | 153 | 206 | 1047 | 74.5 | GCAAGACCATCGCACGGCAA | 21 | 32 | 24 | 30 | 21 | 0 |
| 4787 | 154 | 214 | 1104 | 72.5 | CAGCCTCAAGCCCGAAGTGC | 31 | 13 | 36 | 16 | 33 | 0 |
| 4788 | 155 | 218 | 1122 | 75.3 | GTGCTCGTGCTTTGCGTGCG | 33 | 10 | 17 | 29 | 29 | 0 |
| 4789 | 156 | 228 | 1217 | 68.9 | CGTTTGTCCTTGGATGCGAA | 12 | 9 | 11 | 27 | 16 | 0 |
| 4790 | 157 | 231 | 1229 | 69.8 | CTCATCGTGGACCGAAAGCC | 13 | 10 | 34 | 16 | 36 | 0 |
| 4791 | 158 | 234 | 1271 | 67.1 | CGAACTGTAGTGCAGCACGG | 16 | 14 | 22 | 31 | 35 | 0 |
| 4792 | 159 | 242 | 1333 | 71.3 | ATCGCTTGCTGTACGGCGAA | 24 | 11 | 14 | 35 | 16 | 0 |
| 4793 | 160 | 243 | 1337 | 71 | ATCGGGTATGCGCACGTGTC | 24 | 18 | 29 | 30 | 9 | 0 |
| 4794 | 161 | 248 | 1393 | 71.2 | TGCGATCGAGGACTCAACGG | 29 | 24 | 25 | 13 | 35 | 0 |
| 4795 | 162 | 255 | 1441 | 68.1 | GACCGCAACTGTTCGTGCTT | 32 | 21 | 14 | 10 | 17 | 0 |
| 4796 | 163 | 264 | 1474 | 69.4 | GGACCGAAAGTGCCATGGAC | 34 | 16 | 22 | 15 | 34 | 0 |
| 4797 | 164 | 271 | 1519 | 76.8 | CCATTCCCTCCCCAGCGCAA | 15 | 28 | 28 | 31 | 21 | 0 |
| 4798 | 165 | 272 | 1533 | 78.8 | TCCCCTTGCGAATGCGTGCG | 28 | 11 | 16 | 29 | 29 | 0 |
| 4799 | 166 | 281 | 1587 | 71.8 | ACGGCTGTTCGTTGTCGCAA | 35 | 14 | 10 | 9 | 21 | 0 |
| 4800 | 167 | 282 | 1590 | 71.2 | ACGGGCTTTGTCCACGGAGT | 35 | 17 | 9 | 30 | 20 | 0 |
| 4801 | 168 | 286 | 1602 | 74.2 | ACGGACGGCCATCCATGCTT | 35 | 35 | 15 | 15 | 17 | 0 |
| 4802 | 169 | 289 | 1620 | 72.8 | TTGAAGCCCGTTCGAAACGG | 1 | 36 | 12 | 16 | 35 | 0 |
| 4803 | 170 | 290 | 1621 | 72.1 | TGATTGCGCTTGGGACGATG | 2 | 29 | 11 | 34 | 27 | 0 |
| 4804 | 171 | 291 | 1624 | 71.6 | AATCTGCGCGAATGTCTGCG | 4 | 29 | 16 | 9 | 29 | 0 |
| 4805 | 172 | 292 | 1625 | 69.1 | AATCCACGTTAGTGCGCACG | 4 | 30 | 3 | 29 | 30 | 0 |
| 4806 | 173 | 298 | 1650 | 68.3 | TCTGCTTGCTGTGCTTTCCC | 8 | 11 | 14 | 17 | 28 | 0 |
| 4807 | 174 | 299 | 1651 | 65.8 | CTTGGCTTAGTGGCTTCACG | 11 | 17 | 22 | 17 | 30 | 0 |
| 4808 | 175 | 300 | 1653 | 71.6 | CTTGGATGCCATACGGTGCG | 11 | 27 | 15 | 35 | 29 | 0 |
| 4809 | 176 | 301 | 1656 | 71 | CTTGGACCCTGTCACGGCAA | 11 | 32 | 14 | 30 | 21 | 0 |
| 4810 | 177 | 304 | 1670 | 70 | CGTTATCGCACGGAGTGCAA | 12 | 24 | 30 | 20 | 21 | 0 |
| 4811 | 178 | 306 | 1678 | 70.8 | CGTTAGCCGGACCTGTCACG | 12 | 36 | 34 | 14 | 30 | 0 |
| 4812 | 179 | 313 | 1698 | 72.2 | TCTGCCATGACCGACCTCCC | 8 | 15 | 32 | 32 | 28 | 0 |
| 4813 | 180 | 317 | 1722 | 72.3 | GCTTTGTCCAGCGCAATCCC | 17 | 9 | 31 | 21 | 28 | 0 |
| 4814 | 181 | 321 | 1733 | 71.4 | GCTTGTGCGTCTGTGCCGTT | 17 | 33 | 19 | 33 | 12 | 0 |
| 4815 | 182 | 322 | 1735 | 68.2 | GGTACGTTCGAATCCCCCAT | 18 | 12 | 16 | 28 | 15 | 0 |
| 4816 | 183 | 324 | 1740 | 69.4 | TCTGGGTAGTGCATCGCGAA | 8 | 18 | 33 | 24 | 16 | 0 |
| 4817 | 184 | 331 | 1765 | 72.5 | ACCTACGGGTGCCGTTGTGC | 23 | 35 | 33 | 12 | 33 | 0 |
| 4818 | 185 | 333 | 1772 | 72.5 | ATCGTGCGGTCTACGGGTGC | 24 | 29 | 19 | 35 | 33 | 0 |
| 4819 | 186 | 335 | 1776 | 73.5 | ATCGGGACCAGCATCGGACC | 24 | 34 | 31 | 24 | 32 | 0 |
| 4820 | 187 | 340 | 1800 | 73.1 | TCCCCTGTGACCAGCCGATG | 28 | 14 | 32 | 36 | 27 | 0 |
| 4821 | 188 | 346 | 1811 | 73.2 | TGCGAAAGGGACCAGCAGGA | 29 | 6 | 34 | 31 | 25 | 0 |
| 4822 | 189 | 353 | 1833 | 68 | CACGACCTTTGATCCCGATG | 30 | 23 | 1 | 28 | 27 | 1 |
| 4823 | 190 | 363 | 1865 | 73.9 | GTGCAATCGACCCACGCAGC | 33 | 4 | 32 | 30 | 31 | 0 |
| 4824 | 191 | 376 | 1917 | 70.4 | AGCCGACCTCGTGATGCTTG | 36 | 32 | 10 | 27 | 11 | 0 |
| 4825 | 192 | 387 | 1945 | 73.5 | TCGTGTGCTCGTGACCGCAA | 10 | 33 | 10 | 32 | 21 | 0 |

FIG. 29E

| SEQ ID NO: | ZIP ID# | 4,633 ID# | HEX ID# Tm | ZIPCODE (NH2 -> CONH2) | TETRAMER NUMBERS | | | | "UNALLOWED DIMERS" |
|---|---|---|---|---|---|---|---|---|---|
| 4826 | 193 | 392 | 1960 68.3 | CGTTTTGAGGACGACCATCG | 12 | 1 | 34 | 32 24 | 1 |
| 4827 | 194 | 393 | 1961 70.3 | CGTTTGATTCCCCTTGGCAA | 12 | 2 | 28 | 11 21 | 0 |
| 4828 | 195 | 395 | 1974 72 | TGTCCGTTGTGCCGTTCAGC | 9 | 12 | 33 | 12 31 | 0 |
| 4829 | 196 | 399 | 1983 69.1 | CCATTTGAAAAGCAGCTGCG | 15 | 1 | 6 | 31 29 | 0 |
| 4830 | 197 | 418 | 2028 65.9 | TGTCGCTTACGGATACAGCC | 9 | 17 | 35 | 5 36 | 0 |
| 4831 | 198 | 422 | 2035 69.3 | GGTAGGACATCGGGACCACG | 18 | 34 | 24 | 34 30 | 0 |
| 4832 | 199 | 425 | 2049 71.8 | GAGTGCTTGTGCGTGCGACC | 20 | 17 | 33 | 33 32 | 0 |
| 4833 | 200 | 430 | 2057 70 | GCAACTTGCTTGGTGCTCCC | 21 | 11 | 11 | 33 28 | 0 |
| 4834 | 201 | 431 | 2058 68.9 | TGTCGCAACCATCACGGTCT | 9 | 21 | 15 | 30 19 | 0 |
| 4835 | 202 | 432 | 2061 66.9 | TGTCGCAAGGTAAATCTGCG | 9 | 21 | 18 | 4 29 | 0 |
| 4836 | 203 | 443 | 2094 70.6 | ATCGGACCAATCATCGCGAA | 24 | 32 | 4 | 24 16 | 0 |
| 4837 | 204 | 444 | 2097 71.9 | AGGACGAATCCCATCGGCAA | 25 | 16 | 28 | 24 21 | 0 |
| 4838 | 205 | 448 | 2109 66.4 | GATGCTTGTACATCCCGCAA | 27 | 11 | 7 | 28 21 | 0 |
| 4839 | 206 | 449 | 2114 72.6 | GATGGATGGACCTGCGACGG | 27 | 27 | 32 | 29 35 | 0 |
| 4840 | 207 | 450 | 2115 68.1 | TGTCGATGTCCCTCGTGCTT | 9 | 27 | 28 | 10 17 | 0 |
| 4841 | 208 | 451 | 2116 69.9 | TGTCGATGTGCGCCTACAGC | 9 | 27 | 29 | 26 31 | 0 |
| 4842 | 209 | 452 | 2117 66 | GATGCACGACCTTTAGCGAA | 27 | 30 | 23 | 3 16 | 0 |
| 4843 | 210 | 464 | 2147 69.3 | TGCGCCTATGATCTTGCAGC | 29 | 26 | 2 | 11 31 | 0 |
| 4844 | 211 | 472 | 2158 68.8 | TGTCCACGGCAAAAAGCCTA | 9 | 30 | 21 | 6 26 | 0 |
| 4845 | 212 | 473 | 2163 72.1 | TGTCCACGCAGCAATCAGCC | 9 | 30 | 31 | 4 36 | 0 |
| 4846 | 213 | 476 | 2174 71.2 | CAGCATCGCCATGATGGCTT | 31 | 24 | 15 | 27 17 | 0 |
| 4847 | 214 | 477 | 2176 74.2 | TGTCCAGCCAGCCTTGCAA | 9 | 31 | 31 | 11 16 | 0 |
| 4848 | 215 | 480 | 2181 71.9 | GACCAAAGAGCCAGCCCGAA | 32 | 6 | 36 | 36 16 | 0 |
| 4849 | 216 | 481 | 2185 72.5 | TGTCGACCGGTAAGCCGACC | 9 | 32 | 18 | 36 32 | 0 |
| 4850 | 217 | 482 | 2186 72.1 | GACCAGTGCAGCGATGGCAA | 32 | 22 | 31 | 27 21 | 0 |
| 4851 | 218 | 484 | 2189 71.9 | TGTCGACCTCCCGACCTCGT | 9 | 32 | 28 | 32 10 | 0 |
| 4852 | 219 | 485 | 2191 68.9 | GACCGTGCTGTCAATCCACG | 32 | 33 | 9 | 4 30 | 0 |
| 4853 | 220 | 488 | 2197 68.2 | GTGCTGTCTCGTAGCCCGAA | 33 | 9 | 10 | 36 16 | 0 |
| 4854 | 221 | 495 | 2208 69.7 | TGTCGTGCCCTATCTGTGCG | 9 | 33 | 26 | 8 29 | 0 |
| 4855 | 222 | 497 | 2212 71.5 | TGTCGTGCCAGCCCATAGGA | 9 | 33 | 31 | 15 25 | 0 |
| 4856 | 223 | 498 | 2215 72 | TGTCGGACAAAGTGCGACGG | 9 | 34 | 6 | 29 35 | 0 |
| 4857 | 224 | 499 | 2217 67.4 | GGACCTCAATACGTGCCAGC | 34 | 13 | 5 | 33 31 | 0 |
| 4858 | 225 | 501 | 2219 70.9 | TGTCGGACCCATGACCCTCA | 9 | 34 | 15 | 32 13 | 0 |
| 4859 | 226 | 510 | 2234 67.9 | ACGGCGTTAAAGTGTCCGAA | 35 | 12 | 6 | 9 16 | 0 |
| 4860 | 227 | 515 | 2247 70.2 | AGCCCTTGCAGCAAAGCTTG | 36 | 11 | 31 | 6 11 | 0 |
| 4861 | 228 | 525 | 2301 68.9 | AAAGACGGTGTCGCAACACG | 6 | 35 | 9 | 21 30 | 0 |
| 4862 | 229 | 537 | 2336 68.6 | CTTGCTTGCGTTATCGCCAT | 11 | 11 | 12 | 24 15 | 0 |
| 4863 | 230 | 545 | 2353 67.2 | CGTTGCAACTCAGGTATGCG | 12 | 21 | 13 | 18 29 | 0 |
| 4864 | 231 | 547 | 2355 67.7 | CGTTAGGAACCTACGGCGAA | 12 | 25 | 23 | 35 16 | 0 |
| 4865 | 232 | 548 | 2359 67.9 | CGTTCACGTACATCGTTGCG | 12 | 30 | 7 | 10 29 | 0 |
| 4866 | 233 | 554 | 2371 72.4 | CTGTTCGTGACCACGGTGCG | 14 | 10 | 32 | 35 29 | 0 |
| 4867 | 234 | 557 | 2382 70.8 | CCATATCGCAGCCCATCAGC | 15 | 24 | 31 | 15 31 | 0 |
| 4868 | 235 | 560 | 2390 71.5 | TCGTCCATGGACCGAAGCAA | 10 | 15 | 34 | 16 21 | 0 |
| 4869 | 236 | 581 | 2470 75.6 | ACCTGTGCCAGCCACGGTGC | 23 | 33 | 31 | 30 33 | 0 |
| 4870 | 237 | 582 | 2475 68.4 | ATCGCTGTACCTCGTTTGCC | 24 | 14 | 23 | 12 29 | 0 |
| 4871 | 238 | 588 | 2502 67 | CCTAACGGATCGTTGAAGCC | 26 | 35 | 24 | 1 36 | 0 |
| 4872 | 239 | 589 | 2509 72.6 | TCGTGATGATCGGTGCACGG | 10 | 27 | 24 | 33 35 | 0 |
| 4873 | 240 | 591 | 2523 69 | TCGTTCCCCTCAAGTGGACC | 10 | 28 | 13 | 22 32 | 0 |

FIG. 29F

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 4874 | 241 | 596 | 2531 | 71.3 | TCCCAGTGGATGGGACCCAT | 28 | 22 | 27 | 34 | 15 | 0 |
| 4875 | 242 | 597 | 2534 | 72.4 | TCGTTCCCGATGAGGAACGG | 10 | 28 | 27 | 25 | 35 | 0 |
| 4876 | 243 | 599 | 2536 | 72.6 | TCCCCAGCCGTTGTCTCAGC | 28 | 31 | 12 | 19 | 31 | 0 |
| 4877 | 244 | 606 | 2549 | 72.7 | TGCGGCAATGATCCATCACG | 29 | 21 | 2 | 15 | 30 | 0 |
| 4878 | 245 | 609 | 2555 | 73.9 | TGCGTCCCCTCAGTGCCTCA | 29 | 28 | 13 | 33 | 13 | 0 |
| 4879 | 246 | 610 | 2557 | 72.6 | TCGTTGCGCACGTGATCGTT | 10 | 29 | 30 | 2 | 12 | 0 |
| 4880 | 247 | 613 | 2560 | 72.8 | TGCGGTGCTGATGGACATCG | 29 | 33 | 2 | 34 | 24 | 0 |
| 4881 | 248 | 638 | 2611 | 73 | TCGTGACCGACCGATGTCCC | 10 | 32 | 32 | 27 | 28 | 0 |
| 4882 | 249 | 649 | 2631 | 70.7 | GTGCGATGGAGTGTGCCCAT | 33 | 27 | 20 | 33 | 15 | 0 |
| 4883 | 250 | 650 | 2633 | 68.2 | GTGCGACCTGATATCGGTGC | 33 | 32 | 2 | 24 | 33 | 0 |
| 4884 | 251 | 657 | 2649 | 67.2 | TCGTGGACAGGAGATGGCTT | 10 | 34 | 25 | 27 | 17 | 0 |
| 4885 | 252 | 663 | 2659 | 74.3 | ACGGTGATCACGCAGCACGG | 35 | 2 | 30 | 31 | 35 | 0 |
| 4886 | 253 | 667 | 2674 | 70 | TCGTACGGGACAAAGCGTT | 10 | 35 | 34 | 6 | 12 | 0 |
| 4887 | 254 | 678 | 2722 | 76.4 | TGTCGTGCACGGCTGTTGCG | 9 | 33 | 35 | 14 | 29 | 0 |
| 4888 | 255 | 679 | 2725 | 69.9 | TCGTCCATAGCCTCCCGGTA | 10 | 15 | 36 | 28 | 18 | 0 |
| 4889 | 256 | 692 | 2779 | 71 | CCATGTCTTGCGGCTTACGG | 15 | 19 | 29 | 17 | 35 | 0 |
| 4890 | 257 | 695 | 2808 | 67.6 | GCTTTCGTCCATCTTGGTGC | 17 | 10 | 15 | 11 | 33 | 0 |
| 4891 | 258 | 711 | 2878 | 73.5 | AGGAGCTTTGCGCCATGCAA | 25 | 17 | 29 | 15 | 21 | 0 |
| 4892 | 259 | 721 | 2907 | 71.7 | TCCCAAAGGCTTGCAATCCC | 28 | 6 | 17 | 21 | 28 | 0 |
| 4893 | 260 | 726 | 2928 | 69.7 | CTTGTGCGCTTGAAAGCGAA | 11 | 29 | 11 | 6 | 16 | 0 |
| 4894 | 261 | 727 | 2931 | 71.7 | TGCGGAGTTGTCAGCCGGTA | 29 | 20 | 9 | 36 | 18 | 0 |
| 4895 | 262 | 731 | 2945 | 72.2 | CACGTGTCTCCCAGCCCCAT | 30 | 9 | 28 | 36 | 15 | 0 |
| 4896 | 263 | 733 | 2948 | 66.6 | CACGCTGTCGAATTAGCAGC | 30 | 14 | 16 | 3 | 31 | 0 |
| 4897 | 264 | 749 | 3014 | 69.5 | GGACACCTCTGTGTGCGCAA | 34 | 23 | 14 | 33 | 21 | 0 |
| 4898 | 265 | 753 | 3027 | 73.1 | ACGGAGTGACGGCGAACGAA | 35 | 22 | 35 | 16 | 16 | 0 |
| 4899 | 266 | 759 | 3038 | 72.2 | AGCCAATCTGCGGCAACCAT | 36 | 4 | 29 | 21 | 15 | 0 |
| 4900 | 267 | 760 | 3045 | 68.2 | AGCCGTCTCCTAATCGAGCC | 36 | 19 | 26 | 24 | 36 | 0 |
| 4901 | 268 | 762 | 3048 | 71.6 | AGCCAGTGAAAGTGCGCACG | 36 | 22 | 6 | 29 | 30 | 0 |
| 4902 | 269 | 773 | 3108 | 73.3 | TCTGTCGTTCCCGTGCGGAC | 8 | 10 | 28 | 33 | 34 | 0 |
| 4903 | 270 | 784 | 3142 | 70.5 | TCGTGTCTGGACCACGTCCC | 10 | 19 | 34 | 30 | 28 | 0 |
| 4904 | 271 | 809 | 3232 | 71.4 | CGTTGCTTTGCGGATGTCGT | 12 | 17 | 29 | 27 | 10 | 0 |
| 4905 | 272 | 810 | 3238 | 66.1 | GGTAAAAGTCGTTCCCAGCC | 18 | 6 | 10 | 28 | 36 | 0 |
| 4906 | 273 | 811 | 3245 | 71.4 | GGTACACGCCATCAGCCACG | 18 | 30 | 15 | 31 | 30 | 0 |
| 4907 | 274 | 832 | 3321 | 70.8 | CCTACACGCTTGTGCGGACC | 26 | 30 | 11 | 29 | 32 | 0 |
| 4908 | 275 | 837 | 3349 | 68.6 | TCCCCGTTGGTAAATCCCAT | 28 | 12 | 18 | 4 | 15 | 0 |
| 4909 | 276 | 838 | 3351 | 69.5 | TCCCCCATTGTCGAGTCGTT | 28 | 15 | 9 | 20 | 12 | 0 |
| 4910 | 277 | 843 | 3364 | 74.1 | CGTTTCCCGTGCTGCGAGTG | 12 | 28 | 33 | 29 | 22 | 1 |
| 4911 | 278 | 844 | 3366 | 67.6 | TGCGTTAGAGTGCACGATCG | 29 | 3 | 22 | 30 | 24 | 0 |
| 4912 | 279 | 857 | 3398 | 69 | CACGCACGTGTCAAAGTCCC | 30 | 30 | 9 | 6 | 28 | 1 |
| 4913 | 280 | 867 | 3420 | 67.5 | GACCCTTGGCAATACAACGG | 32 | 11 | 21 | 7 | 35 | 0 |
| 4914 | 281 | 878 | 3451 | 71.1 | GTGCACGGCTTGTGTCCGTT | 33 | 35 | 11 | 9 | 12 | 0 |
| 4915 | 282 | 898 | 3516 | 69.2 | AAAGTGCGTCGTTGATTGCG | 6 | 29 | 10 | 2 | 29 | 0 |
| 4916 | 283 | 899 | 3518 | 68.5 | AAAGGACCTCTGCAGCCGTT | 6 | 32 | 8 | 31 | 12 | 0 |
| 4917 | 284 | 901 | 3530 | 72.8 | TCGTGCAACGTTGACCACGG | 10 | 21 | 12 | 32 | 35 | 0 |
| 4918 | 285 | 923 | 3620 | 71.9 | TCCCGGACAGGAGTGCACCT | 28 | 34 | 25 | 33 | 23 | 0 |
| 4919 | 286 | 961 | 3798 | 73.4 | GATGCAGCCGAAATCGCAGC | 27 | 31 | 16 | 24 | 31 | 0 |
| 4920 | 287 | 965 | 3809 | 71.3 | TCCCTGCGTTGAGGTATGCG | 28 | 29 | 1 | 18 | 29 | 0 |
| 4921 | 288 | 972 | 3829 | 73.7 | TGCGACGGGCAACCATTGAT | 29 | 35 | 21 | 15 | 2 | 0 |

FIG. 29G

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 4922 | 289 | 982 | 3856 | 69.9 | GACCCCATCTTGATCGGCAA | 32 | 15 | 11 | 24 | 21 | 0 |
| 4923 | 290 | 989 | 3872 | 73.8 | GTGCATCGGACCACCTTGCG | 33 | 24 | 32 | 23 | 29 | 0 |
| 4924 | 291 | 991 | 3873 | 70 | GTGCCACGATACGGACCGTT | 33 | 30 | 5 | 34 | 12 | 0 |
| 4925 | 292 | 993 | 3878 | 70 | GGACCCTACCATTCCCAGCC | 34 | 26 | 15 | 28 | 36 | 0 |
| 4926 | 293 | 994 | 3882 | 74.2 | GGACCACGGTGCGATGCTCA | 34 | 30 | 33 | 27 | 13 | 0 |
| 4927 | 294 | 1016 | 3987 | 68.4 | TGTCCAGCTTGAACGGCTGT | 9 | 31 | 1 | 35 | 14 | 0 |
| 4928 | 295 | 1018 | 3993 | 68.2 | CCATTCGTTCGTCGTTGCTT | 15 | 10 | 10 | 12 | 17 | 0 |
| 4929 | 296 | 1020 | 3999 | 73.3 | TCGTGAGTCACGTGCGCAGC | 10 | 20 | 30 | 29 | 31 | 0 |
| 4930 | 297 | 1074 | 4202 | 72.5 | TGCGATACGGACATCGGCAA | 29 | 5 | 34 | 24 | 21 | 0 |
| 4931 | 298 | 1077 | 4209 | 72.6 | TGCGCGAAGATGCTCACAGC | 29 | 16 | 27 | 13 | 31 | 0 |
| 4932 | 299 | 1085 | 4220 | 71.7 | CACGAATCGCTTGTGCGCTT | 30 | 4 | 17 | 33 | 17 | 0 |
| 4933 | 300 | 1099 | 4243 | 69.2 | CAGCAGCCAAAGGTCTTCCC | 31 | 36 | 6 | 19 | 28 | 0 |
| 4934 | 301 | 1126 | 14325 | 68.9 | TTGATCCCAATCCGAATCCC | 1 | 28 | 4 | 16 | 28 | 0 |
| 4935 | 302 | 1129 | 4341 | 69.1 | TTAGCACGGGTACAGCACGG | 3 | 30 | 18 | 31 | 35 | 0 |
| 4936 | 303 | 1147 | 30238 | 72.4 | TGTCTCCCGTGCCCATAGCC | 9 | 28 | 33 | 15 | 36 | 0 |
| 4937 | 304 | 1151 | 4428 | 67.8 | TCGTACCTTGCGGTCTCGTT | 10 | 23 | 29 | 19 | 12 | 0 |
| 4938 | 305 | 1152 | 14366 | 68.5 | TCGTCCTAAGGATCCCAGCC | 10 | 26 | 25 | 28 | 36 | 0 |
| 4939 | 306 | 1162 | 4467 | 72.9 | CTCACGTTCACGCGTTTGCG | 13 | 12 | 30 | 12 | 29 | 0 |
| 4940 | 307 | 1167 | 4480 | 68.9 | CCATTGATCTTGCACGCGTT | 15 | 2 | 11 | 30 | 12 | 0 |
| 4941 | 308 | 1172 | 4490 | 70.3 | CGAACCATCAGCGACCGTCT | 16 | 15 | 31 | 32 | 19 | 0 |
| 4942 | 309 | 1179 | 4518 | 70.4 | GCTTCTGTTCCCGTTTCCC | 17 | 14 | 28 | 12 | 28 | 1 |
| 4943 | 310 | 1200 | 4598 | 67 | ATCGACCTTCTGGATGCAGC | 24 | 23 | 8 | 27 | 31 | 0 |
| 4944 | 311 | 1201 | 4604 | 70.3 | ATCGACGGGAGTTGTCTGCG | 24 | 35 | 20 | 9 | 29 | 0 |
| 4945 | 312 | 1221 | 4659 | 69 | TGCGGCTTCGTTAAAGCTTG | 29 | 17 | 12 | 6 | 11 | 0 |
| 4946 | 313 | 1222 | 4660 | 68.9 | CGAATGCGGGTAATACTGCG | 16 | 29 | 18 | 5 | 29 | 0 |
| 4947 | 314 | 1249 | 4759 | 68.1 | CGAAGGACGTGCACCTCCTA | 16 | 34 | 33 | 23 | 26 | 0 |
| 4948 | 315 | 1251 | 4761 | 68.2 | ACGGTTAGCTGTCAGCACGG | 35 | 3 | 14 | 31 | 35 | 0 |
| 4949 | 316 | 1259 | 4782 | 72 | CGAAACGGAGCCGTCTCGTT | 16 | 35 | 36 | 19 | 12 | 0 |
| 4950 | 317 | 1263 | 4793 | 70.7 | AGCCGCAAAGTGAATCGTGC | 36 | 21 | 22 | 4 | 33 | 0 |
| 4951 | 318 | 1284 | 4872 | 68.3 | TCGTCGAAGTCTCACGCCAT | 10 | 16 | 19 | 30 | 15 | 0 |
| 4952 | 319 | 1290 | 4896 | 68.5 | CTTGACGGAGCCTTGACACG | 11 | 35 | 36 | 1 | 30 | 0 |
| 4953 | 320 | 1375 | 5432 | 72.1 | CTTGCGTTTGCGCCTAGCAA | 11 | 12 | 29 | 26 | 21 | 0 |
| 4954 | 321 | 1398 | 5534 | 72.7 | GTGCGGACCCTAACGGCTCA | 33 | 34 | 26 | 35 | 13 | 0 |
| 4955 | 322 | 1424 | 5680 | 72.8 | GACCCAGCTGTCGGACCACG | 32 | 31 | 9 | 34 | 30 | 0 |
| 4956 | 323 | 1427 | 5684 | 73.7 | GTGCCTTGTGCGCGAACGTT | 33 | 11 | 29 | 16 | 12 | 0 |
| 4957 | 324 | 1439 | 5787 | 73.6 | TACATCCCGGACACGGGCAA | 7 | 28 | 34 | 35 | 21 | 0 |
| 4958 | 325 | 1454 | 5821 | 70.9 | TCGTGATGGTCTTGCGTCCC | 10 | 27 | 19 | 29 | 28 | 0 |
| 4959 | 326 | 1462 | 5855 | 69.7 | CGTTGGACCTTGCTGTTCCC | 12 | 34 | 11 | 14 | 28 | 0 |
| 4960 | 327 | 1463 | 5859 | 66.4 | CTCAACCTCCATTCGTTCCC | 13 | 23 | 15 | 10 | 28 | 0 |
| 4961 | 328 | 1465 | 5862 | 72.6 | CTCATGCGCACGTCTGGTGC | 13 | 29 | 30 | 8 | 33 | 0 |
| 4962 | 329 | 1479 | 5941 | 69.3 | GCAATTAGCACGCCATCGAA | 21 | 3 | 30 | 15 | 16 | 0 |
| 4963 | 330 | 1485 | 5962 | 67.6 | AGTGTCGTTTGATGCGGGAC | 22 | 10 | 1 | 29 | 34 | 0 |
| 4964 | 331 | 1489 | 5980 | 68.8 | ACCTCTCATGCGTGATTGCG | 23 | 13 | 29 | 2 | 29 | 0 |
| 4965 | 332 | 1496 | 14968 | 71.5 | GCAAATCGATCGCGAACGAA | 21 | 24 | 24 | 16 | 16 | 0 |
| 4966 | 333 | 1499 | 6008 | 68.3 | GCAAATCGAGCCAATCGGTA | 21 | 24 | 36 | 4 | 18 | 0 |
| 4967 | 334 | 1550 | 6148 | 68.1 | GGACGTCTTGTCCGTTCACG | 34 | 19 | 9 | 12 | 30 | 0 |
| 4968 | 335 | 1561 | 6173 | 72 | GCAAAGCCCGTTCAGCACCT | 21 | 36 | 12 | 31 | 23 | 0 |
| 4969 | 336 | 1580 | 6250 | 68.5 | CGAACTTGTCTGGGACTGCG | 16 | 11 | 8 | 34 | 29 | 0 |

FIG. 29H

| SEQ ID NO: | ZIP ID# | 4,633 ID# | H3X ID# | Tm | ZIPCODE (NH2 -> CONH2) | TETRAMER NUMBERS | | | | | "UNALLOWED DIMERS" |
|---|---|---|---|---|---|---|---|---|---|---|---|
| 4970 | 337 | 1632 | 6471 | 68.4 | TTAGCGTTTGTCTGCGTCCC | 3 | 12 | 9 | 29 | 28 | 0 |
| 4971 | 338 | 1647 | 6557 | 68.3 | CGAACCATTACATGCGGCTT | 16 | 15 | 7 | 29 | 17 | 0 |
| 4972 | 339 | 1650 | 6572 | 67.9 | GCTTCGAAGTGCCTGTCAGC | 17 | 16 | 33 | 14 | 31 | 0 |
| 4973 | 340 | 1675 | 6706 | 70.1 | GTGCTTGACACGATCGCACG | 33 | 1 | 30 | 24 | 30 | 0 |
| 4974 | 341 | 1700 | 6802 | 69 | ATCGAAAGCTCAGTGCGCAA | 24 | 6 | 13 | 33 | 21 | 0 |
| 4975 | 342 | 1710 | 6845 | 70.6 | ATCGCTTGTGTCTGCGAGCC | 24 | 11 | 9 | 29 | 36 | 0 |
| 4976 | 343 | 1712 | 6850 | 67.6 | ATCGCTTGCGAAAAAGCTGT | 24 | 11 | 16 | 6 | 14 | 0 |
| 4977 | 344 | 1724 | 6870 | 64 | CGTTGAGTAGGAGGACGGAC | 12 | 20 | 25 | 34 | 34 | 0 |
| 4978 | 345 | 1730 | 6882 | 72.1 | CTCATCTGGTGCGGACGCAA | 13 | 8 | 33 | 34 | 21 | 0 |
| 4979 | 346 | 1737 | 6903 | 70.3 | CTGTGATGCGTTACGGCACG | 14 | 27 | 12 | 35 | 30 | 0 |
| 4980 | 347 | 1743 | 6911 | 69.6 | ATCGCCATAATCCAGCCAGC | 24 | 15 | 4 | 31 | 31 | 0 |
| 4981 | 348 | 1766 | 6956 | 65.1 | ATCGGCTTCAGCAAAGTCTG | 24 | 17 | 31 | 6 | 8 | 0 |
| 4982 | 349 | 1781 | 6994 | 70.1 | ATCGGAGTGGACCACGCTTG | 24 | 20 | 34 | 30 | 11 | 0 |
| 4983 | 350 | 1794 | 7018 | 67.8 | AGTGCTCAAGGAATCGGCAA | 22 | 13 | 25 | 24 | 21 | 0 |
| 4984 | 351 | 1813 | 7068 | 67.7 | ATCGCCTAGATGTGCGAGGA | 24 | 26 | 27 | 29 | 25 | 0 |
| 4985 | 352 | 1831 | 7104 | 73.1 | TCCCAGCCCTGTGATGGTGC | 28 | 36 | 14 | 27 | 33 | 0 |
| 4986 | 353 | 1877 | 7191 | 67.2 | ATCGGGACTACAATCGCAGC | 24 | 34 | 7 | 24 | 31 | 0 |
| 4987 | 354 | 1889 | 7213 | 71.2 | ACGGTGTCCGAACCATGCAA | 35 | 9 | 16 | 15 | 21 | 0 |
| 4988 | 355 | 1904 | 7235 | 68.1 | AGCCGAGTTTGACGAACACG | 36 | 20 | 1 | 16 | 30 | 0 |
| 4989 | 356 | 1923 | 7302 | 71.8 | TCGTGACCAGGACAGCACGG | 10 | 32 | 25 | 31 | 35 | 0 |
| 4990 | 357 | 1940 | 7357 | 71.9 | GCTTGATGTCCCGCAATCCC | 17 | 27 | 28 | 21 | 28 | 0 |
| 4991 | 358 | 1944 | 7388 | 69.2 | AGTGGGTAGCAATCCCCACG | 22 | 18 | 21 | 28 | 30 | 0 |
| 4992 | 359 | 1975 | 7510 | 72.4 | GTGCGTGCCTTGGACCACCT | 33 | 33 | 11 | 32 | 23 | 0 |
| 4993 | 360 | 2007 | 7750 | 73.7 | CAGCAGGAGACCGACCGCAA | 31 | 25 | 32 | 32 | 21 | 0 |
| 4994 | 361 | 2029 | 7882 | 69.5 | GATGCCATGCAACAGCAGGA | 27 | 15 | 21 | 31 | 25 | 0 |
| 4995 | 362 | 2083 | 8075 | 71.1 | GGACCTTGCACGTCGTCGAA | 34 | 11 | 30 | 10 | 16 | 0 |
| 4996 | 363 | 2098 | 8128 | 71 | TCCCTGATTCCCCGAACGTT | 28 | 2 | 28 | 16 | 12 | 0 |
| 4997 | 364 | 2128 | 15756 | 66.4 | TACATGCGTTAGGACCCACG | 7 | 29 | 3 | 32 | 30 | 0 |
| 4998 | 365 | 2134 | 8207 | 69.5 | TCTGGATGCACGAATCGTGC | 8 | 27 | 30 | 4 | 33 | 0 |
| 4999 | 366 | 2158 | 8259 | 73 | TCCCCTTGTGCGATCGCTGT | 28 | 11 | 29 | 24 | 14 | 0 |
| 5000 | 367 | 2174 | 8284 | 68.7 | TCCCCGTTACGGAGTGGTCT | 28 | 12 | 35 | 22 | 19 | 0 |
| 5001 | 368 | 2177 | 8289 | 69.5 | TCCCCTCATACAACGGCCAT | 28 | 13 | 7 | 35 | 15 | 0 |
| 5002 | 369 | 2179 | 8294 | 65.6 | TCCCCTCACTGTCCTATCCC | 28 | 13 | 14 | 26 | 28 | 0 |
| 5003 | 370 | 2183 | 8299 | 64.5 | TCCCCTCACCTAATACACGG | 28 | 13 | 26 | 5 | 35 | 0 |
| 5004 | 371 | 2197 | 8327 | 68 | TCCCCCATATACGCAACAGC | 28 | 15 | 5 | 21 | 31 | 0 |
| 5005 | 372 | 2207 | 8344 | 69.8 | TCCCCGAATGATGCTTCGTT | 28 | 16 | 2 | 17 | 12 | 0 |
| 5006 | 373 | 2237 | 8396 | 71.1 | TCCCGGTAGACCCCATGACC | 28 | 18 | 32 | 15 | 32 | 0 |
| 5007 | 374 | 2243 | 8403 | 67.5 | TCCCGTCTCTGTGATGAGCC | 28 | 19 | 14 | 27 | 36 | 0 |
| 5008 | 375 | 2254 | 40508 | 71.7 | TCCCGAGTTGTCGACCCCAT | 28 | 20 | 9 | 32 | 15 | 0 |
| 5009 | 376 | 2271 | 8440 | 67.9 | TCCCGCAAAGGAGAGTGATG | 28 | 21 | 25 | 20 | 27 | 0 |
| 5010 | 377 | 2293 | 8479 | 65.1 | TCCCATCGTGTCTGATAGCC | 28 | 24 | 9 | 2 | 36 | 0 |
| 5011 | 378 | 2304 | 8502 | 65.8 | TCCCAGGACTGTTTGACACG | 28 | 25 | 14 | 1 | 30 | 0 |
| 5012 | 379 | 2365 | 8592 | 64.8 | TCCCCACGTACAGGACAATC | 28 | 30 | 7 | 34 | 4 | 0 |
| 5013 | 380 | 2369 | 8597 | 71.2 | TCCCCACGGCTTCTTGACCT | 28 | 30 | 17 | 11 | 23 | 0 |
| 5014 | 381 | 2403 | 8640 | 71.9 | TCCCGACCGCTTGGTACCAT | 28 | 32 | 17 | 18 | 15 | 0 |
| 5015 | 382 | 2421 | 8665 | 68.3 | TCCCGGACTGATCGTTGATG | 28 | 34 | 2 | 12 | 27 | 0 |
| 5016 | 383 | 2422 | 8666 | 67.5 | TCCCGGACTTAGCGAACTTG | 28 | 34 | 3 | 16 | 11 | 0 |
| 5017 | 384 | 2440 | 8695 | 72.8 | TCCCACGGCGAATGTCCCTA | 28 | 35 | 16 | 9 | 26 | 0 |

FIG. 29I

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 5018 | 385 | 2444 | 8703 | 72.6 | TCCCACGGTCCCGAGTGGTA | 28 | 35 28 20 18 | | | 1 |
| 5019 | 386 | 2452 | 8710 | 68.5 | TCCCAGCCTACATGTCACGG | 28 | 36 7 9 35 | | | 0 |
| 5020 | 387 | 2461 | 8720 | 73.1 | TCCCAGCCGATGGATGATCG | 28 | 36 27 27 24 | | | 0 |
| 5021 | 388 | 2468 | 8728 | 67.1 | TGCGTTGACTTGAGTGACGG | 29 | 1 11 22 35 | | | 0 |
| 5022 | 389 | 2471 | 15876 | 70.2 | TGCGTTGAACCTACGGGGAC | 29 | 1 23 35 34 | | | 0 |
| 5023 | 390 | 2477 | 40574 | 67.2 | TGCGTGATCGTTCTCACAGC | 29 | 2 12 13 31 | | | 0 |
| 5024 | 391 | 2479 | 8749 | 71.1 | TGCGTGATGTCTCACGCGAA | 29 | 2 19 30 16 | | | 0 |
| 5025 | 392 | 2482 | 8752 | 68.1 | TGCGTGATGATGTGTCCGAA | 29 | 2 27 9 16 | | | 0 |
| 5026 | 393 | 2497 | 8775 | 68.8 | TGCGAATCCTGTTGTCCAGC | 29 | 4 14 9 31 | | | 0 |
| 5027 | 394 | 2503 | 8788 | 63.4 | TGCGATACGTCTGAGTAGCC | 29 | 5 19 20 36 | | | 0 |
| 5028 | 395 | 2507 | 8796 | 64.2 | TGCGAAAGTGATAGCCAGTG | 29 | 6 2 36 22 | | | 0 |
| 5029 | 396 | 2515 | 8808 | 67.7 | TGCGAAAGGTGCAGGAGAGT | 29 | 6 33 25 20 | | | 0 |
| 5030 | 397 | 2517 | 15901 | 67.9 | TGCGTACATCGTACGGCTCA | 29 | 7 10 35 13 | | | 0 |
| 5031 | 398 | 2520 | 8817 | 66.9 | TGCGTACAGGACTGCGAAAG | 29 | 7 34 29 6 | | | 0 |
| 5032 | 399 | 2546 | 8864 | 63.6 | TGCGTCGTGGTACCTATGTC | 29 | 10 18 26 9 | | | 0 |
| 5033 | 400 | 2578 | 8901 | 70.5 | TGCGCGTTCCTAAAAGCCAT | 29 | 12 26 6 15 | | | 0 |
| 5034 | 401 | 2592 | 15912 | 66.6 | TGCGCTCACTCAGACCAAAG | 29 | 13 13 32 6 | | | 0 |
| 5035 | 402 | 2594 | 15913 | 71.7 | TGCGCTCACGAACCATCGTT | 29 | 13 16 15 12 | | | 0 |
| 5036 | 403 | 2595 | 30609 | 67.2 | TGCGCTCAGAGTTTAGCACG | 29 | 13 20 3 30 | | | 0 |
| 5037 | 404 | 2599 | 8923 | 72.8 | TGCGCTCAAGCCAGGAGCTT | 29 | 13 36 25 17 | | | 0 |
| 5038 | 405 | 2600 | 8924 | 69.7 | TGCGCTGTTTGAGTGCTCGT | 29 | 14 1 33 10 | | | 0 |
| 5039 | 406 | 2608 | 21521 | 66.7 | TGCGCTGTCGTTAGGATCTG | 29 | 14 12 25 8 | | | 0 |
| 5040 | 407 | 2614 | 30613 | 67.8 | TGCGCTGTGAGTCTGTCGAA | 29 | 14 20 14 16 | | | 0 |
| 5041 | 408 | 2624 | 40623 | 68.6 | TGCGCCATCTGTAGCCTGAT | 29 | 15 14 36 2 | | | 0 |
| 5042 | 409 | 2641 | 8968 | 70.9 | TGCGCGAAGACCACCTCTGT | 29 | 16 32 23 14 | | | 0 |
| 5043 | 410 | 2642 | 8970 | 71.8 | TGCGCGAAGGACGCAATTAG | 29 | 16 34 21 3 | | | 0 |
| 5044 | 411 | 2643 | 8973 | 69 | TGCGGCTTAATCCTCAGCAA | 29 | 17 4 13 21 | | | 0 |
| 5045 | 412 | 2655 | 8991 | 68.6 | TGCGGGTATCTGCTGTGACC | 29 | 18 8 14 32 | | | 0 |
| 5046 | 413 | 2663 | 9004 | 67.3 | TGCGGGTAGATGCCTAGACC | 29 | 18 27 26 32 | | | 0 |
| 5047 | 414 | 2687 | 21565 | 69.1 | TGCGGAGTGAGTGCTTCAGC | 29 | 20 20 17 31 | | | 0 |
| 5048 | 415 | 2690 | 9040 | 75.2 | TGCGGAGTTGCGAGTGCGAA | 29 | 20 29 22 16 | | | 0 |
| 5049 | 416 | 2691 | 30634 | 69.1 | TGCGGAGTCACGTCCCTACA | 29 | 20 30 28 7 | | | 0 |
| 5050 | 417 | 2708 | 9054 | 71 | TGCGAGTGAATCGGACGGAC | 29 | 22 4 34 34 | | | 0 |
| 5051 | 418 | 2721 | 9070 | 63.8 | TGCGACCTTCTGTACAGTGC | 29 | 23 8 7 33 | | | 0 |
| 5052 | 419 | 2748 | 9104 | 72.7 | TGCGATCGGTGCGAGTTTGA | 29 | 24 33 20 1 | | | 0 |
| 5053 | 420 | 2762 | 40657 | 71 | TGCGCCTATTAGAGCCGTGC | 29 | 26 3 36 33 | | | 0 |
| 5054 | 421 | 2763 | 9128 | 66.1 | TGCGCCTAAATCCTGTCTTG | 29 | 26 4 14 11 | | | 0 |
| 5055 | 422 | 2770 | 9139 | 70.5 | TGCGCCTAAGTGCGAAACCT | 29 | 26 22 16 23 | | | 0 |
| 5056 | 423 | 2784 | 9156 | 68 | TGCGGATGAGGATTGATCGT | 29 | 27 25 1 10 | | | 0 |
| 5057 | 424 | 2791 | 30649 | 66.9 | TGCGTCCCATACTGATGTGC | 29 | 28 5 2 33 | | | 0 |
| 5058 | 425 | 2802 | 9177 | 68.2 | TGCGTCCCAGGAGTGCTTAG | 29 | 28 25 33 3 | | | 0 |
| 5059 | 426 | 2843 | 9222 | 67.6 | TGCGGACCTTAGCTCACCAT | 29 | 32 3 13 15 | | | 0 |
| 5060 | 427 | 2861 | 9247 | 69.6 | TGCGGTGCAGTGGGTATCTG | 29 | 33 22 18 8 | | | 0 |
| 5061 | 428 | 2876 | 9264 | 72.8 | TGCGGGACGGTAACGGTGAT | 29 | 34 18 35 2 | | | 0 |
| 5062 | 429 | 2886 | 9275 | 67.9 | TGCGACGGAAAGGGTATGTC | 29 | 35 6 18 9 | | | 0 |
| 5063 | 430 | 2904 | 9292 | 68.3 | TGCGAGCCCTGTTTAGGATG | 29 | 36 14 3 27 | | | 0 |
| 5064 | 431 | 3018 | 9551 | 68.2 | CACGGAGTGATGAGCCCTTG | 30 | 20 27 36 11 | | | 0 |
| 5065 | 432 | 3021 | 9556 | 63.1 | GCAAATACTCTGGAGTTGCG | 21 | 5 8 20 29 | | | 0 |

FIG. 29J

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5066 | 433 | 3045 | 9608 | 71.1 | CACGATCGGCAAATCGTCGT | 30 | 24 | 21 | 24 | 10 | 0 |
| 5067 | 434 | 3053 | 9626 | 70.5 | AGGAAGTGGCAACACGCAGC | 25 | 22 | 21 | 30 | 31 | 0 |
| 5068 | 435 | 3057 | 9633 | 69.4 | AGGAGACCCTCACGAATGCG | 25 | 32 | 13 | 16 | 29 | 0 |
| 5069 | 436 | 3103 | 9728 | 72.5 | CACGCAGCGCTTGCTTTCTG | 30 | 31 | 17 | 17 | 8 | 0 |
| 5070 | 437 | 3153 | 9818 | 68.9 | CACGAGCCGGTACGTTGGTA | 30 | 36 | 18 | 12 | 18 | 0 |
| 5071 | 438 | 3171 | 9864 | 68.8 | CAGCATACGTGCTCCCAGGA | 31 | 5 | 33 | 28 | 25 | 0 |
| 5072 | 439 | 3256 | 10059 | 66.3 | CAGCGAGTCCATGGACAGTG | 31 | 20 | 15 | 34 | 22 | 0 |
| 5073 | 440 | 3258 | 10060 | 67.5 | CAGCGAGTGGTAATCGTCCC | 31 | 20 | 18 | 24 | 28 | 0 |
| 5074 | 441 | 3273 | 10091 | 70.8 | AGTGATCGCTTGAGCCTGCG | 22 | 24 | 11 | 36 | 29 | 0 |
| 5075 | 442 | 3342 | 10220 | 67.9 | CAGCCAGCAAAGCCTAAGGA | 31 | 31 | 6 | 26 | 25 | 0 |
| 5076 | 443 | 3343 | 10221 | 68.4 | CAGCCAGCTACAAGCCAGGA | 31 | 31 | 7 | 36 | 25 | 0 |
| 5077 | 444 | 3473 | 10530 | 66 | GCAAACCTGTCTATCGCGAA | 21 | 23 | 19 | 24 | 16 | 0 |
| 5078 | 445 | 3492 | 16297 | 65.5 | GATGCGAATACAGACCCGAA | 27 | 16 | 7 | 32 | 16 | 0 |
| 5079 | 446 | 3493 | 10589 | 67.4 | GATGGAGTGATGGACCACGG | 27 | 20 | 27 | 32 | 35 | 0 |
| 5080 | 447 | 3501 | 30792 | 73 | TCCCGCAAGTCTGGACCCGAA | 28 | 21 | 19 | 34 | 16 | 0 |
| 5081 | 448 | 3653 | 10942 | 70.1 | GTGCGCTTCCTAACGGGATG | 33 | 17 | 26 | 35 | 27 | 0 |
| 5082 | 449 | 3678 | 30832 | 67 | GTGCGCAACGTTGCTTTTAG | 33 | 21 | 12 | 17 | 3 | 0 |
| 5083 | 450 | 3711 | 11060 | 68.7 | AGGACCTAAGCCATCGACGG | 25 | 26 | 36 | 24 | 35 | 0 |
| 5084 | 451 | 3822 | 11330 | 66.2 | CTTGAGGATGTCGATGGCAA | 11 | 25 | 9 | 27 | 21 | 0 |
| 5085 | 452 | 3920 | 11597 | 68.1 | CAGCCGTTTTGAGATGCCAT | 31 | 12 | 1 | 27 | 15 | 1 |
| 5086 | 453 | 3967 | 11693 | 70.1 | TTGATTGAATCGCGTTTGCG | 1 | 1 | 24 | 12 | 29 | 0 |
| 5087 | 454 | 4057 | 41152 | 66.2 | ACGGCTCAGGACATACCCAT | 35 | 13 | 34 | 5 | 15 | 0 |
| 5088 | 455 | 4062 | 11897 | 64.7 | ACGGCTGTGGTACTCATCGT | 35 | 14 | 18 | 13 | 10 | 0 |
| 5089 | 456 | 4145 | 12041 | 66.9 | AGTGGCTTGTCTGACCAGCC | 22 | 17 | 19 | 32 | 36 | 0 |
| 5090 | 457 | 4162 | 30941 | 67 | ATCGTCTGTCTGGACCCGAA | 24 | 8 | 8 | 32 | 16 | 0 |
| 5091 | 458 | 4174 | 12091 | 64.2 | ACGGAGGATGATACCTCACG | 35 | 25 | 2 | 23 | 30 | 0 |
| 5092 | 459 | 4317 | 16775 | 67.5 | AGCCTTAGCCATTCTGCGAA | 36 | 3 | 15 | 8 | 16 | 0 |
| 5093 | 460 | 4348 | 12389 | 67.1 | AGCCTGTCGCAAATACCGTT | 36 | 9 | 21 | 5 | 12 | 0 |
| 5094 | 461 | 4352 | 12396 | 67.8 | AGCCTCGTTTAGTCGTTGCG | 36 | 10 | 3 | 10 | 29 | 0 |
| 5095 | 462 | 4446 | 12578 | 64.4 | AGCCGTCTGGACTGATTCTG | 36 | 19 | 34 | 2 | 8 | 0 |
| 5096 | 463 | 4448 | 12580 | 64.7 | AGCCGAGTTTAGCCTACACG | 36 | 20 | 3 | 26 | 30 | 0 |
| 5097 | 464 | 4545 | 12741 | 65.9 | TGCGTACACTGTCCATTCCC | 29 | 7 | 14 | 15 | 28 | 0 |
| 5098 | 465 | 4586 | 12811 | 70.2 | AGCCGACCAGCCTTAGGGAC | 36 | 32 | 36 | 3 | 34 | 0 |
| 5099 | 466 | 1 | 20001 | 71.9 | TTGAAGCCATCGGCTTTCCC | 1 | 36 | 24 | 17 | 28 | 0 |
| 5100 | 467 | 2 | 12884 | 73.6 | AATCCACGTCCCCGAAACGG | 4 | 30 | 28 | 16 | 35 | 0 |
| 5101 | 468 | 4 | 30001 | 70.5 | AAAGCGTTCTCATGCGCGTT | 6 | 12 | 13 | 29 | 12 | 0 |
| 5102 | 469 | 10 | 39 | 76.6 | TCGTCAGCCACGACGGACGG | 10 | 31 | 30 | 35 | 35 | 0 |
| 5103 | 470 | 11 | 12889 | 76.2 | TCGTGTGCACGGTGCGATCG | 10 | 33 | 35 | 29 | 24 | 0 |
| 5104 | 471 | 14 | 40001 | 73.9 | CTTGCGAAGTGCGTGCCGTT | 11 | 16 | 33 | 33 | 12 | 0 |
| 5105 | 472 | 16 | 30002 | 72.6 | CGTTTCCCCACGAGTGCGTT | 12 | 28 | 30 | 22 | 12 | 1 |
| 5106 | 473 | 19 | 68 | 77.2 | CCATGTGCACGGCACGCCAT | 15 | 33 | 35 | 30 | 15 | 0 |
| 5107 | 474 | 22 | 40002 | 74.1 | CGAAACGGCTCACAGCCACG | 16 | 35 | 13 | 31 | 30 | 0 |
| 5108 | 475 | 23 | 40003 | 72.5 | GCTTTCCCGGTATCCCGGAC | 17 | 28 | 18 | 28 | 34 | 0 |
| 5109 | 476 | 25 | 30003 | 69.9 | AGTGCGAAATCGGTGCACCT | 22 | 16 | 24 | 33 | 23 | 0 |
| 5110 | 477 | 27 | 100 | 72.2 | ACCTCAGCCACGAGCCAGGA | 23 | 31 | 30 | 36 | 25 | 0 |
| 5111 | 478 | 28 | 12908 | 73.1 | ACCTAGCCTGCGTCCCGACC | 23 | 36 | 29 | 28 | 32 | 0 |
| 5112 | 479 | 31 | 12921 | 72.7 | TCCCAAAGGCAAAGCCATCG | 28 | 6 | 21 | 36 | 24 | 0 |
| 5113 | 480 | 34 | 40004 | 73.4 | TCCCTCCCCCTACACGCGTT | 28 | 28 | 26 | 30 | 12 | 0 |

FIG. 29K

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5114 | 481 | 35 | 40005 | 76 | TGCGTTGACAGCGGACGCAA | 29 | 1 | 31 | 34 | 21 | 0 |
| 5115 | 482 | 37 | 12931 | 72.5 | TGCGCGAACCTAGATGCACG | 29 | 16 | 26 | 27 | 30 | 0 |
| 5116 | 483 | 38 | 30005 | 70.4 | TGCGGGTATTAGCACGGACC | 29 | 18 | 3 | 30 | 32 | 0 |
| 5117 | 484 | 39 | 12933 | 75.7 | TGCGAGTGACGGGTGCTCCC | 29 | 22 | 35 | 33 | 28 | 0 |
| 5118 | 485 | 40 | 30006 | 71.6 | TGCGCCTATCTGACGGCTTG | 29 | 26 | 8 | 35 | 11 | 0 |
| 5119 | 486 | 41 | 12934 | 73.3 | TGCGGATGCAGCTACATGCG | 29 | 27 | 31 | 7 | 29 | 0 |
| 5120 | 487 | 45 | 12936 | 75 | CACGCTTGCACGATCGGTGC | 30 | 11 | 30 | 24 | 33 | 0 |
| 5121 | 488 | 46 | 12939 | 74.7 | CACGGTGCCCATCTGTTGCG | 30 | 33 | 15 | 14 | 29 | 0 |
| 5122 | 489 | 47 | 30007 | 70.9 | CACGACGGAAAGGCAAATCG | 30 | 35 | 6 | 21 | 24 | 0 |
| 5123 | 490 | 50 | 40008 | 73.1 | CAGCAGCCAGTGGTGCTCCC | 31 | 36 | 22 | 33 | 28 | 0 |
| 5124 | 491 | 51 | 12944 | 74.3 | TTGAGACCTGCGCAGCCGAA | 1 | 32 | 29 | 31 | 16 | 0 |
| 5125 | 492 | 54 | 40009 | 72.8 | GGACACGGTCCCTGTCTGCG | 34 | 35 | 28 | 9 | 29 | 1 |
| 5126 | 493 | 56 | 12951 | 71.1 | TTGAACGGCTTGCTTGCCAT | 1 | 35 | 11 | 11 | 15 | 0 |
| 5127 | 494 | 57 | 30014 | 72.8 | ACGGGAGTACGGCACGCTTG | 35 | 20 | 35 | 30 | 11 | 0 |
| 5128 | 495 | 61 | 40010 | 70.5 | AGCCCTTGAGGAACGGGGTA | 36 | 11 | 25 | 35 | 18 | 0 |
| 5129 | 496 | 63 | 12968 | 73.5 | TTGAAGCCCTCAAGCCGCAA | 1 | 36 | 13 | 36 | 21 | 0 |
| 5130 | 497 | 64 | 12969 | 73.2 | TGATTGCGGCAACTTGCACG | 2 | 29 | 21 | 11 | 30 | 0 |
| 5131 | 498 | 65 | 264 | 74 | TCTGCCATGGACACGGGTGC | 8 | 15 | 34 | 35 | 33 | 0 |
| 5132 | 499 | 66 | 12973 | 72.3 | TCTGCAGCAGGACCATTGCG | 8 | 31 | 25 | 15 | 29 | 0 |
| 5133 | 500 | 71 | 282 | 75.6 | TCGTCAGCCAGCGTGCGATG | 10 | 31 | 31 | 33 | 27 | 0 |
| 5134 | 501 | 72 | 286 | 74.3 | CTTGCCATTCCCGGACCAGC | 11 | 15 | 28 | 34 | 31 | 0 |
| 5135 | 502 | 74 | 308 | 69.9 | CGAAGCTTAGCCCCTATGCG | 16 | 17 | 36 | 26 | 29 | 0 |
| 5136 | 503 | 77 | 12989 | 69.8 | GGTATGCGTCGTTCGTTCCC | 18 | 29 | 10 | 10 | 28 | 0 |
| 5137 | 504 | 80 | 20049 | 69.5 | GCAAGATGGATGTCCCAGCC | 21 | 27 | 27 | 28 | 36 | 0 |
| 5138 | 505 | 83 | 12997 | 71.4 | GATGGCAACAGCTCCCCCAT | 27 | 21 | 31 | 28 | 15 | 0 |
| 5139 | 506 | 85 | 350 | 75.8 | GATGACGGGACCCACGTGCG | 27 | 35 | 32 | 30 | 29 | 0 |
| 5140 | 507 | 87 | 40012 | 72.1 | TCCCGAGTAGCCCACGTCGT | 28 | 20 | 36 | 30 | 10 | 0 |
| 5141 | 508 | 90 | 13002 | 72.1 | TCCCGTGCAAAGACGGACCT | 28 | 33 | 6 | 35 | 23 | 0 |
| 5142 | 509 | 91 | 30016 | 72.4 | TGCGGAGTCTTGACGGGGAC | 29 | 20 | 11 | 35 | 34 | 0 |
| 5143 | 510 | 93 | 30017 | 72.9 | TGCGGATGAATCATCGTGCG | 29 | 27 | 4 | 24 | 29 | 0 |
| 5144 | 511 | 97 | 13012 | 74 | CAGCATCGTCCCGCAAATCG | 31 | 24 | 28 | 21 | 24 | 0 |
| 5145 | 512 | 102 | 413 | 76.5 | GACCGATGCACGACGGGCAA | 32 | 27 | 30 | 35 | 21 | 0 |
| 5146 | 513 | 103 | 13014 | 72.4 | TGATGACCGTGCAGCCGGTA | 2 | 32 | 33 | 36 | 18 | 0 |
| 5147 | 514 | 108 | 425 | 69.8 | GTGCTCCCTACATCCCTGCG | 33 | 28 | 7 | 28 | 29 | 0 |
| 5148 | 515 | 110 | 13017 | 73.5 | GTGCGGACGATGAGCCGGTA | 33 | 34 | 27 | 36 | 18 | 0 |
| 5149 | 516 | 113 | 40013 | 73.7 | GGACGGACATCGGACCGCTT | 34 | 34 | 24 | 32 | 17 | 0 |
| 5150 | 517 | 115 | 438 | 75.8 | ACGGTCGTCAGCCGTTTGCG | 35 | 10 | 31 | 12 | 29 | 0 |
| 5151 | 518 | 116 | 439 | 75.4 | ACGGCTTGCACGACGGAGGA | 35 | 11 | 30 | 35 | 25 | 0 |
| 5152 | 519 | 117 | 20065 | 73.9 | ACGGCGTTTTAGCACGTGCG | 35 | 12 | 3 | 30 | 29 | 0 |
| 5153 | 520 | 119 | 30021 | 71.5 | ACGGCCTAGATGACGGCGTT | 35 | 26 | 27 | 35 | 12 | 0 |
| 5154 | 521 | 120 | 40015 | 70.1 | CTTGGCAACTCACAGCGCAA | 11 | 21 | 13 | 31 | 21 | 0 |
| 5155 | 522 | 121 | 30023 | 72 | CGTTAGCCTCTGCAGCGCAA | 12 | 36 | 8 | 31 | 21 | 0 |
| 5156 | 523 | 122 | 40016 | 69.3 | CCATAGCCTTGAAGCCGGAC | 15 | 36 | 1 | 36 | 34 | 0 |
| 5157 | 524 | 123 | 13046 | 69.2 | CGAAACCTAGCCAGCCCCTA | 16 | 23 | 36 | 36 | 26 | 0 |
| 5158 | 525 | 127 | 544 | 73.4 | AGGATGCGCTCATCCCCGTT | 25 | 29 | 13 | 28 | 12 | 0 |
| 5159 | 526 | 128 | 30025 | 72.4 | GATGCGAACACGGATGTGCG | 27 | 16 | 30 | 27 | 29 | 0 |
| 5160 | 527 | 130 | 40017 | 73.1 | TCCCCGTTCGAAGATGCGAA | 28 | 12 | 16 | 27 | 16 | 0 |
| 5161 | 528 | 131 | 13070 | 75.8 | TCCCATCGACGGTGCGGGTA | 28 | 24 | 35 | 29 | 18 | 0 |

FIG. 29L

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5162 | 529 | 133 | 30026 | 78.3 | TCCCAGCCCGAAAGCCCAGC | 28 | 36 | 16 | 36 | 31 | 0 |
| 5163 | 530 | 134 | 40018 | 78.7 | TGCGCTTGTGCGGTGCATCG | 29 | 11 | 29 | 33 | 24 | 0 |
| 5164 | 531 | 136 | 30028 | 70.2 | CAGCCCTATCTGCAGCGACC | 31 | 26 | 8 | 31 | 32 | 0 |
| 5165 | 532 | 137 | 603 | 68.9 | CAGCACGGTACACACGGCTT | 31 | 35 | 7 | 30 | 17 | 0 |
| 5166 | 533 | 138 | 13093 | 73.9 | GACCGATGGCTTCACGTGCG | 32 | 27 | 17 | 30 | 29 | 0 |
| 5167 | 534 | 139 | 30030 | 73.4 | GTGCGACCGTGCCGTTTGAT | 33 | 32 | 33 | 12 | 2 | 0 |
| 5168 | 535 | 141 | 13103 | 71.9 | GGACATCGCCTAAGCCCGAA | 34 | 24 | 26 | 36 | 16 | 0 |
| 5169 | 536 | 142 | 13104 | 71.3 | GGACCCTATCCCCGAATCCC | 34 | 26 | 28 | 16 | 28 | 0 |
| 5170 | 537 | 143 | 30031 | 71.3 | GGACTCCCTCTGACGGCAGC | 34 | 28 | 8 | 35 | 31 | 0 |
| 5171 | 538 | 144 | 13105 | 69.7 | GGACCACGTCGTATCGAGCC | 34 | 30 | 10 | 24 | 36 | 0 |
| 5172 | 539 | 146 | 13110 | 73.8 | ACGGATCGATCGAGCCGGAC | 35 | 24 | 24 | 36 | 34 | 0 |
| 5173 | 540 | 147 | 646 | 77.4 | ACGGAGGAACGGCACGGCAA | 35 | 25 | 35 | 30 | 21 | 0 |
| 5174 | 541 | 148 | 20075 | 73.8 | AGCCGCAAGAGTGTGCCACG | 36 | 21 | 20 | 33 | 30 | 0 |
| 5175 | 542 | 149 | 13129 | 71.2 | AAAGCGTTTCCCAGCCCTTG | 6 | 12 | 28 | 36 | 11 | 1 |
| 5176 | 543 | 152 | 30036 | 69.5 | CGTTGCAACTGTAGCCCACG | 12 | 21 | 14 | 36 | 30 | 0 |
| 5177 | 544 | 154 | 721 | 68 | CTCAACGGTCCCATACACGG | 13 | 35 | 28 | 5 | 35 | 1 |
| 5178 | 545 | 155 | 741 | 73.1 | CGAAAATCAGCCTGCGCGTT | 16 | 4 | 36 | 29 | 12 | 0 |
| 5179 | 546 | 156 | 13151 | 71.2 | CGAAAAGGATGCGAATGCG | 16 | 6 | 27 | 16 | 29 | 0 |
| 5180 | 547 | 158 | 745 | 70.9 | CGAACTCAACGGGCAAGTGC | 16 | 13 | 35 | 21 | 33 | 0 |
| 5181 | 548 | 160 | 749 | 75 | CGAAAGTGCACGCACGGTGC | 16 | 22 | 30 | 30 | 33 | 0 |
| 5182 | 549 | 164 | 779 | 67.7 | GGTAGCAAAAAGGGACGCAA | 18 | 21 | 6 | 34 | 21 | 0 |
| 5183 | 550 | 169 | 30039 | 68.1 | CCTATGCGTGTCATCGGCTT | 26 | 29 | 9 | 24 | 17 | 0 |
| 5184 | 551 | 170 | 867 | 72.1 | TCCCGTCTCGAAGACCCGAA | 28 | 19 | 16 | 32 | 16 | 0 |
| 5185 | 552 | 172 | 13204 | 70.5 | TGCGGCTTTACAGGACGCTT | 29 | 17 | 7 | 34 | 17 | 0 |
| 5186 | 553 | 173 | 40024 | 74.8 | TGCGAGGAGACCTCCCACGG | 29 | 25 | 32 | 28 | 35 | 0 |
| 5187 | 554 | 174 | 888 | 74 | TGCGGACCGGTATCCCACCT | 29 | 32 | 18 | 28 | 23 | 0 |
| 5188 | 555 | 175 | 40025 | 74 | TGCGGTGCTCTGACGGTCGT | 29 | 33 | 8 | 35 | 10 | 0 |
| 5189 | 556 | 176 | 20090 | 71.7 | CACGTCGTACGGGCAACAGC | 30 | 10 | 35 | 21 | 31 | 0 |
| 5190 | 557 | 177 | 13215 | 72.2 | CAGCCTTGCTTGGGACGGAC | 31 | 11 | 11 | 34 | 34 | 0 |
| 5191 | 558 | 178 | 13217 | 68.4 | CAGCCCTAAGGAGGACAGCC | 31 | 26 | 25 | 34 | 36 | 0 |
| 5192 | 559 | 180 | 20095 | 73.5 | AATCCAGCTGCGCGTTCGAA | 4 | 31 | 29 | 12 | 16 | 0 |
| 5193 | 560 | 181 | 921 | 70.9 | CAGCACGGGTCTAGCCGATG | 31 | 35 | 19 | 36 | 27 | 0 |
| 5194 | 561 | 182 | 923 | 71.3 | GACCAATCGCTTGACCGCAA | 32 | 4 | 17 | 32 | 21 | 0 |
| 5195 | 562 | 184 | 13219 | 68.2 | GACCCCATCGTTAGTGTGCG | 32 | 15 | 12 | 22 | 29 | 0 |
| 5196 | 563 | 185 | 30045 | 68.1 | GACCCCTAACGGAAAGCGTT | 32 | 26 | 35 | 6 | 12 | 0 |
| 5197 | 564 | 186 | 13223 | 71 | GACCGATGCCATTCGTCGAA | 32 | 27 | 15 | 10 | 16 | 0 |
| 5198 | 565 | 187 | 30046 | 70.4 | GACCGGACAGGATGATTGCG | 32 | 34 | 25 | 2 | 29 | 0 |
| 5199 | 566 | 188 | 13226 | 68.3 | GTGCCTCAATACCAGCACGG | 33 | 13 | 5 | 31 | 35 | 0 |
| 5200 | 567 | 190 | 40031 | 73.3 | GTGCGATGCAGCGTCTGCAA | 33 | 27 | 31 | 19 | 21 | 0 |
| 5201 | 568 | 193 | 20097 | 69.7 | GGACAGCCAGGAATCGATCG | 34 | 36 | 25 | 24 | 24 | 0 |
| 5202 | 569 | 194 | 973 | 69.5 | ACGGCTCACTCATCCCCTCA | 35 | 13 | 13 | 28 | 13 | 0 |
| 5203 | 570 | 195 | 977 | 70.8 | ACGGACCTCTCAAGCCGACC | 35 | 23 | 13 | 36 | 32 | 0 |
| 5204 | 571 | 196 | 978 | 72.6 | ACGGGATGCGAACGAAGTGC | 35 | 27 | 16 | 16 | 33 | 0 |
| 5205 | 572 | 198 | 40034 | 69.8 | AGCCGTTAAAGTGCGGATG | 36 | 12 | 6 | 29 | 27 | 0 |
| 5206 | 573 | 199 | 40035 | 74.3 | AGCCCTCAATCGCAGCAGCC | 36 | 13 | 24 | 31 | 36 | 0 |
| 5207 | 574 | 200 | 20100 | 72.1 | AGCCGGTACCATAGCCTGCG | 36 | 18 | 15 | 36 | 29 | 0 |
| 5208 | 575 | 202 | 20101 | 69.4 | AGCCAGGATGTCCCTATGCG | 36 | 25 | 9 | 26 | 29 | 0 |
| 5209 | 576 | 204 | 1022 | 73.3 | CCATCGAAGGACTGCGCAGC | 15 | 16 | 34 | 29 | 31 | 0 |

FIG. 29M

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5210 | 577 | 207 | 40037 | 72.6 | GCAAACGGCTCATCCCGGTA | 21 | 35 | 13 | 28 | 18 | 0 |
| 5211 | 578 | 208 | 20103 | 73.2 | CCTAACGGCAGCTGCGCTGT | 26 | 35 | 31 | 29 | 14 | 0 |
| 5212 | 579 | 209 | 1063 | 75.8 | GATGACGGCAGCTCCCGCAA | 27 | 35 | 31 | 28 | 21 | 0 |
| 5213 | 580 | 211 | 13280 | 78 | TGCGCTGTTCCCCACGAGCC | 29 | 14 | 28 | 30 | 36 | 0 |
| 5214 | 581 | 212 | 20105 | 73.2 | TGCGCGAATTAGGCAAAGCC | 29 | 16 | 3 | 21 | 36 | 0 |
| 5215 | 582 | 213 | 1094 | 73.3 | CACGATCGTCCCCGAACGAA | 30 | 24 | 28 | 16 | 16 | 0 |
| 5216 | 583 | 215 | 40038 | 73.8 | CAGCGGACCCTAAGCCAGCC | 31 | 34 | 26 | 36 | 36 | 0 |
| 5217 | 584 | 217 | 1117 | 72.9 | GACCGAGTTGCGTCCCGATG | 32 | 20 | 29 | 28 | 27 | 0 |
| 5218 | 585 | 219 | 20108 | 70.4 | GTGCTGCGGGTACCATGGAC | 33 | 29 | 18 | 15 | 34 | 0 |
| 5219 | 586 | 220 | 30048 | 72.9 | GTGCCACGATCGCTTGTCCC | 33 | 30 | 24 | 11 | 28 | 1 |
| 5220 | 587 | 221 | 40039 | 73.3 | GGACGACCTGTCGGACGCAA | 34 | 32 | 9 | 34 | 21 | 0 |
| 5221 | 588 | 222 | 1148 | 71.3 | ACGGCCTAACGGTGTCCGTT | 35 | 26 | 35 | 9 | 12 | 0 |
| 5222 | 589 | 223 | 30052 | 75.8 | ACGGTCCCCGTTGGACCAGC | 35 | 28 | 12 | 34 | 31 | 1 |
| 5223 | 590 | 224 | 30053 | 72.9 | AGCCCGAACAGCTCCCTCGT | 36 | 16 | 31 | 28 | 10 | 0 |
| 5224 | 591 | 225 | 1200 | 74.8 | TCGTAGCCATCGCACGCAGC | 10 | 36 | 24 | 30 | 31 | 0 |
| 5225 | 592 | 227 | 40040 | 69.1 | CGTTTTGACGTTAGCCTGCG | 12 | 1 | 12 | 36 | 29 | 1 |
| 5226 | 593 | 229 | 13343 | 68.8 | AAAGCGTTATCGTCCCGACC | 6 | 12 | 24 | 28 | 32 | 0 |
| 5227 | 594 | 230 | 40041 | 73.2 | CGTTGACCGATGACGGCCAT | 12 | 32 | 27 | 35 | 15 | 0 |
| 5228 | 595 | 232 | 30054 | 70.2 | AAAGCCATGCTTTCCCTCCC | 6 | 15 | 17 | 28 | 28 | 0 |
| 5229 | 596 | 233 | 40042 | 69.5 | CGAATCGTTCGTCTTGCACG | 16 | 10 | 10 | 11 | 30 | 0 |
| 5230 | 597 | 235 | 30055 | 68.5 | CGAACGAAGATGCCATCAGC | 16 | 16 | 27 | 15 | 31 | 0 |
| 5231 | 598 | 236 | 1277 | 70.1 | CGAACAGCGACCCCTACAGC | 16 | 31 | 32 | 26 | 31 | 0 |
| 5232 | 599 | 237 | 13376 | 68.5 | GCTTATCGTGCGTCGTGCTT | 17 | 24 | 29 | 10 | 17 | 0 |
| 5233 | 600 | 238 | 40043 | 67.7 | GCAAAAGTGTCCAGCGGAC | 21 | 6 | 9 | 31 | 34 | 0 |
| 5234 | 601 | 239 | 30058 | 69.4 | GCAATCGTTGTCGGTATGCG | 21 | 10 | 9 | 18 | 29 | 0 |
| 5235 | 602 | 240 | 13388 | 72.4 | GCAAAGTGCGAACACGGCAA | 21 | 22 | 16 | 30 | 21 | 0 |
| 5236 | 603 | 241 | 30059 | 71.5 | AAAGGCAACAGCGCAAGCAA | 6 | 21 | 31 | 21 | 21 | 0 |
| 5237 | 604 | 244 | 40044 | 71.4 | ATCGGCAAAAGTCCCCGAA | 24 | 21 | 6 | 28 | 16 | 1 |
| 5238 | 605 | 245 | 30060 | 74.8 | ATCGCAGCGCTTGATGTGCG | 24 | 31 | 17 | 27 | 29 | 0 |
| 5239 | 606 | 246 | 1355 | 73.2 | GATGCTCAAGCCCAGCACGG | 27 | 13 | 36 | 31 | 35 | 0 |
| 5240 | 607 | 247 | 13417 | 72.9 | AAAGTCCCGAGTTGCGTGCG | 6 | 28 | 20 | 29 | 29 | 1 |
| 5241 | 608 | 249 | 30063 | 73.6 | TGCGAGCCATCGACCTACGG | 29 | 36 | 24 | 23 | 35 | 0 |
| 5242 | 609 | 250 | 40048 | 70.8 | CACGGCTTGGTAGTGCGACC | 30 | 17 | 18 | 33 | 32 | 0 |
| 5243 | 610 | 251 | 40049 | 71.2 | CACGGCAATGATCACGGACC | 30 | 21 | 2 | 30 | 32 | 0 |
| 5244 | 611 | 252 | 1413 | 72.3 | CACGAGTGGGACGTGCATCG | 30 | 22 | 34 | 33 | 24 | 0 |
| 5245 | 612 | 253 | 13443 | 68.5 | CAGCGCTTGGTAATCGGGTA | 31 | 17 | 18 | 24 | 18 | 0 |
| 5246 | 613 | 254 | 30067 | 67.8 | GACCGGTAAAAGCGAAGCAA | 32 | 18 | 6 | 16 | 21 | 0 |
| 5247 | 614 | 256 | 13456 | 69 | GTGCTCGTCAGCAGTGCGTT | 33 | 10 | 31 | 22 | 12 | 0 |
| 5248 | 615 | 257 | 13457 | 71.3 | GTGCCTTGGTGCGATGCCTA | 33 | 11 | 33 | 27 | 26 | 0 |
| 5249 | 616 | 258 | 30069 | 71.2 | GTGCCTCATGTCACGGGTGC | 33 | 13 | 9 | 35 | 33 | 0 |
| 5250 | 617 | 259 | 30070 | 70.8 | AAAGGTGCCGAAATCGGGAC | 6 | 33 | 16 | 24 | 34 | 0 |
| 5251 | 618 | 260 | 40052 | 72.2 | GTGCCAGCGGTAGGACCAGC | 33 | 31 | 18 | 34 | 31 | 0 |
| 5252 | 619 | 261 | 1467 | 70.5 | GGACTTGAACGGGCTTGCAA | 34 | 1 | 35 | 17 | 21 | 0 |
| 5253 | 620 | 262 | 40053 | 70.8 | GGACCTCAGCAAAGCCCCAT | 34 | 13 | 21 | 36 | 15 | 0 |
| 5254 | 621 | 263 | 30072 | 69.2 | GGACCCATGCTTCCATGACC | 34 | 15 | 17 | 15 | 32 | 0 |
| 5255 | 622 | 265 | 1483 | 71.7 | ACGGTCTGGCTTACGGGTGC | 35 | 8 | 17 | 35 | 33 | 0 |
| 5256 | 623 | 266 | 30073 | 72.6 | ACGGCGTTGTGCAAAGTCCC | 35 | 12 | 33 | 6 | 28 | 1 |
| 5257 | 624 | 267 | 13472 | 73.4 | ACGGATCGCACGCCTAGCAA | 35 | 24 | 30 | 26 | 21 | 0 |

FIG. 29N

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5258 | 625 | 269 | 40054 | 73.5 | AGCCGAGTGGACATCGTGCG | 36 | 20 | 34 | 24 | 29 | 0 |
| 5259 | 626 | 270 | 20130 | 73.4 | AGCCAGTGACGGCCATCACG | 36 | 22 | 35 | 15 | 30 | 0 |
| 5260 | 627 | 273 | 20134 | 74 | TCCCCGAAGGTAACGGCAGC | 28 | 16 | 18 | 35 | 31 | 0 |
| 5261 | 628 | 274 | 1538 | 73.5 | TCCCATCGGAGTTCCCGACC | 28 | 24 | 20 | 28 | 32 | 0 |
| 5262 | 629 | 275 | 1555 | 76.5 | TGCGGGACGAGTGACCCACG | 29 | 34 | 20 | 32 | 30 | 0 |
| 5263 | 630 | 276 | 13501 | 72.4 | CAGCTGCGTACATGCGCCAT | 31 | 29 | 7 | 29 | 15 | 0 |
| 5264 | 631 | 277 | 13503 | 73.6 | GACCGCAACGAAAGCCTCCC | 32 | 21 | 16 | 36 | 28 | 0 |
| 5265 | 632 | 278 | 13505 | 76.1 | GTGCACGGGCAAGACCGTGC | 33 | 35 | 21 | 32 | 33 | 0 |
| 5266 | 633 | 279 | 13506 | 70 | ACGGTCGTATCGCTTGCCAT | 35 | 10 | 24 | 11 | 15 | 0 |
| 5267 | 634 | 280 | 1586 | 73.4 | ACGGCTTGCTCAGACCGCAA | 35 | 11 | 13 | 32 | 21 | 0 |
| 5268 | 635 | 283 | 1593 | 75.5 | ACGGGAGTTGCGCAGCCTCA | 35 | 20 | 29 | 31 | 13 | 0 |
| 5269 | 636 | 284 | 1595 | 74.1 | ACGGACCTGATGCAGCGCAA | 35 | 23 | 27 | 31 | 21 | 0 |
| 5270 | 637 | 285 | 30077 | 71.7 | TACAACGGCACGTGCGACCT | 7 | 35 | 30 | 29 | 23 | 0 |
| 5271 | 638 | 287 | 13515 | 71.3 | AGCCGCAAGTCTTGCGTTGA | 36 | 21 | 19 | 29 | 1 | 0 |
| 5272 | 639 | 288 | 13516 | 75.6 | AGCCATCGCAGCCTTGGCAA | 36 | 24 | 31 | 11 | 21 | 0 |
| 5273 | 640 | 293 | 1633 | 76.1 | TCTGCGTTTGCGGCAAAGCC | 8 | 12 | 29 | 21 | 36 | 0 |
| 5274 | 641 | 294 | 13523 | 73.2 | TCTGCGAATGCGGACCGTCT | 8 | 16 | 29 | 32 | 19 | 0 |
| 5275 | 642 | 295 | 20141 | 68.7 | TCTGTCGTGCTTGACCAGCC | 8 | 10 | 17 | 32 | 36 | 0 |
| 5276 | 643 | 296 | 40058 | 68.5 | CTTGCGTTGCTTTGTCCGTT | 11 | 12 | 17 | 9 | 12 | 0 |
| 5277 | 644 | 302 | 40059 | 71.1 | CGTTTTGAGTGCAGCCCAGC | 12 | 1 | 33 | 36 | 31 | 1 |
| 5278 | 645 | 303 | 30080 | 69.8 | TCTGCGTTCGTTCTTGCGAA | 8 | 12 | 12 | 11 | 16 | 0 |
| 5279 | 646 | 305 | 13535 | 69.4 | CGTTGATGAGGACAGCTGCG | 12 | 27 | 25 | 31 | 29 | 0 |
| 5280 | 647 | 307 | 1679 | 69.4 | CTCAGCAAACCTGTGCACGG | 13 | 21 | 23 | 33 | 35 | 0 |
| 5281 | 648 | 308 | 1680 | 72.5 | CTCACAGCACGGGTGCGATG | 13 | 31 | 35 | 33 | 27 | 0 |
| 5282 | 649 | 309 | 1688 | 72.4 | CTGTCACGGACCCAGCCGTT | 14 | 30 | 32 | 31 | 12 | 0 |
| 5283 | 650 | 310 | 1693 | 68.8 | TCTGCCATCGAAAGTGGTGC | 8 | 15 | 16 | 22 | 33 | 0 |
| 5284 | 651 | 311 | 13539 | 70.5 | CCATGGTACGTTTGCGGACC | 15 | 18 | 12 | 29 | 32 | 0 |
| 5285 | 652 | 312 | 30083 | 71.3 | CCATTCCCATCGTCTGCACG | 15 | 28 | 24 | 8 | 30 | 0 |
| 5286 | 653 | 314 | 1703 | 69.7 | CGAATCTGCGTTTGATTGCG | 16 | 8 | 12 | 2 | 29 | 0 |
| 5287 | 654 | 315 | 13544 | 71.9 | CGAAAGTGACGGAGCCCGTT | 16 | 22 | 35 | 36 | 12 | 0 |
| 5288 | 655 | 316 | 1718 | 69.9 | CGAAGTGCCTTGTCGTTCCC | 16 | 33 | 11 | 10 | 28 | 0 |
| 5289 | 656 | 318 | 13550 | 68.7 | TCTGGCTTAGGAACGGGCTT | 8 | 17 | 25 | 35 | 17 | 0 |
| 5290 | 657 | 319 | 40061 | 69.2 | GCTTTGCGAATCCTTGGCTT | 17 | 29 | 4 | 11 | 17 | 0 |
| 5291 | 658 | 320 | 1732 | 73 | TCTGGCTTGACCGACCCGAA | 8 | 17 | 32 | 32 | 16 | 0 |
| 5292 | 659 | 323 | 1739 | 69.3 | GGTATCCCCGAATGTCCACG | 18 | 28 | 16 | 9 | 30 | 0 |
| 5293 | 660 | 326 | 1750 | 69.3 | GCAATGATATCGCACGGTGC | 21 | 2 | 24 | 30 | 33 | 0 |
| 5294 | 661 | 327 | 1751 | 69.1 | TCTGGCAAAAAGGCTTTCCC | 8 | 21 | 6 | 17 | 28 | 0 |
| 5295 | 662 | 328 | 1752 | 69.4 | GCAACTGTCAGCGCTTCGAA | 21 | 14 | 31 | 17 | 16 | 0 |
| 5296 | 663 | 329 | 13554 | 68 | GCAAGGTATCTGCAGCCAGC | 21 | 18 | 8 | 31 | 31 | 0 |
| 5297 | 664 | 330 | 1763 | 73.9 | AGTGGCAATCCCTCCCTGCG | 22 | 21 | 28 | 28 | 29 | 0 |
| 5298 | 665 | 334 | 30086 | 73.6 | ATCGGTGCTGCGAATCGTGC | 24 | 33 | 29 | 4 | 33 | 0 |
| 5299 | 666 | 336 | 1788 | 71.2 | CCTACAGCCGAATCCCGCTT | 26 | 31 | 16 | 28 | 17 | 0 |
| 5300 | 667 | 337 | 40062 | 72.3 | TCTGGATGCCATGTGCCGAA | 8 | 27 | 15 | 33 | 16 | 0 |
| 5301 | 668 | 338 | 30087 | 69.3 | TCTGGATGCGAAAAAGTGCG | 8 | 27 | 16 | 6 | 29 | 0 |
| 5302 | 669 | 339 | 1797 | 70.9 | TCTGGATGGACGGTATGCG | 8 | 27 | 34 | 18 | 29 | 0 |
| 5303 | 670 | 341 | 40063 | 72.9 | TCCCCCATTCGTGATGGTGC | 28 | 15 | 10 | 27 | 33 | 0 |
| 5304 | 671 | 342 | 40064 | 73.6 | TCCCGCTTTCTGGATGTGCG | 28 | 17 | 8 | 27 | 29 | 0 |
| 5305 | 672 | 343 | 40065 | 70.7 | TCCCGGTACCATATCGCGAA | 28 | 18 | 15 | 24 | 16 | 0 |

FIG. 29O

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5306 | 673 | 344 | 13566 | 72.7 | TCCCGAGTGGACGCAACCAT | 28 | 20 | 34 | 21 | 15 | 0 |
| 5307 | 674 | 345 | 13568 | 72.3 | TCCCAGCCCCTATCCCACCT | 28 | 36 | 26 | 28 | 23 | 0 |
| 5308 | 675 | 347 | 1812 | 74.1 | TGCGTCTGTCCCCGAAGCAA | 29 | 8 | 28 | 16 | 21 | 0 |
| 5309 | 676 | 348 | 1822 | 74.3 | TGCGTGCGGATGACCTACGG | 29 | 29 | 27 | 23 | 35 | 0 |
| 5310 | 677 | 349 | 1823 | 72 | TGCGGACCTCGTTGATCACG | 29 | 32 | 10 | 2 | 30 | 0 |
| 5311 | 678 | 350 | 1828 | 67.2 | TCTGCACGCTTGTTAGCAGC | 8 | 30 | 11 | 3 | 31 | 0 |
| 5312 | 679 | 351 | 1831 | 74.8 | TCTGCACGCCATGTGCCGTT | 8 | 30 | 15 | 33 | 12 | 0 |
| 5313 | 680 | 352 | 40067 | 71.4 | CACGGAGTTGTCGGACGTGC | 30 | 20 | 9 | 34 | 33 | 0 |
| 5314 | 681 | 354 | 30090 | 70.3 | TCTGCACGCCTAAGCCCTGT | 8 | 30 | 26 | 36 | 14 | 0 |
| 5315 | 682 | 355 | 40068 | 70.9 | CACGGATGACGGACCTCGAA | 30 | 27 | 35 | 23 | 16 | 0 |
| 5316 | 683 | 356 | 1845 | 68.9 | CAGCCTGTGGTACACGCGTT | 31 | 14 | 18 | 30 | 12 | 0 |
| 5317 | 684 | 357 | 20165 | 73.6 | CAGCCGAAGCTTGCAAACGG | 31 | 16 | 17 | 21 | 35 | 0 |
| 5318 | 685 | 359 | 13579 | 77.2 | TCTGCAGCGTGCGCAAAGCC | 8 | 31 | 33 | 21 | 36 | 0 |
| 5319 | 686 | 360 | 1860 | 71.6 | TCTGGACCTGCGCCATCTCA | 8 | 32 | 29 | 15 | 13 | 0 |
| 5320 | 687 | 361 | 1861 | 71.7 | GACCCACGGACCTGTCCAGC | 32 | 30 | 32 | 9 | 31 | 0 |
| 5321 | 688 | 362 | 13581 | 70.5 | TCTGGACCGACCAGTGCGTT | 8 | 32 | 32 | 22 | 12 | 0 |
| 5322 | 689 | 364 | 1867 | 70 | GTGCTCGTCTGTGTGCACGG | 33 | 10 | 14 | 33 | 35 | 0 |
| 5323 | 690 | 365 | 30091 | 69.2 | TCTGGTGCGGTACAGCCTCA | 8 | 33 | 18 | 31 | 13 | 0 |
| 5324 | 691 | 366 | 40071 | 73.5 | GTGCATCGGGACATCGGTGC | 33 | 24 | 34 | 24 | 33 | 0 |
| 5325 | 692 | 367 | 40072 | 68.6 | GGACCGTTGTCTAGCCCGTT | 34 | 12 | 19 | 36 | 12 | 0 |
| 5326 | 693 | 368 | 40073 | 70.9 | GGACCCTAATCGACGGCGTT | 34 | 26 | 24 | 35 | 12 | 0 |
| 5327 | 694 | 369 | 1898 | 72.2 | ACGGGAGTGCAACACGGACC | 35 | 20 | 21 | 30 | 32 | 0 |
| 5328 | 695 | 370 | 13593 | 70.8 | ACGGGCAACTTGATCGCTCA | 35 | 21 | 11 | 24 | 13 | 0 |
| 5329 | 696 | 371 | 1902 | 69.3 | ACGGGATGACCTAGCCGATG | 35 | 27 | 23 | 36 | 27 | 0 |
| 5330 | 697 | 372 | 1904 | 72.8 | ACGGACGGGCTTAGTGTGCG | 35 | 35 | 17 | 22 | 29 | 0 |
| 5331 | 698 | 373 | 1906 | 71.3 | AGCCAAAGGTGCCCATCGTT | 36 | 6 | 33 | 15 | 12 | 0 |
| 5332 | 699 | 374 | 40076 | 70.7 | TCTGAGCCGCAAGGTAACGG | 8 | 36 | 21 | 18 | 35 | 0 |
| 5333 | 700 | 377 | 1921 | 73.3 | TTGAAGCCCCATTGCGCCTA | 1 | 36 | 15 | 29 | 26 | 0 |
| 5334 | 701 | 378 | 1924 | 76.9 | AATCCAGCGTGCTGCGTGCG | 4 | 31 | 33 | 29 | 29 | 0 |
| 5335 | 702 | 379 | 1926 | 73.6 | AATCACGGAGCCCACGGGAC | 4 | 35 | 36 | 30 | 34 | 0 |
| 5336 | 703 | 380 | 1927 | 73.2 | AATCAGCCAGCCCAGCTCCC | 4 | 36 | 36 | 31 | 28 | 0 |
| 5337 | 704 | 381 | 1928 | 70.7 | AAAGCCATACGGCAGCGATG | 6 | 15 | 35 | 31 | 27 | 0 |
| 5338 | 705 | 382 | 1933 | 71.5 | AAAGCAGCCACGTGATTGCG | 6 | 31 | 30 | 2 | 29 | 0 |
| 5339 | 706 | 383 | 1936 | 71.5 | TGTCCGAAGGACCAGCTCCC | 9 | 16 | 34 | 31 | 28 | 0 |
| 5340 | 707 | 384 | 13599 | 70.5 | TGTCGCAAAGCCAAAGTCCC | 9 | 21 | 36 | 6 | 28 | 1 |
| 5341 | 708 | 386 | 1943 | 77.7 | TCGTCACGTGCGGACCTGCG | 10 | 30 | 29 | 32 | 29 | 0 |
| 5342 | 709 | 388 | 1946 | 72.4 | TCGTACGGCGTTTTGATGCG | 10 | 35 | 12 | 1 | 29 | 1 |
| 5343 | 710 | 389 | 1947 | 71.9 | CTTGCTCAATCGGTGCGTGC | 11 | 13 | 24 | 33 | 33 | 0 |
| 5344 | 711 | 390 | 30093 | 68.2 | CTTGCACGTTAGGACCCGAA | 11 | 30 | 3 | 32 | 16 | 0 |
| 5345 | 712 | 391 | 1957 | 70.1 | TGTCCTTGGACCCGAAGTGC | 9 | 11 | 32 | 16 | 33 | 0 |
| 5346 | 713 | 394 | 1969 | 71.1 | CGTTACCTTCCCGACCGACC | 12 | 23 | 28 | 32 | 32 | 1 |
| 5347 | 714 | 396 | 1978 | 68.3 | CTCAGCAATGTCGGACAGCC | 13 | 21 | 9 | 34 | 36 | 0 |
| 5348 | 715 | 397 | 20181 | 69.5 | CTCATCCCACCTCACGAGCC | 13 | 28 | 23 | 30 | 36 | 0 |
| 5349 | 716 | 398 | 20184 | 67.5 | CTGTACGGAATCAGCCGACC | 14 | 35 | 4 | 36 | 32 | 0 |
| 5350 | 717 | 400 | 1984 | 72.7 | CCATCTTGGACCCAGCACGG | 15 | 11 | 32 | 31 | 35 | 0 |
| 5351 | 718 | 401 | 1987 | 68.2 | TGTCCCATCGAAAATCCGAA | 9 | 15 | 16 | 4 | 16 | 0 |
| 5352 | 719 | 402 | 13609 | 68.2 | CCATGCAAAGGAAGGAGCAA | 15 | 21 | 25 | 25 | 21 | 0 |
| 5353 | 720 | 403 | 1992 | 69.8 | CCATCCTACGTTGTGCGCAA | 15 | 26 | 12 | 33 | 21 | 0 |

FIG. 29P

| SEQ ID NO: | ZIP ID# | 4,633 ID# | H3X ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5354 | 721 | 404 | 1993 | 71.5 | CCATGATGGCAAGTGCCAGC | 15 | 27 | 21 | 33 | 31 | 0 |
| 5355 | 722 | 405 | 13610 | 71.5 | TGTCCCATCAGCACGGGATG | 9 | 15 | 31 | 35 | 27 | 0 |
| 5356 | 723 | 406 | 13612 | 68.6 | CCATAGCCATACTGCGGTGC | 15 | 36 | 5 | 29 | 33 | 0 |
| 5357 | 724 | 407 | 30095 | 69.4 | CGAACGTTGCTTGGACGATG | 16 | 12 | 17 | 34 | 27 | 0 |
| 5358 | 725 | 408 | 30096 | 67.5 | CGAAGCTTCTTGGGACGGTA | 16 | 17 | 11 | 34 | 18 | 0 |
| 5359 | 726 | 409 | 13616 | 71.3 | TGTCCGAAACCTCGAATGCG | 9 | 16 | 23 | 16 | 29 | 0 |
| 5360 | 727 | 410 | 40078 | 69.8 | CGAAAGGAAGGAGGACGCAA | 16 | 25 | 25 | 34 | 21 | 0 |
| 5361 | 728 | 411 | 2007 | 67.3 | CGAACCTACTCATCCCCACG | 16 | 26 | 13 | 28 | 30 | 0 |
| 5362 | 729 | 412 | 2011 | 70.2 | CGAACAGCGGACAAAGAGCC | 16 | 31 | 34 | 6 | 36 | 0 |
| 5363 | 730 | 413 | 40080 | 68.6 | GCTTCGTTCGTTATCGGCAA | 17 | 12 | 12 | 24 | 21 | 0 |
| 5364 | 731 | 414 | 13620 | 68.2 | GCTTCCATCGTTGATGACGG | 17 | 15 | 12 | 27 | 35 | 0 |
| 5365 | 732 | 415 | 40081 | 67.6 | GCTTGCTTCCATTGTCGCTT | 17 | 17 | 15 | 9 | 17 | 0 |
| 5366 | 733 | 416 | 30098 | 67.3 | GCTTATCGACCTAGCCGTGC | 17 | 24 | 23 | 36 | 33 | 0 |
| 5367 | 734 | 417 | 13621 | 70.7 | TGTCGCTTAGGAAGCCACGG | 9 | 17 | 25 | 36 | 35 | 0 |
| 5368 | 735 | 419 | 2029 | 71 | GGTATCGTTCCCTCCCGTGC | 18 | 10 | 28 | 28 | 33 | 0 |
| 5369 | 736 | 420 | 2031 | 67.3 | GGTAGCAAACCTACGGCAGC | 18 | 21 | 23 | 35 | 31 | 0 |
| 5370 | 737 | 421 | 2034 | 72.8 | TGTCGGTACAGCCAGCGCAA | 9 | 18 | 31 | 31 | 21 | 0 |
| 5371 | 738 | 423 | 2037 | 68.7 | GTCTTCGTGGACCGTTTCCC | 19 | 10 | 34 | 12 | 28 | 1 |
| 5372 | 739 | 424 | 2039 | 71.8 | GTCTCGAATCCCGACCACGG | 19 | 16 | 28 | 32 | 35 | 0 |
| 5373 | 740 | 426 | 2050 | 71.8 | TGTCGAGTCAGCAGCCCGAA | 9 | 20 | 31 | 36 | 16 | 0 |
| 5374 | 741 | 427 | 30099 | 67.5 | GCAATTGACCATAGCCGACC | 21 | 1 | 15 | 36 | 32 | 0 |
| 5375 | 742 | 428 | 2054 | 67 | GCAAAATCTCGTGATGTGCG | 21 | 4 | 10 | 27 | 29 | 0 |
| 5376 | 743 | 429 | 40082 | 68.8 | GCAATCGTGCTTGATGCCAT | 21 | 10 | 17 | 27 | 15 | 0 |
| 5377 | 744 | 433 | 2062 | 73.4 | TGTCGCAAGAGTTGCGCACG | 9 | 21 | 20 | 29 | 30 | 0 |
| 5378 | 745 | 434 | 2063 | 68.9 | GCAAAGTGGTCTGTGCCGAA | 21 | 22 | 19 | 33 | 16 | 0 |
| 5379 | 746 | 435 | 13629 | 73.8 | TGTCGCAATGCGGACCCCTA | 9 | 21 | 29 | 32 | 26 | 0 |
| 5380 | 747 | 437 | 2074 | 76.2 | AGTGCAGCAGCCGGACTGCG | 22 | 31 | 36 | 34 | 29 | 0 |
| 5381 | 748 | 438 | 2079 | 74.6 | ACCTCACGCGAAACGGCGTT | 23 | 30 | 16 | 35 | 12 | 0 |
| 5382 | 749 | 439 | 2082 | 72.9 | ATCGTCGTCAGCGCAAAGCC | 24 | 10 | 31 | 21 | 36 | 0 |
| 5383 | 750 | 440 | 2090 | 74.5 | ATCGGATGGCAAACGGGTGC | 24 | 27 | 21 | 35 | 33 | 0 |
| 5384 | 751 | 441 | 30100 | 76.5 | TGTCATCGTGCGCAGCGTGC | 9 | 24 | 29 | 31 | 33 | 0 |
| 5385 | 752 | 446 | 2107 | 73.4 | CCTACAGCAGCCCAGCGTGC | 26 | 31 | 36 | 31 | 33 | 0 |
| 5386 | 753 | 447 | 40083 | 72.5 | TGTCCCTAACGGGACCTGCG | 9 | 26 | 35 | 32 | 29 | 0 |
| 5387 | 754 | 453 | 2119 | 69.8 | GATGGTGCCCATCTTGCCAT | 27 | 33 | 15 | 11 | 15 | 0 |
| 5388 | 755 | 454 | 40084 | 71.8 | GATGGGACGATGCGTTTCCC | 27 | 34 | 27 | 12 | 28 | 1 |
| 5389 | 756 | 455 | 40085 | 70.3 | TCCCCGTTAGGATTGATGCG | 28 | 12 | 25 | 1 | 29 | 0 |
| 5390 | 757 | 456 | 13642 | 73.5 | TCCCAGGAGGACGACCGCTT | 28 | 25 | 34 | 32 | 17 | 0 |
| 5391 | 758 | 457 | 2135 | 72.8 | TGCGTTGAACGGGACCACCT | 29 | 1 | 35 | 32 | 23 | 0 |
| 5392 | 759 | 458 | 2136 | 75.1 | TGCGAATCGACCCAGCCCAT | 29 | 4 | 32 | 31 | 15 | 0 |
| 5393 | 760 | 459 | 2137 | 72.9 | TGCGAAAGCAGCCTTGGCTT | 29 | 6 | 31 | 11 | 17 | 0 |
| 5394 | 761 | 460 | 40087 | 70.5 | TGCGGGTACGAACCTAACGG | 29 | 18 | 16 | 26 | 35 | 0 |
| 5395 | 762 | 462 | 2145 | 78.1 | TGCGAGTGGCAATGCGGCAA | 29 | 22 | 21 | 29 | 21 | 0 |
| 5396 | 763 | 463 | 2146 | 70.7 | TGCGAGGACGAACACGACCT | 29 | 25 | 16 | 30 | 23 | 0 |
| 5397 | 764 | 465 | 2149 | 75 | TGTCTGCGTGCGGTGCCCTA | 9 | 29 | 29 | 33 | 26 | 0 |
| 5398 | 765 | 466 | 30103 | 76.9 | TGCGGTGCCAGCTCTGGTGC | 29 | 33 | 31 | 8 | 33 | 0 |
| 5399 | 766 | 467 | 13646 | 70.8 | CACGTCGTGACCCTTGCCAT | 30 | 10 | 32 | 11 | 15 | 0 |
| 5400 | 767 | 468 | 2153 | 74.1 | TGTCCACGCTTGGACCCACG | 9 | 30 | 11 | 32 | 30 | 0 |
| 5401 | 768 | 470 | 30104 | 68.7 | TGTCCACGGCTTCCTAGCAA | 9 | 30 | 17 | 26 | 21 | 0 |

FIG. 29Q

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5402 | 769 | 471 | 40088 | 68.9 | CACGGGTACTGTCACGACGG | 30 | 18 | 14 | 30 | 35 | 0 |
| 5403 | 770 | 474 | 2164 | 70.5 | TGTCCACGGACCTCGTGCTT | 9 | 30 | 32 | 10 | 17 | 0 |
| 5404 | 771 | 475 | 40090 | 69.8 | CAGCACCTTCGTACGGTCCC | 31 | 23 | 10 | 35 | 28 | 1 |
| 5405 | 772 | 478 | 40091 | 70 | CAGCGACCTTGAGGACCAGC | 31 | 32 | 1 | 34 | 31 | 0 |
| 5406 | 773 | 479 | 2180 | 70.9 | TGTCGACCAATCTCCCGTGC | 9 | 32 | 4 | 28 | 33 | 0 |
| 5407 | 774 | 483 | 30110 | 71 | GACCAGGACTCATGCGGCAA | 32 | 25 | 13 | 29 | 21 | 0 |
| 5408 | 775 | 486 | 13654 | 68.4 | GTGCAATCAATCCACGCCAT | 33 | 4 | 4 | 30 | 15 | 0 |
| 5409 | 776 | 489 | 2198 | 69.7 | TGTCGTGCTCGTGCAAGACC | 9 | 33 | 10 | 21 | 32 | 0 |
| 5410 | 777 | 490 | 30111 | 72.7 | GTGCCTTGCTGTCACGCACG | 33 | 11 | 14 | 30 | 30 | 0 |
| 5411 | 778 | 491 | 30112 | 70.2 | TGTCGTGCGGTATCTGGCAA | 9 | 33 | 18 | 8 | 21 | 0 |
| 5412 | 779 | 492 | 40092 | 69.6 | GTGCGTCTTCTGGGACGGAC | 33 | 19 | 8 | 34 | 34 | 0 |
| 5413 | 780 | 493 | 2205 | 67 | TGTCGTGCACCTACCTGTGC | 9 | 33 | 23 | 23 | 33 | 0 |
| 5414 | 781 | 494 | 40093 | 68.2 | GTGCAGGACTGTCGAAACGG | 33 | 25 | 14 | 16 | 35 | 0 |
| 5415 | 782 | 496 | 2210 | 70.2 | TGTCGTGCTCCCCGAAAATC | 9 | 33 | 28 | 16 | 4 | 0 |
| 5416 | 783 | 500 | 2218 | 68 | TGTCGGACCTGTGCTTAGCC | 9 | 34 | 14 | 17 | 36 | 0 |
| 5417 | 784 | 502 | 40094 | 68.9 | GGACGTCTGGTAAGCCGCTT | 34 | 19 | 18 | 36 | 17 | 0 |
| 5418 | 785 | 503 | 13659 | 68.6 | TGTCGGACACCTCGTTACGG | 9 | 34 | 23 | 12 | 35 | 0 |
| 5419 | 786 | 504 | 13660 | 67 | TGTCGGACCCTAAATCGCTT | 9 | 34 | 26 | 4 | 17 | 0 |
| 5420 | 787 | 505 | 13661 | 66.7 | GGACGATGAGTGCCTAAGCC | 34 | 27 | 22 | 26 | 36 | 0 |
| 5421 | 788 | 506 | 2226 | 71.7 | GGACTCCCGACCAGTGGTGC | 34 | 28 | 32 | 22 | 33 | 0 |
| 5422 | 789 | 507 | 2230 | 71.5 | TGTCACGGTTGATCCCACGG | 9 | 35 | 1 | 28 | 35 | 1 |
| 5423 | 790 | 509 | 2233 | 73.7 | TGTCACGGCTTGCGTTGCAA | 9 | 35 | 11 | 12 | 21 | 0 |
| 5424 | 791 | 511 | 40096 | 69 | ACGGGCTTACCTGATGCCAT | 35 | 17 | 23 | 27 | 15 | 0 |
| 5425 | 792 | 512 | 30115 | 69.6 | ACGGGAGTAGGACGTTTGCG | 35 | 20 | 25 | 12 | 29 | 0 |
| 5426 | 793 | 513 | 30116 | 71.9 | TGTCACGGGCAAAAAGCGAA | 9 | 35 | 21 | 6 | 16 | 0 |
| 5427 | 794 | 514 | 13665 | 73 | ACGGTCCCCTTGGGACAGGA | 35 | 28 | 11 | 34 | 25 | 1 |
| 5428 | 795 | 516 | 13667 | 67.5 | AGCCCTGTATACCGAATGCG | 36 | 14 | 5 | 16 | 29 | 0 |
| 5429 | 796 | 517 | 2249 | 69.6 | AGCCGCTTTTGACGTTTCGT | 36 | 17 | 1 | 12 | 10 | 0 |
| 5430 | 797 | 518 | 2252 | 69.2 | AGCCACCTGCAAGATGGCTT | 36 | 23 | 21 | 27 | 17 | 0 |
| 5431 | 798 | 519 | 40097 | 70 | AGCCATCGTTAGCAGCCAGC | 36 | 24 | 3 | 31 | 31 | 0 |
| 5432 | 799 | 520 | 13669 | 73.3 | TGTCAGCCGACCGCTTTCGT | 9 | 36 | 32 | 17 | 10 | 0 |
| 5433 | 800 | 521 | 13672 | 68.8 | TGATGCTTCTTGGTGCGCTT | 2 | 17 | 11 | 33 | 17 | 0 |
| 5434 | 801 | 522 | 2282 | 72.7 | TTAGGGACAGCCAGCCACGG | 3 | 34 | 36 | 36 | 35 | 0 |
| 5435 | 802 | 523 | 2287 | 70.3 | AATCCACGCGTTGGTAACGG | 4 | 30 | 12 | 18 | 35 | 0 |
| 5436 | 803 | 524 | 2300 | 70.8 | AAAGGGACAGGATCCCTGCG | 6 | 34 | 25 | 28 | 29 | 0 |
| 5437 | 804 | 526 | 13686 | 69.5 | AAAGAGCCAAAGCACGCCAT | 6 | 36 | 6 | 30 | 15 | 0 |
| 5438 | 805 | 528 | 2310 | 72.5 | TCGTTCTGTGCGCGAAGTGC | 10 | 8 | 29 | 16 | 33 | 0 |
| 5439 | 806 | 529 | 30120 | 68.7 | TCTGCACGATACGACCGCTT | 8 | 30 | 5 | 32 | 17 | 0 |
| 5440 | 807 | 530 | 2316 | 69.8 | TCGTTGTCCGTTGAGTTGCG | 10 | 9 | 12 | 20 | 29 | 0 |
| 5441 | 808 | 531 | 2317 | 73.1 | TGTCCTCAACGGTGCGGCTT | 9 | 13 | 35 | 29 | 17 | 0 |
| 5442 | 809 | 532 | 2321 | 71.3 | TGTCGAGTTGCGCTTGGACC | 9 | 20 | 29 | 11 | 32 | 0 |
| 5443 | 810 | 533 | 30121 | 73 | TCGTTGTCCACGAGCCCGTT | 10 | 9 | 30 | 36 | 12 | 0 |
| 5444 | 811 | 534 | 30122 | 70.9 | TCGTTGTCACGGTCGTGCAA | 10 | 9 | 35 | 10 | 21 | 0 |
| 5445 | 812 | 535 | 13693 | 69.6 | TCGTTCGTGGTATGCGCCTA | 10 | 10 | 18 | 29 | 26 | 0 |
| 5446 | 813 | 536 | 13694 | 70.8 | TCGTTGCGATCGTACATGCG | 10 | 29 | 24 | 7 | 29 | 0 |
| 5447 | 814 | 538 | 30123 | 69.3 | CTTGCGTTCTTGCTTGCAGC | 11 | 12 | 11 | 11 | 31 | 0 |
| 5448 | 815 | 539 | 2340 | 71.4 | TCGTCTTGTCCCGGACTCCC | 10 | 11 | 28 | 34 | 28 | 1 |
| 5449 | 816 | 540 | 13698 | 69.6 | TCGTCTTGGACCAGCCACCT | 10 | 11 | 32 | 36 | 23 | 0 |

FIG. 29R

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 5450 | 817 | 541 | 2345 | 68.5 | CTTGAGCCAGCCATACACGG | 11 | 36 | 36 | 5 | 35 | 0 |
| 5451 | 818 | 542 | 2346 | 70.4 | CGTTTGATGCAACAGCGTGC | 12 | 2 | 21 | 31 | 33 | 0 |
| 5452 | 819 | 543 | 2347 | 70.2 | CGTTTGTCAATCGTGCGTGC | 12 | 9 | 4 | 33 | 33 | 0 |
| 5453 | 820 | 544 | 40099 | 69 | CGTTCGAAGGTAGCAATGCG | 12 | 16 | 18 | 21 | 29 | 0 |
| 5454 | 821 | 546 | 2354 | 68.8 | CGTTACCTCGTTCGAATGCG | 12 | 23 | 12 | 16 | 29 | 0 |
| 5455 | 822 | 549 | 13701 | 75.2 | TCGTCGTTGACCCACGCACG | 10 | 12 | 32 | 30 | 30 | 0 |
| 5456 | 823 | 550 | 2363 | 68.8 | TCGTCGTTAGCCAGCCTTGA | 10 | 12 | 36 | 36 | 1 | 0 |
| 5457 | 824 | 552 | 2367 | 71.8 | TCGTCTCACAGCGTGCCGTT | 10 | 13 | 31 | 33 | 12 | 0 |
| 5458 | 825 | 553 | 13703 | 68 | CTCAAGCCTTAGGTGCCACG | 13 | 36 | 3 | 33 | 30 | 0 |
| 5459 | 826 | 555 | 2375 | 72.4 | CTGTAGCCCAGCTGCGGCTT | 14 | 36 | 31 | 29 | 17 | 0 |
| 5460 | 827 | 556 | 2379 | 71 | CCATCTCAAGCCCCATGCAA | 15 | 13 | 36 | 15 | 21 | 0 |
| 5461 | 828 | 558 | 13705 | 71.9 | CCATCAGCGGTAACGGGACC | 15 | 31 | 18 | 35 | 32 | 0 |
| 5462 | 829 | 559 | 13706 | 71.8 | TCGTCCATGACCCACGCTTG | 10 | 15 | 32 | 30 | 11 | 0 |
| 5463 | 830 | 561 | 2393 | 68.2 | CGAAAATCACGGTGTCGCTT | 16 | 4 | 35 | 9 | 17 | 0 |
| 5464 | 831 | 562 | 2394 | 70.3 | TCGTCGAAAAGGACCACGG | 10 | 16 | 6 | 32 | 35 | 0 |
| 5465 | 832 | 563 | 2395 | 73.8 | CGAATCTGTGCGGGACCACG | 16 | 8 | 29 | 34 | 30 | 0 |
| 5466 | 833 | 564 | 40100 | 71.6 | TCGTCGAAACCTTCCCGGAC | 10 | 16 | 23 | 28 | 34 | 1 |
| 5467 | 834 | 565 | 13712 | 67.9 | TCGTCGAAAGGAATCGGATG | 10 | 16 | 25 | 24 | 27 | 0 |
| 5468 | 835 | 566 | 2407 | 73.6 | TCGTCGAAGTGCGCAATCCC | 10 | 16 | 33 | 21 | 28 | 0 |
| 5469 | 836 | 567 | 2413 | 69.1 | TCGTGCTTCTCAGACCTGCG | 10 | 17 | 13 | 32 | 29 | 0 |
| 5470 | 837 | 568 | 2429 | 69.8 | TCGTGGTAAGCCCACGGAGT | 10 | 18 | 36 | 30 | 20 | 0 |
| 5471 | 838 | 569 | 2431 | 71.2 | GTCTCGTTTCCCACGGAGCC | 19 | 12 | 28 | 35 | 36 | 1 |
| 5472 | 839 | 570 | 13723 | 73.4 | GTCTGCAAAGCCAGCCGTGC | 19 | 21 | 36 | 36 | 33 | 0 |
| 5473 | 840 | 571 | 2435 | 71.5 | TCGTGTCTGTGCATCGTGCG | 10 | 19 | 33 | 24 | 29 | 0 |
| 5474 | 841 | 572 | 2436 | 69.8 | GAGTTCGTCAGCGGACGACC | 20 | 10 | 31 | 34 | 32 | 0 |
| 5475 | 842 | 573 | 20241 | 68.7 | GAGTCCATTGCGGTCTTCCC | 20 | 15 | 29 | 19 | 28 | 0 |
| 5476 | 843 | 574 | 40102 | 68 | TCGTGCAATTGATGTCGTGC | 10 | 21 | 1 | 9 | 33 | 0 |
| 5477 | 844 | 575 | 2447 | 66.7 | TCGTGCAAGCTTCTTGGATG | 10 | 21 | 17 | 11 | 27 | 0 |
| 5478 | 845 | 576 | 2452 | 75 | TCGTGCAATGCGGTGCTCGT | 10 | 21 | 29 | 33 | 10 | 0 |
| 5479 | 846 | 577 | 2454 | 70.9 | TCGTGCAAGGACAGCCTCGT | 10 | 21 | 34 | 36 | 10 | 0 |
| 5480 | 847 | 578 | 2457 | 72.5 | AGTGTGCGGGTAACGGGTGC | 22 | 29 | 18 | 35 | 33 | 0 |
| 5481 | 848 | 579 | 2459 | 74.3 | AGTGGTGCGATGGTGCGTGC | 22 | 33 | 27 | 33 | 33 | 0 |
| 5482 | 849 | 580 | 2469 | 73.7 | ACCTCAGCACGGACGGGGAC | 23 | 31 | 35 | 35 | 34 | 0 |
| 5483 | 850 | 583 | 13733 | 69.4 | TCGTATCGGCTTATCGCACG | 10 | 24 | 17 | 24 | 30 | 0 |
| 5484 | 851 | 584 | 2485 | 73.1 | ATCGGGACGACCTCCCAGGA | 24 | 34 | 32 | 28 | 25 | 0 |
| 5485 | 852 | 585 | 20255 | 67.7 | AGGAGACCTCTGAGCCAGCC | 25 | 32 | 8 | 36 | 36 | 0 |
| 5486 | 853 | 586 | 2491 | 71.4 | AGGAAGCCCCATCCATGTGC | 25 | 36 | 15 | 15 | 33 | 0 |
| 5487 | 854 | 587 | 20256 | 70.5 | CCTAAAAGTGCGTGCGAGCC | 26 | 6 | 29 | 29 | 36 | 0 |
| 5488 | 855 | 590 | 2516 | 72.3 | TCGTGATGAGCCGCAACAGC | 10 | 27 | 36 | 21 | 31 | 0 |
| 5489 | 856 | 592 | 13744 | 68 | TCGTTCCCCTGTTTAGCGAA | 10 | 28 | 14 | 3 | 16 | 0 |
| 5490 | 857 | 593 | 40104 | 69.3 | TCGTTCCCCCATAAAGGTGC | 10 | 28 | 15 | 6 | 33 | 0 |
| 5491 | 858 | 594 | 2528 | 68.7 | TCCCGTCTGCAACCTAGCAA | 28 | 19 | 21 | 26 | 21 | 0 |
| 5492 | 859 | 595 | 40106 | 70.6 | TCCCGAGTCCATCTTGGCAA | 28 | 20 | 15 | 11 | 21 | 0 |
| 5493 | 860 | 598 | 13745 | 73.5 | TCGTTCCCTGCGTCGTACGG | 10 | 28 | 29 | 10 | 35 | 0 |
| 5494 | 861 | 600 | 30130 | 73.3 | TCGTTCCCGGACTGTCGTGC | 10 | 28 | 34 | 9 | 33 | 0 |
| 5495 | 862 | 601 | 13747 | 70.4 | TCGTTGCGAATCAATCGCAA | 10 | 29 | 4 | 4 | 21 | 0 |
| 5496 | 863 | 603 | 30132 | 70 | TGCGTCGTAGTGGAGTTGCG | 29 | 10 | 22 | 20 | 29 | 0 |
| 5497 | 864 | 604 | 13748 | 73.3 | TCGTTGCGCTCATTGATGCG | 10 | 29 | 13 | 1 | 29 | 0 |

FIG. 29S

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 5498 | 865 | 605 | 30133 | 71 | TGCGGAGTGGTAGACCCACG | 29 | 20 | 18 | 32 30 | 0 |
| 5499 | 866 | 607 | 2550 | 69.8 | TCGTTGCGAGTGAAAGCGAA | 10 | 29 | 22 | 6 16 | 0 |
| 5500 | 867 | 608 | 30134 | 72.4 | TGCGGATGGGTAGGACAGCC | 29 | 27 | 18 | 34 36 | 0 |
| 5501 | 868 | 611 | 2558 | 75.6 | TCGTTGCGCAGCTGTCCACG | 10 | 29 | 31 | 9 30 | 0 |
| 5502 | 869 | 612 | 2559 | 73.5 | TCGTTGCGGACCAAAGGTGC | 10 | 29 | 32 | 6 33 | 0 |
| 5503 | 870 | 614 | 2561 | 71 | TCGTTGCGAGCCAATCTCGT | 10 | 29 | 36 | 4 10 | 0 |
| 5504 | 871 | 615 | 20265 | 66.3 | CACGAAAGATACACGGCAGC | 30 | 6 | 5 | 35 31 | 0 |
| 5505 | 872 | 616 | 2564 | 73.1 | CACGTCTGTCCCTGCGAGCC | 30 | 8 | 28 | 29 36 | 0 |
| 5506 | 873 | 617 | 2565 | 71 | CACGCTTGCTCACAGCTCCC | 30 | 11 | 13 | 31 28 | 0 |
| 5507 | 874 | 618 | 13749 | 69.4 | TCGTCACGCGTTTCTGGGTA | 10 | 30 | 12 | 8 18 | 0 |
| 5508 | 875 | 619 | 30135 | 68.7 | TCGTCACGCTGTAGCCCCTA | 10 | 30 | 14 | 36 26 | 0 |
| 5509 | 876 | 620 | 2569 | 70 | TCGTCACGCCATGATGGATG | 10 | 30 | 15 | 27 27 | 0 |
| 5510 | 877 | 621 | 2574 | 68.2 | CACGGCAATACAGACCGGAC | 30 | 21 | 7 | 32 34 | 0 |
| 5511 | 878 | 622 | 20267 | 66.1 | CACGAGTGAAAGGCTTGTGC | 30 | 22 | 6 | 17 33 | 0 |
| 5512 | 879 | 623 | 13751 | 69.4 | TCGTCACGATCGTCTGACGG | 10 | 30 | 24 | 8 35 | 0 |
| 5513 | 880 | 624 | 2580 | 74 | TCGTCACGACGGGATGACGG | 10 | 30 | 35 | 27 35 | 0 |
| 5514 | 881 | 625 | 2585 | 68.6 | TCGTCAGCCTCATGTCAGCC | 10 | 31 | 13 | 9 36 | 0 |
| 5515 | 882 | 626 | 2587 | 70.4 | CAGCCCATGACCTGTCAGCC | 31 | 15 | 32 | 9 36 | 0 |
| 5516 | 883 | 627 | 40109 | 67.2 | CAGCGGTATTGAGGACCGTT | 31 | 18 | 1 | 34 12 | 0 |
| 5517 | 884 | 628 | 30137 | 69.9 | CAGCGAGTAGTGCAGCGTGC | 31 | 20 | 22 | 31 33 | 0 |
| 5518 | 885 | 630 | 13756 | 72.2 | CAGCGACCGAGTTCGTTCCC | 31 | 32 | 20 | 10 28 | 0 |
| 5519 | 886 | 631 | 2601 | 70.5 | GACCAATCCGTTGGACTGCG | 32 | 4 | 12 | 34 29 | 0 |
| 5520 | 887 | 632 | 2602 | 70.2 | GACCAAAGCTTGAGCCGTGC | 32 | 6 | 11 | 36 33 | 0 |
| 5521 | 888 | 633 | 40110 | 66.5 | GACCCGTTACCTTCTGACGG | 32 | 12 | 23 | 8 35 | 0 |
| 5522 | 889 | 634 | 40111 | 68.9 | GACCCTGTTTGAAGCCGCTT | 32 | 14 | 1 | 36 17 | 0 |
| 5523 | 890 | 635 | 30138 | 68.7 | GACCGCTTCCATGAGTTCCC | 32 | 17 | 15 | 20 28 | 0 |
| 5524 | 891 | 636 | 30139 | 72.8 | GACCGTCTGGACGTGCGACC | 32 | 19 | 34 | 33 32 | 0 |
| 5525 | 892 | 637 | 40112 | 68.2 | GACCATCGTCGTAGGATGCG | 32 | 24 | 10 | 25 29 | 0 |
| 5526 | 893 | 639 | 2614 | 66.6 | TCGTGTGCAATCTCTGCCAT | 10 | 33 | 4 | 8 15 | 0 |
| 5527 | 894 | 640 | 2615 | 71.6 | GTGCTCTGCCATAGCCGCAA | 33 | 8 | 15 | 36 21 | 0 |
| 5528 | 895 | 641 | 2616 | 71.9 | TCGTGTGCTGTCGCAATCCC | 10 | 33 | 9 | 21 28 | 0 |
| 5529 | 896 | 642 | 30141 | 68.5 | GTGCCTTGATACCACGCAGC | 33 | 11 | 5 | 30 31 | 0 |
| 5530 | 897 | 643 | 20269 | 69 | TCGTGTGCCTGTGCTTCCAT | 10 | 33 | 14 | 17 15 | 0 |
| 5531 | 898 | 645 | 20270 | 69.9 | GTGCGGTAACCTACGGACGG | 33 | 18 | 23 | 35 35 | 0 |
| 5532 | 899 | 646 | 2626 | 68.7 | GTGCGTCTGGACAGTGCGTT | 33 | 19 | 34 | 22 12 | 0 |
| 5533 | 900 | 647 | 2627 | 70 | TCGTGTGCGAGTCACGAGGA | 10 | 33 | 20 | 30 25 | 0 |
| 5534 | 901 | 648 | 2628 | 71.7 | TCGTGTGCGCAAAAGAGCC | 10 | 33 | 21 | 6 36 | 0 |
| 5535 | 902 | 651 | 2637 | 71.8 | GGACTTGATCCCTGCGCGTT | 34 | 1 | 28 | 29 12 | 0 |
| 5536 | 903 | 652 | 2638 | 71.5 | GGACAATCCAGCGACCCGTT | 34 | 4 | 31 | 32 12 | 0 |
| 5537 | 904 | 653 | 2639 | 70.5 | GGACAAAGGCAAGTGCCGAA | 34 | 6 | 21 | 33 16 | 0 |
| 5538 | 905 | 654 | 20272 | 69.5 | TCGTGGACCTTGGACCGTCT | 10 | 34 | 11 | 32 19 | 0 |
| 5539 | 906 | 655 | 40114 | 71.7 | TCGTGGACCTGTTGCGCCTA | 10 | 34 | 14 | 29 26 | 0 |
| 5540 | 907 | 656 | 40115 | 69.6 | GGACGAGTTCTGGTGCGACC | 34 | 20 | 8 | 33 32 | 0 |
| 5541 | 908 | 658 | 13764 | 69.2 | GGACGATGCCTACAGCCCAT | 34 | 27 | 26 | 31 15 | 0 |
| 5542 | 909 | 659 | 13765 | 67.7 | GGACTCCTCCCATACAGCC | 34 | 28 | 28 | 5 36 | 0 |
| 5543 | 910 | 660 | 2653 | 74.8 | TCGTGGACTGCGGTGCCTCA | 10 | 34 | 29 | 33 13 | 0 |
| 5544 | 911 | 661 | 40117 | 67.9 | GGACCACGTTAGATCGGCAA | 34 | 30 | 3 | 24 21 | 0 |
| 5545 | 912 | 662 | 2658 | 70.3 | GGACAGCCCCATAGTGCGAA | 34 | 36 | 15 | 22 16 | 0 |

FIG. 29T

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5546 | 913 | 664 | 30143 | 69.9 | ACGGTCGTTCTGATCGCGTT | 35 | 10 | 8 | 24 | 12 | 0 |
| 5547 | 914 | 665 | 13771 | 71.4 | ACGGCCATGGTATCGTGCAA | 35 | 15 | 18 | 10 | 21 | 0 |
| 5548 | 915 | 666 | 40118 | 69.9 | ACGGCCTAATCGCTCAATCG | 35 | 26 | 24 | 13 | 24 | 0 |
| 5549 | 916 | 668 | 2677 | 69.9 | TCGTAGCCTTGACAGCGCAA | 10 | 36 | 1 | 31 | 21 | 0 |
| 5550 | 917 | 669 | 2681 | 72.2 | AGCCTGTCGGTAAGCCTGCG | 36 | 9 | 18 | 36 | 29 | 0 |
| 5551 | 918 | 670 | 13779 | 67.5 | AGCCTCGTAGGACTGTTGCG | 36 | 10 | 25 | 14 | 29 | 0 |
| 5552 | 919 | 671 | 13780 | 70.5 | AGCCCGTTTCTGTTGATGCG | 36 | 12 | 8 | 1 | 29 | 0 |
| 5553 | 920 | 672 | 13781 | 70.6 | AGCCCCATGAGTGACCCCAT | 36 | 15 | 20 | 32 | 15 | 0 |
| 5554 | 921 | 673 | 30148 | 71.8 | AGCCTGCGATACTCCCCACG | 36 | 29 | 5 | 28 | 30 | 0 |
| 5555 | 922 | 674 | 2696 | 72.7 | TTGAAGCCGACCGGTAACGG | 1 | 36 | 32 | 18 | 35 | 0 |
| 5556 | 923 | 675 | 2703 | 75.4 | AATCGACCACGGGTGCACGG | 4 | 32 | 35 | 33 | 35 | 0 |
| 5557 | 924 | 676 | 2709 | 73.9 | AAAGTCCCGGACCGAATGCG | 6 | 28 | 34 | 16 | 29 | 1 |
| 5558 | 925 | 677 | 2719 | 73.5 | TCTGCACGGACCCCTATGCG | 8 | 30 | 32 | 26 | 29 | 0 |
| 5559 | 926 | 680 | 20288 | 68.8 | CTTGCTTGACCTGCAAACGG | 11 | 11 | 23 | 21 | 35 | 0 |
| 5560 | 927 | 681 | 2735 | 66.3 | CTTGATCGTTAGTGCGACGG | 11 | 24 | 3 | 29 | 35 | 0 |
| 5561 | 928 | 682 | 40122 | 69.4 | CTTGCCTACTTGCACGGCAA | 11 | 26 | 11 | 30 | 21 | 0 |
| 5562 | 929 | 683 | 2737 | 71 | CTTGGATGGACATCGCGAA | 11 | 27 | 34 | 24 | 16 | 0 |
| 5563 | 930 | 684 | 30149 | 70.3 | CGTTTTGAAGCCGGTAACGG | 12 | 1 | 36 | 18 | 35 | 1 |
| 5564 | 931 | 685 | 13804 | 70.2 | CTTGCGTTACCTTGCGGACC | 11 | 12 | 23 | 29 | 32 | 0 |
| 5565 | 932 | 687 | 2767 | 69.6 | CTCACACGGGACAGGAAGCC | 13 | 30 | 34 | 25 | 36 | 0 |
| 5566 | 933 | 688 | 2769 | 74 | CTCAGTGCCAGCGACCACGG | 13 | 33 | 31 | 32 | 35 | 0 |
| 5567 | 934 | 689 | 40125 | 69.5 | CTGTGCAAGTGCCGTTACGG | 14 | 21 | 33 | 12 | 35 | 0 |
| 5568 | 935 | 690 | 30151 | 71.9 | CTTGCCATCCATCACGGCAA | 11 | 15 | 15 | 30 | 21 | 0 |
| 5569 | 936 | 691 | 30152 | 68.5 | CCATGCTTAGTGGTGCAGCC | 15 | 17 | 22 | 33 | 36 | 0 |
| 5570 | 937 | 693 | 30153 | 68.7 | CTTGCGAATTGAATCGGTGC | 11 | 16 | 1 | 24 | 33 | 0 |
| 5571 | 938 | 694 | 40127 | 66.4 | CGAAGCTTCCTAGGACGCTT | 16 | 17 | 26 | 34 | 17 | 0 |
| 5572 | 939 | 696 | 2811 | 69.6 | CTTGGCTTCCATCACGTCCC | 11 | 17 | 15 | 30 | 28 | 0 |
| 5573 | 940 | 697 | 2813 | 71.2 | GCTTGTCTTCCCGACCGGAC | 17 | 19 | 28 | 32 | 34 | 0 |
| 5574 | 941 | 698 | 40128 | 71.3 | GCTTCAGCGGACCTGTTCCC | 17 | 31 | 34 | 14 | 28 | 0 |
| 5575 | 942 | 699 | 30155 | 70.1 | GCTTGTGCCTTGCTTGGCTT | 17 | 33 | 11 | 11 | 17 | 0 |
| 5576 | 943 | 700 | 40129 | 70.1 | GCTTACGGCGTTAGCCAGGA | 17 | 35 | 12 | 36 | 25 | 0 |
| 5577 | 944 | 701 | 2828 | 66.4 | GTCTTCGTCCTATCCCACGG | 19 | 10 | 26 | 28 | 35 | 0 |
| 5578 | 945 | 702 | 20300 | 69.8 | GTCTCACGGCAAGACCCAGC | 19 | 30 | 21 | 32 | 31 | 0 |
| 5579 | 946 | 703 | 40132 | 68.6 | GCAAGCTTTGATTCCCCCAT | 21 | 17 | 2 | 28 | 15 | 0 |
| 5580 | 947 | 704 | 2847 | 68.3 | GCAAGAGTGGACAGGATGCG | 21 | 20 | 34 | 25 | 29 | 0 |
| 5581 | 948 | 705 | 30156 | 68 | GCAAACCTTTAGCACGCGTT | 21 | 23 | 3 | 30 | 12 | 0 |
| 5582 | 949 | 706 | 30157 | 66.7 | GCAAATCGAAAGGATGGCTT | 21 | 24 | 6 | 27 | 17 | 0 |
| 5583 | 950 | 707 | 40133 | 68.9 | CTTGGCAAAGGAAGCCCTGT | 11 | 21 | 25 | 36 | 14 | 0 |
| 5584 | 951 | 708 | 30158 | 75.4 | GCAAGACCAGCCGTGCGACC | 21 | 32 | 36 | 33 | 32 | 0 |
| 5585 | 952 | 709 | 2858 | 70.3 | AGTGCGAAGACCATCGACGG | 22 | 16 | 32 | 24 | 35 | 0 |
| 5586 | 953 | 710 | 2866 | 75.2 | ACCTGTGCGGACAGCCCGAA | 23 | 33 | 34 | 36 | 16 | 0 |
| 5587 | 954 | 712 | 30159 | 71.7 | AGGATGCGACCTCAGCGGAC | 25 | 29 | 23 | 31 | 34 | 0 |
| 5588 | 955 | 713 | 2881 | 74.5 | AGGACACGAGCCCAGCCGAA | 25 | 30 | 36 | 31 | 16 | 0 |
| 5589 | 956 | 714 | 13849 | 68.1 | CTTGCCTAATCGAGGATGCG | 11 | 26 | 24 | 25 | 29 | 0 |
| 5590 | 957 | 715 | 13852 | 66.9 | CCTAACGGTCCCAATCCTCA | 26 | 35 | 28 | 4 | 13 | 1 |
| 5591 | 958 | 716 | 20309 | 67.9 | CTTGGATGTCGTGACCAGCC | 11 | 27 | 10 | 32 | 36 | 0 |
| 5592 | 959 | 717 | 13853 | 71.2 | CTTGGATGCTTGCAGCAGCC | 11 | 27 | 11 | 31 | 36 | 0 |
| 5593 | 960 | 718 | 2898 | 68.5 | CTTGGATGCGTTGCTTGACC | 11 | 27 | 12 | 17 | 32 | 0 |

FIG. 29U

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5594 | 961 | 719 | 2899 | 68.9 | GATGCTGTTCGTCAGCCGAA | 27 | 14 | 10 | 31 | 16 | 0 |
| 5595 | 962 | 720 | 30160 | 69.8 | GATGGCAAAGCCGAGTGCTT | 27 | 21 | 36 | 20 | 17 | 0 |
| 5596 | 963 | 722 | 2910 | 71 | TCCCCTGTCTTGAGCCCCAT | 28 | 14 | 11 | 36 | 15 | 0 |
| 5597 | 964 | 723 | 2921 | 73.2 | TCCCACGGGCAATTGAATCG | 28 | 35 | 21 | 1 | 24 | 0 |
| 5598 | 965 | 724 | 2926 | 76.7 | TGCGTGTCCAGCGTGCTCCC | 29 | 9 | 31 | 33 | 28 | 0 |
| 5599 | 966 | 725 | 13864 | 72.3 | TGCGTCGTTTGACAGCCAGC | 29 | 10 | 1 | 31 | 31 | 0 |
| 5600 | 967 | 728 | 2938 | 75.1 | TGCGTGCGCCATTCTGCTGT | 29 | 29 | 15 | 8 | 14 | 0 |
| 5601 | 968 | 729 | 2940 | 73.9 | CTTGTGCGCAGCAGTGCACG | 11 | 29 | 31 | 22 | 30 | 0 |
| 5602 | 969 | 730 | 13871 | 68.1 | CACGAATCTCTGGACCGTGC | 30 | 4 | 8 | 32 | 33 | 0 |
| 5603 | 970 | 732 | 2947 | 67.9 | CTTGCACGCTTGTTGAGCAA | 11 | 30 | 11 | 1 | 21 | 1 |
| 5604 | 971 | 734 | 2951 | 71.1 | CTTGCACGAGTGGCAAAGCC | 11 | 30 | 22 | 21 | 36 | 0 |
| 5605 | 972 | 735 | 40137 | 67.7 | CACGAGGACCTACACGCCAT | 30 | 25 | 26 | 30 | 15 | 0 |
| 5606 | 973 | 736 | 2959 | 69.3 | CTTGCAGCTGATACGGGCAA | 11 | 31 | 2 | 35 | 21 | 0 |
| 5607 | 974 | 737 | 2960 | 71.8 | CAGCAATCGTGCATCGAGCC | 31 | 4 | 33 | 24 | 36 | 0 |
| 5608 | 975 | 738 | 30162 | 68.2 | CAGCCTCAGGTATCCCCCAT | 31 | 13 | 18 | 28 | 15 | 0 |
| 5609 | 976 | 739 | 13879 | 72.1 | CTTGCAGCGGTAATCGTGCG | 11 | 31 | 18 | 24 | 29 | 0 |
| 5600 | 977 | 740 | 13880 | 66.2 | CAGCGTCTAAAGACGGCTCA | 31 | 19 | 6 | 35 | 13 | 0 |
| 5611 | 978 | 741 | 13883 | 68.7 | CAGCGACCTACAGTGCCAGC | 31 | 32 | 7 | 33 | 31 | 0 |
| 5612 | 979 | 742 | 2979 | 70.1 | GACCTTGAGACCACGGGCAA | 32 | 1 | 32 | 35 | 21 | 0 |
| 5613 | 980 | 743 | 40139 | 68.7 | GACCAGGACCTAACGGACGG | 32 | 25 | 26 | 35 | 35 | 0 |
| 5614 | 981 | 744 | 20324 | 68.2 | GACCGGACCCTAGATGCCAT | 32 | 34 | 26 | 27 | 15 | 0 |
| 5615 | 982 | 745 | 30163 | 67.8 | CTTGGTGCGGTACTCAAGCC | 11 | 33 | 18 | 13 | 36 | 0 |
| 5616 | 983 | 746 | 40140 | 72.2 | GTGCGTCTTCGTGTGCCGAA | 33 | 19 | 10 | 33 | 16 | 0 |
| 5617 | 984 | 747 | 13893 | 67.2 | GTGCGAGTAATCGACCCGTT | 33 | 20 | 4 | 32 | 12 | 0 |
| 5618 | 985 | 748 | 20327 | 71.8 | CTTGGTGCGGACTCTGTGCG | 11 | 33 | 34 | 8 | 29 | 0 |
| 5619 | 986 | 750 | 30165 | 68 | GGACATCGAGGAGCTTGCAA | 34 | 24 | 25 | 17 | 21 | 0 |
| 5620 | 987 | 751 | 3019 | 71.7 | CTTGGGACGACCCGTTGCTT | 11 | 34 | 32 | 12 | 17 | 0 |
| 5621 | 988 | 752 | 40142 | 71.2 | ACGGGAGTAGCCACGGGGTA | 35 | 20 | 36 | 35 | 18 | 0 |
| 5622 | 989 | 754 | 13905 | 70.8 | ACGGACCTCACGGACCCTGT | 35 | 23 | 30 | 32 | 14 | 0 |
| 5623 | 990 | 755 | 30166 | 70.8 | ACGGAGGATCGTAGCCGGAC | 35 | 25 | 10 | 36 | 34 | 0 |
| 5624 | 991 | 756 | 13906 | 71.5 | ACGGGATGGGTAAGGATGCG | 35 | 27 | 18 | 25 | 29 | 0 |
| 5625 | 992 | 757 | 3036 | 70 | AGCCTTGACTCATCCCGCAA | 36 | 1 | 13 | 28 | 21 | 0 |
| 5626 | 993 | 758 | 3037 | 72.1 | AGCCTGATAGCCTGCGACGG | 36 | 2 | 36 | 29 | 35 | 0 |
| 5627 | 994 | 761 | 13910 | 71.5 | AGCCGAGTGTGCTGATTGCG | 36 | 20 | 33 | 2 | 29 | 0 |
| 5628 | 995 | 763 | 3053 | 68.4 | AGCCTCCCTGATCCATACGG | 36 | 28 | 2 | 15 | 35 | 0 |
| 5629 | 996 | 764 | 13912 | 72.8 | AGCCCAGCGGACTACATGCG | 36 | 31 | 34 | 7 | 29 | 0 |
| 5630 | 997 | 765 | 20336 | 71.2 | AGCCGGACGAGTTCGTAGCC | 36 | 34 | 20 | 10 | 36 | 0 |
| 5631 | 998 | 766 | 30168 | 71.5 | TTGAATCGGGACGTGCAGGA | 1 | 24 | 34 | 33 | 25 | 0 |
| 5632 | 999 | 767 | 13918 | 73.3 | TGATCACGCTCATGCGCAGC | 2 | 30 | 13 | 29 | 31 | 0 |
| 5633 | 1000 | 768 | 13920 | 66.8 | TTAGGCAAGATGGGACCGTT | 3 | 21 | 27 | 34 | 12 | 0 |
| 5634 | 1001 | 769 | 40145 | 68.5 | AATCGCAAGCTTTGTCGTGC | 4 | 21 | 17 | 9 | 33 | 0 |
| 5635 | 1002 | 770 | 3086 | 73.6 | AATCTCCCACGTCCCGTGC | 4 | 28 | 30 | 28 | 33 | 0 |
| 5636 | 1003 | 771 | 40146 | 71.9 | AATCCACGCTCAAGCCAGCC | 4 | 30 | 13 | 36 | 36 | 0 |
| 5637 | 1004 | 772 | 30172 | 69.8 | AAAGCCATTCCCAAAGCACG | 6 | 15 | 28 | 6 | 30 | 0 |
| 5638 | 1005 | 774 | 3109 | 66.4 | TCTCGTTGGTAAGGAGCAA | 8 | 12 | 18 | 25 | 21 | 0 |
| 5639 | 1006 | 775 | 13938 | 66.9 | TCTGGCAATTAGCTTGCGAA | 8 | 21 | 3 | 11 | 16 | 0 |
| 5640 | 1007 | 776 | 30174 | 69.9 | TCTGGGACAATCGCAATCCC | 8 | 34 | 4 | 21 | 28 | 0 |
| 5641 | 1008 | 777 | 3121 | 72.4 | CGTTTCTGAGCCGGACAGCC | 12 | 8 | 36 | 34 | 36 | 0 |

FIG. 29V

| SEQ ID NO: | ZIP ID# | 4,633 ID# | HEX ID# Tm | ZIPCODE (NH2 -> CONH2) | T3TRAMER NUMBERS | | | | "UNALLOWED DIMERS" |
|---|---|---|---|---|---|---|---|---|---|
| 5642 | 1009 | 778 | 40147 70.1 | TGTCCCATCACGTGTCTGCG | 9 | 15 | 30 | 9 29 | 0 |
| 5643 | 1010 | 779 | 3127 72.2 | TGTCGTCTTGCGGGTATGCG | 9 | 19 | 29 | 18 29 | 0 |
| 5644 | 1011 | 780 | 3129 71.8 | TGTCATCGCGTTCACGTCCC | 9 | 24 | 12 | 30 28 | 0 |
| 5645 | 1012 | 781 | 3131 69.7 | TGTCGATGCCATACCTTGCG | 9 | 27 | 15 | 23 29 | 0 |
| 5646 | 1013 | 782 | 20344 69.3 | CGTTTCGTAAAGCGAATGCG | 12 | 10 | 6 | 16 29 | 0 |
| 5647 | 1014 | 783 | 30177 70.6 | CGTTTCGTGGTAACGGCGTT | 12 | 10 | 18 | 35 12 | 0 |
| 5648 | 1015 | 785 | 40148 68 | TCGTACGGAAAGCTTGCCAT | 10 | 35 | 6 | 11 15 | 0 |
| 5649 | 1016 | 786 | 40149 72.3 | CTTGCAGCCGTTCCATGCAA | 11 | 31 | 12 | 15 21 | 0 |
| 5650 | 1017 | 787 | 30179 68.5 | CGTTTTGAGCAATCCCATCG | 12 | 1 | 21 | 28 24 | 1 |
| 5651 | 1018 | 788 | 3159 70 | CGTTAAAGACGGTCCCGTGC | 12 | 6 | 35 | 28 33 | 1 |
| 5652 | 1019 | 789 | 40151 68.1 | CGTTCGAAAAGAGGATGCG | 12 | 16 | 6 | 25 29 | 0 |
| 5653 | 1020 | 790 | 3165 72.9 | CGTTCGTTGTCTTGCGTGCG | 12 | 12 | 19 | 29 29 | 0 |
| 5654 | 1021 | 791 | 13963 73.4 | CTCAATCGGACCCACGCGAA | 13 | 24 | 32 | 30 16 | 0 |
| 5655 | 1022 | 792 | 3182 69.8 | CGTTCTCAACGGGACCCTTG | 12 | 13 | 35 | 32 11 | 0 |
| 5656 | 1023 | 793 | 3183 67.6 | CTGTTCGTAGGAACGGACGG | 14 | 10 | 25 | 35 35 | 0 |
| 5657 | 1024 | 794 | 3190 72.9 | CCATTGTCGACCAGCCCAGC | 15 | 9 | 32 | 36 31 | 0 |
| 5658 | 1025 | 795 | 13969 69.1 | CCATCCATCGAACTGTTGCG | 15 | 15 | 16 | 14 29 | 0 |
| 5659 | 1026 | 796 | 13970 71.7 | CGTTCCATATCGCCATTGCG | 12 | 15 | 24 | 15 29 | 0 |
| 5660 | 1027 | 797 | 3201 67.9 | CCATGATGTGATCAGCGCAA | 15 | 27 | 2 | 31 21 | 0 |
| 5661 | 1028 | 798 | 3202 69.4 | CCATGACCAATCGATGCGAA | 15 | 32 | 4 | 27 16 | 0 |
| 5662 | 1029 | 799 | 3203 70.2 | CGTTCCATGGACGCAAACCT | 12 | 15 | 34 | 21 23 | 0 |
| 5663 | 1030 | 800 | 20357 67.7 | CGTTCCATACGGAGCCTCTG | 12 | 15 | 35 | 36 8 | 0 |
| 5664 | 1031 | 801 | 30185 68.7 | CGTTCGAATCGTAGCCGATG | 12 | 16 | 10 | 36 27 | 0 |
| 5665 | 1032 | 802 | 13972 70.9 | CGAACTTGCACGGCTTGACC | 16 | 11 | 30 | 17 32 | 0 |
| 5666 | 1033 | 803 | 3210 68.1 | CGAACTCAGATGTCCCGTGC | 16 | 13 | 27 | 28 33 | 0 |
| 5667 | 1034 | 805 | 20361 70.1 | CGTTCGAAGAGTTGCGGCTT | 12 | 16 | 20 | 29 17 | 0 |
| 5668 | 1035 | 806 | 40152 67.8 | CGAAATCGTACAACGGAGCC | 16 | 24 | 7 | 35 36 | 0 |
| 5669 | 1036 | 807 | 13977 73 | CGTTCGAAGACCGACCCACG | 12 | 16 | 32 | 32 30 | 0 |
| 5670 | 1037 | 808 | 20363 68.9 | GCTTGTCTACGGGGACGACC | 17 | 19 | 35 | 34 32 | 0 |
| 5671 | 1038 | 812 | 3249 65.4 | GTCTCGTTATCGGTCTTGCG | 19 | 12 | 24 | 19 29 | 0 |
| 5672 | 1039 | 813 | 3257 71.3 | GAGTTCGTGCAAACGGGCAA | 20 | 10 | 21 | 35 21 | 0 |
| 5673 | 1040 | 814 | 3260 69 | GAGTCAGCCGAACGTTTCCC | 20 | 31 | 16 | 12 28 | 1 |
| 5674 | 1041 | 815 | 20369 69.2 | CGTTGAGTGGACGATGCAGC | 12 | 20 | 34 | 27 31 | 0 |
| 5675 | 1042 | 816 | 13992 70.6 | CGTTGCAATGATGCTTTGCG | 12 | 21 | 2 | 17 29 | 0 |
| 5676 | 1043 | 817 | 40155 67.7 | GCAACGAACGAAAATCGACC | 21 | 16 | 16 | 4 32 | 0 |
| 5677 | 1044 | 818 | 30191 69.1 | GCAAGGTAGACCTGCGGACC | 21 | 18 | 32 | 29 32 | 0 |
| 5678 | 1045 | 819 | 13994 65.7 | GCAAGAGTAAAGTGCGCGTT | 21 | 20 | 6 | 29 12 | 0 |
| 5679 | 1046 | 820 | 30192 67.3 | GCAAACCTCCTAGCAAACGG | 21 | 23 | 26 | 21 35 | 0 |
| 5680 | 1047 | 821 | 20374 66.4 | CGTTGCAACAGCACCTCTGT | 12 | 21 | 31 | 23 14 | 0 |
| 5681 | 1048 | 822 | 3277 69.7 | CGTTGCAAAGCCGCTTTACA | 12 | 21 | 36 | 17 7 | 0 |
| 5682 | 1049 | 823 | 3281 71.3 | AGTCACGGGACACCTTCCC | 22 | 30 | 34 | 23 28 | 1 |
| 5683 | 1050 | 824 | 14003 74.9 | AGTCAGCCAGCGGACGCTT | 22 | 31 | 31 | 34 17 | 0 |
| 5684 | 1051 | 825 | 14004 75 | AGTGGTGCCACGGACCCGAA | 22 | 33 | 30 | 32 16 | 0 |
| 5685 | 1052 | 826 | 3291 74.1 | ACCTGACCTGCGCGTTGCAA | 23 | 32 | 29 | 12 21 | 0 |
| 5686 | 1053 | 827 | 14013 73.1 | ATCGCTGTCAGCGTGCCCAT | 24 | 14 | 31 | 33 15 | 0 |
| 5687 | 1054 | 828 | 30193 69.5 | ATCGGGTATCGTGACCCGAA | 24 | 18 | 10 | 32 16 | 0 |
| 5688 | 1055 | 829 | 40156 70.4 | ATCGGACCTCTGGGACGCTT | 24 | 32 | 8 | 34 17 | 0 |
| 5689 | 1056 | 830 | 3309 68.9 | AGGATGCGTACAGTGCGTGC | 25 | 29 | 7 | 33 33 | 0 |

FIG. 29W

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5690 | 1057 | 831 | 14021 | 71.2 | AGGAAGCCGGTAGGACTGCG | 25 | 36 | 18 | 34 | 29 | 0 |
| 5691 | 1058 | 833 | 30194 | 66.6 | GATGCGTTAATCGGACTCCC | 27 | 12 | 4 | 34 | 28 | 0 |
| 5692 | 1059 | 834 | 14032 | 71 | CGTTGATGGACCGTGCCCTA | 12 | 27 | 32 | 33 | 26 | 0 |
| 5693 | 1060 | 835 | 40157 | 73.5 | CGTTGATGGGACGACCCACG | 12 | 27 | 34 | 32 | 30 | 0 |
| 5694 | 1061 | 839 | 3356 | 70.7 | TCCCAGTGGGTACACGGTGC | 28 | 22 | 18 | 30 | 33 | 0 |
| 5695 | 1062 | 840 | 40160 | 68.4 | TCCCCCTAAATCCCATCAGC | 28 | 26 | 4 | 15 | 31 | 0 |
| 5696 | 1063 | 841 | 3361 | 71.8 | CGTTTCCCTCCCTCGTCGAA | 12 | 28 | 28 | 10 | 16 | 1 |
| 5697 | 1064 | 842 | 14040 | 73.8 | TCCCTGCGCCATGGTACGAA | 28 | 29 | 15 | 18 | 16 | 0 |
| 5698 | 1065 | 845 | 40162 | 70.8 | TGCGATACAGCCTCCCCTCA | 29 | 5 | 36 | 28 | 13 | 0 |
| 5699 | 1066 | 846 | 40164 | 72.8 | TGCGCGAATGCGTTAGCTTG | 29 | 16 | 29 | 3 | 11 | 0 |
| 5700 | 1067 | 847 | 20392 | 74.7 | CGTTTGCGGCTTGTGCCTCA | 12 | 29 | 17 | 33 | 13 | 0 |
| 5701 | 1068 | 848 | 40165 | 70.4 | TGCGGTCTTACACACGCGAA | 29 | 19 | 7 | 30 | 16 | 0 |
| 5702 | 1069 | 849 | 14044 | 69 | TGCGAGGAATCGTTAGCGAA | 29 | 25 | 24 | 3 | 16 | 0 |
| 5703 | 1070 | 850 | 3381 | 73.6 | CGTTTGCGGATGCCATGCTT | 12 | 29 | 27 | 15 | 17 | 0 |
| 5704 | 1071 | 851 | 14045 | 70.7 | TGCGTCCCTTGAGCTTCAGC | 29 | 28 | 1 | 17 | 31 | 0 |
| 5705 | 1072 | 852 | 14046 | 77 | CGTTTGCGCACGCGTTGCTT | 12 | 29 | 30 | 12 | 17 | 0 |
| 5706 | 1073 | 853 | 40166 | 69.7 | CACGTCGTTGTCCAGCGGTA | 30 | 10 | 9 | 31 | 18 | 0 |
| 5707 | 1074 | 854 | 20396 | 67.1 | CACGCTTGTGATCCATCGAA | 30 | 11 | 2 | 15 | 16 | 0 |
| 5708 | 1075 | 855 | 40167 | 70.4 | CGTTCACGCTGTCTTGTGCG | 12 | 30 | 14 | 11 | 29 | 0 |
| 5709 | 1076 | 856 | 40171 | 67.5 | CACGGATGTTAGCGAATCCC | 30 | 27 | 3 | 16 | 28 | 0 |
| 5710 | 1077 | 858 | 14053 | 74.7 | CGTTCACGCAGCGCAATCGT | 12 | 30 | 31 | 21 | 10 | 0 |
| 5711 | 1078 | 859 | 20400 | 66.3 | CACGGACCAAAGTTAGTGCG | 30 | 32 | 6 | 3 | 29 | 0 |
| 5712 | 1079 | 860 | 3401 | 72 | CGTTCACGACGGGTCTGCAA | 12 | 30 | 35 | 19 | 21 | 0 |
| 5713 | 1080 | 861 | 20402 | 71.8 | CGTTCACGAGCCTCGTCACG | 12 | 30 | 36 | 10 | 30 | 0 |
| 5714 | 1081 | 862 | 20403 | 65.7 | CAGCTCTGGACCAAAGCTCA | 31 | 8 | 32 | 6 | 13 | 0 |
| 5715 | 1082 | 863 | 30197 | 69.1 | CGTTCAGCGCTTCGTTTCTG | 12 | 31 | 17 | 12 | 8 | 0 |
| 5716 | 1083 | 864 | 3411 | 74.7 | CGTTCAGCCACGCAGCAGGA | 12 | 31 | 30 | 31 | 25 | 0 |
| 5717 | 1084 | 865 | 14060 | 69.7 | CAGCGTGCTTGAAATCGTGC | 31 | 33 | 1 | 4 | 33 | 0 |
| 5718 | 1085 | 866 | 3418 | 69.6 | CGTTGACCTCTGTCCCCAGC | 12 | 32 | 8 | 28 | 31 | 0 |
| 5719 | 1086 | 868 | 40173 | 68.7 | CGTTGACCCTGTCGAACGAA | 12 | 32 | 14 | 16 | 16 | 0 |
| 5720 | 1087 | 869 | 3424 | 67 | CGTTGACCATCGTTAGCACG | 12 | 32 | 24 | 3 | 30 | 0 |
| 5721 | 1088 | 870 | 3426 | 69.4 | GACCTGCGCTCAGGTAAGCC | 32 | 29 | 13 | 18 | 36 | 0 |
| 5722 | 1089 | 871 | 40175 | 71.7 | CGTTGACCCAGCTCCCGTCT | 12 | 32 | 31 | 28 | 19 | 0 |
| 5723 | 1090 | 873 | 3435 | 72.1 | GTGCTGTCCTTGCAGCTGCG | 33 | 9 | 11 | 31 | 29 | 0 |
| 5724 | 1091 | 874 | 20413 | 65.8 | GTGCCTTGTACACAGCGACC | 33 | 11 | 7 | 31 | 32 | 0 |
| 5725 | 1092 | 875 | 30199 | 69 | GTGCCTCAAAAGTCCCCAGC | 33 | 13 | 6 | 28 | 31 | 1 |
| 5726 | 1093 | 876 | 40177 | 69.8 | CGTTGTGCCGATGTGTCGCTT | 12 | 33 | 27 | 9 | 17 | 0 |
| 5727 | 1094 | 877 | 3450 | 71.8 | GTGCGACCGTCTATCGTGCG | 33 | 32 | 19 | 24 | 29 | 0 |
| 5728 | 1095 | 879 | 30200 | 73.2 | CGTTGGACCGTTGGACCGAA | 12 | 34 | 12 | 34 | 16 | 0 |
| 5729 | 1096 | 880 | 30202 | 67.8 | GGACGGTACGAAGCTTCACG | 34 | 18 | 16 | 17 | 30 | 0 |
| 5730 | 1097 | 881 | 40178 | 70.4 | GGACAGGATGTCACGGCAGC | 34 | 25 | 9 | 35 | 31 | 0 |
| 5731 | 1098 | 882 | 14078 | 68.2 | GGACGGACTTGAAGTGTGCG | 34 | 34 | 1 | 22 | 29 | 0 |
| 5732 | 1099 | 883 | 3463 | 71.8 | GGACACGGCCATCTGTGCAA | 34 | 35 | 15 | 14 | 21 | 0 |
| 5733 | 1100 | 884 | 14079 | 70 | ACGGTTGAACCTGGACGTGC | 35 | 1 | 23 | 34 | 33 | 1 |
| 5734 | 1101 | 885 | 3465 | 70.8 | ACGGAATCCTTGCACGCTCA | 35 | 4 | 11 | 30 | 13 | 0 |
| 5735 | 1102 | 886 | 14080 | 71.5 | ACGGAAAGGACCGACCATCG | 35 | 6 | 32 | 32 | 24 | 0 |
| 5736 | 1103 | 887 | 3468 | 71.5 | ACGGTCTGGACCGCAAGGAC | 35 | 8 | 32 | 21 | 34 | 0 |
| 5737 | 1104 | 888 | 30203 | 71.5 | ACGGCTGTCTTGTCCCGACC | 35 | 14 | 11 | 28 | 32 | 1 |

FIG. 29X

| SEQ ID NO: | ZIP ID# | 4,633 ID# | H3X ID# Tm | ZIPCODE (NH2 -> CONH2) | TETRAMER NUMBERS | | | | | "UNALLOWED DIMERS" |
|---|---|---|---|---|---|---|---|---|---|---|
| 5738 | 1105 | 889 | 3472 67.9 | ACGGGAGTTTGATTGATGCG | 35 | 20 | 1 | 1 | 29 | 0 |
| 5739 | 1106 | 890 | 30204 74.1 | ACGGGATGCAGCAGTGCGAA | 35 | 27 | 31 | 22 | 16 | 0 |
| 5741 | 1107 | 891 | 30205 70.7 | AGCCTTGAGTGCCTTGCACG | 36 | 1 | 33 | 11 | 30 | 0 |
| 5741 | 1108 | 892 | 14087 73.1 | AGCCTGATTGCGCAGCCTTG | 36 | 2 | 29 | 31 | 11 | 0 |
| 5742 | 1109 | 893 | 14097 70.4 | AGCCGACCTGTCATCGCTTG | 36 | 32 | 9 | 24 | 11 | 0 |
| 5743 | 1110 | 894 | 3498 71.8 | AGCCACGGCTCAAATCGACC | 36 | 35 | 13 | 4 | 32 | 0 |
| 5744 | 1111 | 895 | 3502 71.6 | TTGAAGCCTCGTACGGTGCG | 1 | 36 | 10 | 35 | 29 | 0 |
| 5745 | 1112 | 896 | 14102 73.3 | AATCGCTTCAGCAGCCTGCG | 4 | 17 | 31 | 36 | 29 | 0 |
| 5746 | 1113 | 897 | 14106 73 | AAAGCGTTGTGCCAGCAGCC | 6 | 12 | 33 | 31 | 36 | 0 |
| 5747 | 1114 | 900 | 3525 74.5 | TGTCTGCGCAGCTGCGGTCT | 9 | 29 | 31 | 29 | 19 | 0 |
| 5748 | 1115 | 902 | 3532 77.1 | TCGTCACGGGACTGCGGCAA | 10 | 30 | 34 | 29 | 21 | 0 |
| 5749 | 1116 | 903 | 20437 71 | TCGTAGCCAGGAGTGCCGAA | 10 | 36 | 25 | 33 | 16 | 0 |
| 5750 | 1117 | 904 | 20439 69.8 | CTTGAGTGCGTTCGTTTGCG | 11 | 22 | 12 | 12 | 29 | 0 |
| 5751 | 1118 | 905 | 20441 69.4 | CGTTTCGTGACCTGTCTGCG | 12 | 10 | 32 | 9 | 29 | 0 |
| 5752 | 1119 | 906 | 14112 72.5 | CGTTACGGCGAAAGGAACGG | 12 | 35 | 16 | 25 | 35 | 0 |
| 5753 | 1120 | 907 | 3546 75.8 | CTCAACGGCGAATGCGCCAT | 13 | 35 | 16 | 29 | 15 | 0 |
| 5754 | 1121 | 908 | 3547 73.6 | CCATGCTTGGACGGACACGG | 15 | 17 | 34 | 34 | 35 | 0 |
| 5755 | 1122 | 909 | 3548 69.3 | CCATTGCGAAAGGACCCTGT | 15 | 29 | 6 | 32 | 14 | 0 |
| 5756 | 1123 | 910 | 14114 74.4 | CGAAATCGATCGCAGCTGCG | 16 | 24 | 24 | 31 | 29 | 0 |
| 5757 | 1124 | 911 | 3557 71.9 | CGAACACGAGGAACGGTCCC | 16 | 30 | 25 | 35 | 28 | 1 |
| 5758 | 1125 | 912 | 3558 77.2 | CGAACAGCACGGCACGGTGC | 16 | 31 | 35 | 30 | 33 | 0 |
| 5759 | 1126 | 913 | 30207 71.2 | GCAAACGGACGGAAAGGGAC | 21 | 35 | 35 | 6 | 34 | 0 |
| 5760 | 1127 | 914 | 3582 73.8 | AGTGGTGCCGAAGTGCTGCG | 22 | 33 | 16 | 33 | 29 | 0 |
| 5761 | 1128 | 915 | 3585 74.7 | ACCTACGGTGCGGACCGTGC | 23 | 35 | 29 | 32 | 33 | 0 |
| 5762 | 1129 | 916 | 20457 71.1 | CTCAATCGCTTGGCAAACGG | 13 | 24 | 11 | 21 | 35 | 0 |
| 5763 | 1130 | 917 | 30208 71.3 | CTCAATCGCCATCACGCGTT | 13 | 24 | 15 | 30 | 12 | 0 |
| 5764 | 1131 | 918 | 3591 69.8 | ATCGGGTAGCTTCAGCGTGC | 24 | 18 | 17 | 31 | 33 | 0 |
| 5765 | 1132 | 919 | 14129 72.2 | ATCGACGGGTCTGGACACGG | 24 | 35 | 19 | 34 | 35 | 0 |
| 5766 | 1133 | 920 | 3600 71.8 | AGGAGCTTCAGCCAGCCGAA | 25 | 17 | 31 | 31 | 16 | 0 |
| 5767 | 1134 | 921 | 3601 75.5 | AGGACACGGTGCCACGACGG | 25 | 30 | 33 | 30 | 35 | 0 |
| 5768 | 1135 | 922 | 14132 73.3 | TCCCGCTTGCAACCATGACC | 28 | 17 | 21 | 15 | 32 | 0 |
| 5769 | 1136 | 924 | 3624 75.4 | TGCGAATCATCGCAGCCACG | 29 | 4 | 24 | 31 | 30 | 0 |
| 5770 | 1137 | 925 | 3625 73.4 | TGCGTCTGAGCCTGCGGTCT | 29 | 8 | 36 | 29 | 19 | 0 |
| 5771 | 1138 | 926 | 3629 70.8 | TGCGCTCAGGACCGTTTGAT | 29 | 13 | 34 | 12 | 2 | 0 |
| 5772 | 1139 | 927 | 14135 70.1 | TGCGGTCTAGCCCTTGTCGT | 29 | 19 | 36 | 11 | 10 | 0 |
| 5773 | 1140 | 928 | 3637 71.7 | TGCGTCCCCCTACCTAACGG | 29 | 28 | 26 | 26 | 35 | 0 |
| 5774 | 1141 | 929 | 40180 75.4 | TGCGGACCGCTTGACCTCGT | 29 | 32 | 17 | 32 | 10 | 0 |
| 5775 | 1142 | 930 | 14139 73.3 | CACGCCTAGGACACGGCAGC | 30 | 26 | 34 | 35 | 31 | 0 |
| 5776 | 1143 | 931 | 3649 76 | CACGCAGCGTGCCTCACACG | 30 | 31 | 33 | 13 | 30 | 0 |
| 5777 | 1144 | 932 | 3650 74.8 | CACGGACCGTCTGCAATGCG | 30 | 32 | 19 | 21 | 29 | 0 |
| 5778 | 1145 | 933 | 3658 76.9 | CAGCATCGAGCCACGGCGAA | 31 | 24 | 36 | 35 | 16 | 0 |
| 5779 | 1146 | 934 | 14144 73.8 | CAGCTGCGGGACAGGAGCAA | 31 | 29 | 34 | 25 | 21 | 0 |
| 5780 | 1147 | 935 | 20484 70.4 | GACCGATGGTCTCCATTGCG | 32 | 27 | 19 | 15 | 29 | 0 |
| 5781 | 1148 | 936 | 3672 73.4 | GACCGTGCGAGTAGCCTGCG | 32 | 33 | 20 | 36 | 29 | 0 |
| 5782 | 1149 | 937 | 3691 74.9 | GGACGATGCACGTCCCGGAC | 34 | 27 | 30 | 28 | 34 | 0 |
| 5783 | 1150 | 938 | 14153 72.6 | GGACGGACCCATAGCCCCAT | 34 | 34 | 15 | 36 | 15 | 0 |
| 5784 | 1151 | 939 | 30211 68.8 | ACGGCCATAAAGGCAAGACC | 35 | 15 | 6 | 21 | 32 | 0 |
| 5785 | 1152 | 940 | 3701 68.5 | ACGGGTCTCCATTTGAAGCC | 35 | 19 | 15 | 1 | 36 | 0 |

FIG. 29Y

| SEQ ID NO: | ZIP ID# | 4,633 ID# | HEX ID# Tm | ZIPCODE (NH2 -> CONH2) | TETRAMER NUMBERS | | | | | "UNALLOWED DIMERS" |
|---|---|---|---|---|---|---|---|---|---|---|
| 5786 | 1153 | 941 | 3703 72.2 | ACGGATCGGACCTGTCCACG | 35 | 24 | 32 | 9 | 30 | 0 |
| 5787 | 1154 | 942 | 40182 72.4 | ACGGAGGAAAAGTGCGGCAA | 35 | 25 | 6 | 29 | 21 | 0 |
| 5788 | 1155 | 943 | 20493 71.5 | ACGGCCTAGGACGTGCGTCT | 35 | 26 | 34 | 33 | 19 | 0 |
| 5789 | 1156 | 944 | 3708 69.3 | AGCCTTGAAATCACGGCGTT | 36 | 1 | 4 | 35 | 12 | 0 |
| 5790 | 1157 | 945 | 3711 70.5 | AGCCTCTGAGCCCGTTCCAT | 36 | 8 | 36 | 12 | 15 | 0 |
| 5791 | 1158 | 946 | 30212 71.2 | CTCAAGCCCGTTGGACTCCC | 13 | 36 | 12 | 34 | 28 | 0 |
| 5792 | 1159 | 947 | 30213 68.8 | AGCCGGTACGAACCATAGCC | 36 | 18 | 16 | 15 | 36 | 0 |
| 5793 | 1160 | 948 | 30214 73.2 | CTCAAGCCGATGTCCCTGCG | 13 | 36 | 27 | 28 | 29 | 0 |
| 5794 | 1161 | 950 | 3749 73.3 | CGTTCGTTACGGCAGCGGAC | 12 | 12 | 35 | 31 | 34 | 0 |
| 5795 | 1162 | 951 | 3750 74.1 | CGTTCCATTCCCTGCGGGAC | 12 | 15 | 28 | 29 | 34 | 0 |
| 5796 | 1163 | 952 | 3757 73.5 | CGTTCAGCCCTATGCGCAGC | 12 | 31 | 26 | 29 | 31 | 0 |
| 5797 | 1164 | 953 | 3765 72.1 | CTGTCGAACGTTTGCGCAGC | 14 | 16 | 12 | 29 | 31 | 0 |
| 5798 | 1165 | 954 | 20509 71.5 | CGAATCCCCGTTGACCGAGT | 16 | 28 | 12 | 32 | 20 | 0 |
| 5799 | 1166 | 955 | 20511 69.2 | GCTTGTGCGAGTCCATCACG | 17 | 33 | 20 | 15 | 30 | 0 |
| 5800 | 1167 | 956 | 3781 73.6 | GCAACCATAGCCGGACGCAA | 21 | 15 | 36 | 34 | 21 | 0 |
| 5801 | 1168 | 957 | 3782 71.6 | GCAACGAATGTCAGCCACGG | 21 | 16 | 9 | 36 | 35 | 0 |
| 5802 | 1169 | 958 | 14170 69 | GCAAGCAATCTGCAGCCTTG | 21 | 21 | 8 | 31 | 11 | 0 |
| 5803 | 1170 | 959 | 3786 74.2 | GCAAGACCGCAAATCGTGCG | 21 | 32 | 21 | 24 | 29 | 0 |
| 5804 | 1171 | 960 | 14173 72.1 | GATGTGCGAATCGGACGCAA | 27 | 29 | 4 | 34 | 21 | 0 |
| 5805 | 1172 | 962 | 3800 69.8 | TCCCCTTGAGGACCATCACG | 28 | 11 | 25 | 15 | 30 | 0 |
| 5806 | 1173 | 963 | 30215 71.9 | TCCCGCTTCCTAGTGCGACC | 28 | 17 | 26 | 33 | 32 | 0 |
| 5807 | 1174 | 964 | 3805 74.5 | TCCCAGTGCGAATCCCGGAC | 28 | 22 | 16 | 28 | 34 | 0 |
| 5808 | 1175 | 966 | 3817 75.4 | TGCGTGTCCACGCCTATGCG | 29 | 9 | 30 | 26 | 29 | 0 |
| 5809 | 1176 | 967 | 14180 72.7 | TGCGCGAACTTGCCATGGTA | 29 | 16 | 11 | 15 | 18 | 0 |
| 5810 | 1177 | 968 | 40184 72.2 | TGCGGCTTTCGTGCTTTTGA | 29 | 17 | 10 | 17 | 1 | 0 |
| 5811 | 1178 | 969 | 40185 73.3 | TGCGGAGTCCATCAGCGCTT | 29 | 20 | 15 | 31 | 17 | 0 |
| 5812 | 1179 | 970 | 40186 71.8 | TGCGAGGAAAAGCTGTTGCG | 29 | 25 | 6 | 14 | 29 | 0 |
| 5813 | 1180 | 971 | 14181 74.8 | CTGTTGCGCAGCACGGCCTA | 14 | 29 | 31 | 35 | 26 | 0 |
| 5814 | 1181 | 974 | 3832 73.4 | CACGCTGTTCCCGACCAGGA | 30 | 14 | 28 | 32 | 25 | 0 |
| 5815 | 1182 | 975 | 20528 72.5 | CACGCCATAATCGTGCCACG | 30 | 15 | 4 | 33 | 30 | 0 |
| 5816 | 1183 | 976 | 14182 70.3 | CACGCGAAATACGCAACGAA | 30 | 16 | 5 | 21 | 16 | 0 |
| 5817 | 1184 | 977 | 3836 73.7 | CACGGGTAACGGCGAAGCAA | 30 | 18 | 35 | 16 | 21 | 0 |
| 5818 | 1185 | 978 | 3837 73.8 | CACGGATGGGACGCAACAGC | 30 | 27 | 34 | 21 | 31 | 0 |
| 5819 | 1186 | 979 | 3847 76 | CAGCATCGCGTTGCAATGCG | 31 | 24 | 12 | 21 | 29 | 0 |
| 5820 | 1187 | 980 | 3849 76.5 | CAGCGATGTGCGGTGCCCAT | 31 | 27 | 29 | 33 | 15 | 0 |
| 5821 | 1188 | 981 | 40187 74.5 | CAGCTGCGAGTGAGCCGTGC | 31 | 29 | 22 | 36 | 33 | 0 |
| 5822 | 1189 | 983 | 40188 70.8 | GACCGCAAATACGACCGTGC | 32 | 21 | 5 | 32 | 33 | 0 |
| 5823 | 1190 | 984 | 14187 74 | GACCTCCCCAGCTGCGTCGT | 32 | 28 | 31 | 29 | 10 | 0 |
| 5824 | 1191 | 985 | 14188 74.4 | CTGTGACCTGCGCACGCCAT | 14 | 32 | 29 | 30 | 15 | 0 |
| 5825 | 1192 | 986 | 20536 69.8 | GACCCACGACCTACGGCTTG | 32 | 30 | 23 | 35 | 11 | 0 |
| 5826 | 1193 | 988 | 3869 69.8 | GTGCGCTTCCATCTTGGGAC | 33 | 17 | 15 | 11 | 34 | 0 |
| 5827 | 1194 | 990 | 40189 74.4 | GTGCTGCGGATGATCGGCAA | 33 | 29 | 27 | 24 | 21 | 0 |
| 5828 | 1195 | 992 | 14190 72.4 | GTGCGGACTGATCACGTGCG | 33 | 34 | 2 | 30 | 29 | 0 |
| 5829 | 1196 | 995 | 3884 69.3 | GGACGGACATACGGACGCTT | 34 | 34 | 5 | 34 | 17 | 0 |
| 5830 | 1197 | 996 | 14193 73.9 | GGACAGCCCTCACACGTGCG | 34 | 36 | 13 | 30 | 29 | 0 |
| 5831 | 1198 | 997 | 3886 75.6 | ACGGCTTGGACCGTGCGATG | 35 | 11 | 32 | 33 | 27 | 0 |
| 5832 | 1199 | 998 | 3891 73.6 | ACGGACCTACGGGACCACGG | 35 | 23 | 35 | 32 | 35 | 0 |
| 5833 | 1200 | 999 | 3900 73.6 | AGCCTCGTGCTTCACGCGAA | 36 | 10 | 17 | 30 | 16 | 0 |

FIG. 29Z

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5834 | 1201 | 1000 | 30218 | 70.9 | AGCCGCTTATCGTGTCTGCG | 36 | 17 | 24 | 9 | 29 | 0 |
| 5835 | 1202 | 1001 | 3905 | 77.2 | AGCCGTCTTGCGGGACGTGC | 36 | 19 | 29 | 34 | 33 | 0 |
| 5836 | 1203 | 1002 | 3912 | 71.2 | AGCCTCCCAAAGCTCAACGG | 36 | 28 | 6 | 13 | 35 | 0 |
| 5837 | 1204 | 1003 | 3915 | 72.3 | AGCCGACCTCTGCTTGCAGC | 36 | 32 | 8 | 11 | 31 | 0 |
| 5838 | 1205 | 1004 | 3923 | 71 | TTGAGGACCGAACACGACGG | 1 | 34 | 16 | 30 | 35 | 0 |
| 5839 | 1206 | 1005 | 3927 | 74.4 | TGATGACCGGACCACGGCAA | 2 | 32 | 34 | 30 | 21 | 0 |
| 5840 | 1207 | 1006 | 20546 | 68.4 | TTAGGACCAAAGCCATTGCG | 3 | 32 | 6 | 15 | 29 | 0 |
| 5841 | 1208 | 1007 | 20548 | 69.8 | AATCCGTTGCTTGTGCCCAT | 4 | 12 | 17 | 33 | 15 | 0 |
| 5842 | 1209 | 1008 | 3942 | 71.9 | AATCTCCCCCATCACGCGAA | 4 | 28 | 15 | 30 | 16 | 0 |
| 5843 | 1210 | 1009 | 14213 | 72 | AATCAGCCCGAATCCCTCCC | 4 | 36 | 16 | 28 | 28 | 0 |
| 5844 | 1211 | 1010 | 3948 | 71.4 | AAAGCTTGCAGCATCGGCAA | 6 | 11 | 31 | 24 | 21 | 0 |
| 5845 | 1212 | 1011 | 14216 | 70.7 | AAAGACGGCGAAGACCCGTT | 6 | 35 | 16 | 32 | 12 | 0 |
| 5846 | 1213 | 1012 | 3965 | 72.4 | TCTGAGGATGCGGGACGGAC | 8 | 25 | 29 | 34 | 34 | 0 |
| 5847 | 1214 | 1013 | 14222 | 69.4 | TCTGAGCCTGTCATCGCGAA | 8 | 36 | 9 | 24 | 16 | 0 |
| 5848 | 1215 | 1014 | 3982 | 72.6 | TGTCATCGCCATGACCGTGC | 9 | 24 | 15 | 32 | 33 | 0 |
| 5849 | 1216 | 1015 | 3985 | 71.9 | TGTCTGCGCCATCGTTGGAC | 9 | 29 | 15 | 12 | 34 | 0 |
| 5850 | 1217 | 1017 | 3990 | 71.3 | TGTCACGGCCATGATGGACC | 9 | 35 | 15 | 27 | 32 | 0 |
| 5851 | 1218 | 1019 | 30219 | 69.2 | TCGTGCTTTACAAGCCACGG | 10 | 17 | 7 | 36 | 35 | 0 |
| 5852 | 1219 | 1021 | 14233 | 67.1 | CTTGCGAATTAGGTGCTCCC | 11 | 16 | 3 | 33 | 28 | 0 |
| 5853 | 1220 | 1022 | 4021 | 74.1 | CGTTCTCATCCCTGCGTGCG | 12 | 13 | 28 | 29 | 29 | 0 |
| 5854 | 1221 | 1023 | 4025 | 68.1 | CGTTGCAAATACATCGTGCG | 12 | 21 | 5 | 24 | 29 | 0 |
| 5855 | 1222 | 1024 | 4026 | 68.2 | CGTTACCTAGCCACCTTGCG | 12 | 23 | 36 | 23 | 29 | 0 |
| 5856 | 1223 | 1025 | 4027 | 67.1 | CGTTATCGTGCGAAAGCTCA | 12 | 24 | 29 | 6 | 13 | 0 |
| 5857 | 1224 | 1026 | 4033 | 71.1 | CGTTGACCGCTTAGGATGCG | 12 | 32 | 17 | 25 | 29 | 0 |
| 5858 | 1225 | 1027 | 4034 | 69.8 | CGTTGTGCCCTAGGACGGAC | 12 | 33 | 26 | 34 | 34 | 0 |
| 5859 | 1226 | 1028 | 4040 | 73 | CCATCTCAACGGCACGAGCC | 15 | 13 | 35 | 30 | 36 | 0 |
| 5860 | 1227 | 1029 | 4042 | 70.4 | CTGTTCGTGCAATCGTTGCG | 14 | 10 | 21 | 10 | 29 | 0 |
| 5861 | 1228 | 1030 | 4045 | 69.4 | CTGTTCCCGGTACACGTCCC | 14 | 28 | 18 | 30 | 28 | 0 |
| 5862 | 1229 | 1031 | 4046 | 74.5 | CTGTGTGCGTGCGATGTGCC | 14 | 33 | 33 | 27 | 29 | 0 |
| 5863 | 1230 | 1032 | 4052 | 71.2 | CCATCCTACAGCTGCGCAGC | 15 | 26 | 31 | 29 | 31 | 0 |
| 5864 | 1231 | 1033 | 14242 | 73.6 | CCATCCATGGACGACCTGCG | 15 | 15 | 34 | 32 | 29 | 0 |
| 5865 | 1232 | 1034 | 14243 | 69.7 | CGAATCGTCGTTGATGGCAA | 16 | 10 | 12 | 27 | 21 | 0 |
| 5866 | 1233 | 1035 | 14244 | 69.5 | CGAACGTTCACGGAGTGCAGC | 16 | 12 | 30 | 22 | 31 | 0 |
| 5867 | 1234 | 1036 | 40192 | 68.8 | CGAACGAACCTACGAATGCG | 16 | 16 | 26 | 16 | 29 | 0 |
| 5868 | 1235 | 1037 | 40193 | 70.6 | CGAAACCTTGTCGACCACGG | 16 | 23 | 9 | 32 | 35 | 0 |
| 5869 | 1236 | 1038 | 30222 | 71.6 | CGAACAGCCCATTCGTCACG | 16 | 31 | 15 | 10 | 30 | 0 |
| 5870 | 1237 | 1039 | 4076 | 71.2 | GCTTCTCAACGGCAGCATCG | 17 | 13 | 35 | 31 | 24 | 0 |
| 5871 | 1238 | 1040 | 14253 | 66.2 | GCTTAGGAAGGAATCGCGTT | 17 | 25 | 25 | 24 | 12 | 0 |
| 5872 | 1239 | 1041 | 14255 | 67.8 | GCTTCAGCTACATCCCGTGC | 17 | 31 | 7 | 28 | 33 | 0 |
| 5873 | 1240 | 1042 | 4087 | 69.7 | CCATGCTTGACCCGAAGCTT | 15 | 17 | 32 | 16 | 17 | 0 |
| 5874 | 1241 | 1043 | 4088 | 73.8 | CCATGCTTGTGCGACCGACC | 15 | 17 | 33 | 32 | 32 | 0 |
| 5875 | 1242 | 1044 | 4093 | 68.7 | GGTAGCTTGCAAATCGCGAA | 18 | 17 | 21 | 24 | 16 | 0 |
| 5876 | 1243 | 1045 | 4099 | 71.6 | CCATGGTACAGCTGCGACGG | 15 | 18 | 31 | 29 | 35 | 0 |
| 5877 | 1244 | 1046 | 4100 | 73.1 | GGTAGTGCACGGAGCCGTGC | 18 | 33 | 35 | 36 | 33 | 0 |
| 5878 | 1245 | 1047 | 4104 | 70.7 | GTCTCACGTGCGCTTGTCCC | 19 | 30 | 29 | 11 | 28 | 1 |
| 5879 | 1246 | 1048 | 14264 | 70.2 | CCATGCAATCGTGCAAATCG | 15 | 21 | 10 | 21 | 24 | 0 |
| 5880 | 1247 | 1049 | 40195 | 68 | CCATGCAACGAATCCCAATC | 15 | 21 | 16 | 28 | 4 | 0 |
| 5881 | 1248 | 1050 | 4121 | 71.3 | GCAAGTCTTCCCAGCCGGAC | 21 | 19 | 28 | 36 | 34 | 0 |

FIG. 29AA

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5882 | 1249 | 1051 | 4122 | 72.2 | GCAAGAGTTCCCCAGCCACG | 21 | 20 | 28 | 31 | 30 | 0 |
| 5883 | 1250 | 1052 | 40196 | 67.8 | GCAAATCGTTAGGGACGTGC | 21 | 24 | 3 | 34 | 33 | 0 |
| 5884 | 1251 | 1054 | 14269 | 69.9 | CCATGCAACACGATCGATCG | 15 | 21 | 30 | 24 | 24 | 0 |
| 5885 | 1252 | 1055 | 14270 | 69.9 | CCATGCAAGACCCGTTAGCC | 15 | 21 | 32 | 12 | 36 | 0 |
| 5886 | 1253 | 1056 | 20576 | 69.6 | CCATGCAAGGACGAGTTCCC | 15 | 21 | 34 | 20 | 28 | 0 |
| 5887 | 1254 | 1057 | 4132 | 71.4 | CCATGCAAAGCCCTCAGCAA | 15 | 21 | 36 | 13 | 21 | 0 |
| 5888 | 1255 | 1058 | 20578 | 70.4 | AGTGGACCCTTGCTGTTGCG | 22 | 32 | 11 | 14 | 29 | 0 |
| 5889 | 1256 | 1059 | 4140 | 69.5 | ACCTTCCCATACCAGCTGCG | 23 | 28 | 5 | 31 | 29 | 1 |
| 5890 | 1257 | 1060 | 4147 | 68.9 | ATCGGGTATCTGGACCACGG | 24 | 18 | 8 | 32 | 35 | 0 |
| 5891 | 1258 | 1061 | 20580 | 69.8 | ATCGGAGTGATGTGCGGGAC | 24 | 20 | 27 | 29 | 34 | 0 |
| 5892 | 1259 | 1062 | 4150 | 71.8 | ATCGTCCCCGTTCACGAGGA | 24 | 28 | 12 | 30 | 25 | 0 |
| 5893 | 1260 | 1063 | 4158 | 73.8 | AGGAAGGATCCCCACGCACG | 25 | 25 | 28 | 30 | 30 | 0 |
| 5894 | 1261 | 1064 | 14279 | 68.8 | CCATGATGCGTTCAGCGTCT | 15 | 27 | 12 | 31 | 19 | 0 |
| 5895 | 1262 | 1065 | 4178 | 71.1 | GATGATCGGATGGTGCACGG | 27 | 24 | 27 | 33 | 35 | 0 |
| 5896 | 1263 | 1066 | 4179 | 67.1 | CCATGATGCCTAGGACGACC | 15 | 27 | 26 | 34 | 32 | 0 |
| 5897 | 1264 | 1067 | 4181 | 71.7 | CCATGATGTCCCGATGCGAA | 15 | 27 | 28 | 27 | 16 | 0 |
| 5898 | 1265 | 1068 | 4182 | 74.1 | CCATGATGCAGCCACGCCAT | 15 | 27 | 31 | 30 | 15 | 0 |
| 5899 | 1266 | 1069 | 14281 | 69.3 | TCCCTTAGCGTTCAGCCCAT | 28 | 3 | 12 | 31 | 15 | 0 |
| 5900 | 1267 | 1070 | 14283 | 71.7 | CCATTCCCCTCAACGGGATG | 15 | 28 | 13 | 35 | 27 | 0 |
| 5901 | 1268 | 1071 | 20589 | 70.6 | TCCCACCTAGTGCACGCCAT | 28 | 23 | 22 | 30 | 15 | 0 |
| 5902 | 1269 | 1072 | 40200 | 67.1 | TGCGTGATAATCCTTGGCAA | 29 | 2 | 4 | 11 | 21 | 0 |
| 5903 | 1270 | 1073 | 40201 | 71.2 | TGCGTTAGCGTTTCCCGGTA | 29 | 3 | 12 | 28 | 18 | 1 |
| 5904 | 1271 | 1075 | 14287 | 70.1 | TGCGTGTCGGTAAAAGTGCG | 29 | 9 | 18 | 6 | 29 | 0 |
| 5905 | 1272 | 1076 | 40202 | 69 | TGCGTCGTAAAGTCCCATCG | 29 | 10 | 6 | 28 | 24 | 1 |
| 5906 | 1273 | 1078 | 40203 | 72 | TGCGAGGACACGGAGTGTGC | 29 | 25 | 30 | 20 | 33 | 0 |
| 5907 | 1274 | 1079 | 4213 | 74 | CCATTGCGTGCGAATCCAGC | 15 | 29 | 29 | 4 | 31 | 0 |
| 5908 | 1275 | 1080 | 4214 | 75.2 | TGCGCACGGCAAGAGTCGAA | 29 | 30 | 21 | 20 | 16 | 0 |
| 5909 | 1276 | 1081 | 4215 | 74 | TGCGGACCCACGTCTGGATG | 29 | 32 | 30 | 8 | 27 | 0 |
| 5910 | 1277 | 1082 | 4216 | 77.6 | CCATTGCGGTGCGGACCGTT | 15 | 29 | 33 | 34 | 12 | 0 |
| 5911 | 1278 | 1083 | 4217 | 73.8 | CCATTGCGACGGCCATATCG | 15 | 29 | 35 | 15 | 24 | 0 |
| 5912 | 1279 | 1084 | 4218 | 73 | CACGTTGAAGCCTGCGGCTT | 30 | 1 | 36 | 29 | 17 | 0 |
| 5913 | 1280 | 1086 | 4221 | 72.9 | CACGTCTGGCAATCCCAGCC | 30 | 8 | 21 | 28 | 36 | 0 |
| 5914 | 1281 | 1087 | 4224 | 68.9 | CACGAGTGACCTTCCCCCAT | 30 | 22 | 23 | 28 | 15 | 1 |
| 5915 | 1282 | 1088 | 40204 | 71.9 | CACGATCGGCTTTTGATGCG | 30 | 24 | 17 | 1 | 29 | 0 |
| 5916 | 1283 | 1089 | 40205 | 71 | CACGTGCGAAAGATCGAGCC | 30 | 29 | 6 | 24 | 36 | 0 |
| 5917 | 1284 | 1090 | 40206 | 74.1 | CACGGACCGAGTGCTTTGCG | 30 | 32 | 20 | 17 | 29 | 0 |
| 5918 | 1285 | 1091 | 4230 | 72.6 | CACGAGCCGATGAGTGCACG | 30 | 36 | 27 | 22 | 30 | 0 |
| 5919 | 1286 | 1092 | 4231 | 69.7 | CAGCTTGATCCCCATCAGC | 31 | 1 | 28 | 15 | 31 | 0 |
| 5920 | 1287 | 1094 | 4233 | 71.5 | CCATCAGCCTTGGGACCGTT | 15 | 31 | 11 | 34 | 12 | 0 |
| 5921 | 1288 | 1095 | 20601 | 68.7 | CAGCCGTTTTAGTCCCCCAT | 31 | 12 | 3 | 28 | 15 | 0 |
| 5922 | 1289 | 1096 | 4236 | 71.9 | CAGCAGTGGCAAGTGCAGCC | 31 | 22 | 21 | 33 | 36 | 0 |
| 5923 | 1290 | 1097 | 4237 | 67.8 | CAGCACCTTTAGTGCGGACC | 31 | 23 | 3 | 29 | 32 | 0 |
| 5924 | 1291 | 1098 | 4238 | 68.6 | CCATCAGCTCCCAGGAGACC | 15 | 31 | 28 | 25 | 32 | 0 |
| 5925 | 1292 | 1100 | 30226 | 69.9 | GACCGAGTAGGAACGGTGCG | 32 | 20 | 25 | 35 | 29 | 0 |
| 5926 | 1293 | 1101 | 4253 | 67.7 | GACCAGGAAATCTCCCGACC | 32 | 25 | 4 | 28 | 32 | 0 |
| 5927 | 1294 | 1102 | 40209 | 70.5 | GACCGATGCTTGGCTTCGAA | 32 | 27 | 11 | 17 | 16 | 0 |
| 5928 | 1295 | 1103 | 4256 | 69.1 | GACCTCCCGGTAGTCTTGCG | 32 | 28 | 18 | 19 | 29 | 0 |
| 5929 | 1296 | 1104 | 14299 | 72 | CCATGACCAGCCGAGTGCAA | 15 | 32 | 36 | 20 | 21 | 0 |

FIG. 29BB

| SEQ ID NO: | ZIP ID# | 4,633 ID# | H3X ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5930 | 1297 | 1105 | 4261 | 67.4 | GTGCTGATACCTGTGCGCAA | 33 | 2 | 23 | 33 | 21 | 0 |
| 5931 | 1298 | 1106 | 4262 | 72.9 | GTGCAATCTGCGACGGGACC | 33 | 4 | 29 | 35 | 32 | 0 |
| 5932 | 1299 | 1107 | 4264 | 70.7 | GTGCTCTGCGTTGGACGCTT | 33 | 8 | 12 | 34 | 17 | 0 |
| 5933 | 1300 | 1108 | 4268 | 69 | GTGCCTGTCGTTTGTCACGG | 33 | 14 | 12 | 9 | 35 | 0 |
| 5934 | 1301 | 1109 | 14301 | 67.4 | GTGCGCTTCGTTAATCCCAT | 33 | 17 | 12 | 4 | 15 | 0 |
| 5935 | 1302 | 1110 | 4273 | 68.7 | GTGCATCGGGTAACCTTCCC | 33 | 24 | 18 | 23 | 28 | 1 |
| 5936 | 1303 | 1111 | 4274 | 66.1 | GTGCAGGAATACTCCCCGTT | 33 | 25 | 5 | 28 | 12 | 0 |
| 5937 | 1304 | 1112 | 4275 | 72 | GTGCTGCGGGACTCTGGACC | 33 | 29 | 34 | 8 | 32 | 0 |
| 5938 | 1305 | 1113 | 14305 | 70 | GTGCGACCCCTACCTATGCG | 33 | 32 | 26 | 26 | 29 | 0 |
| 5939 | 1306 | 1114 | 4278 | 71.6 | CCATGTGCAGCCCACGAAAG | 15 | 33 | 36 | 30 | 6 | 0 |
| 5940 | 1307 | 1115 | 40211 | 69 | CCATGGACGGTACTCATGCG | 15 | 34 | 18 | 13 | 29 | 0 |
| 5941 | 1308 | 1116 | 4288 | 68.1 | CCATGGACAGGACACGAGGA | 15 | 34 | 25 | 30 | 25 | 0 |
| 5942 | 1309 | 1117 | 4292 | 71.5 | GGACCACGGTCTCACGGGAC | 34 | 30 | 19 | 30 | 34 | 0 |
| 5943 | 1310 | 1118 | 14310 | 72 | CCATGGACGTGCCAGCTTGA | 15 | 34 | 33 | 31 | 1 | 0 |
| 5944 | 1311 | 1119 | 4297 | 74.9 | ACGGAATCGCAATGCGAGCC | 35 | 4 | 21 | 29 | 36 | 0 |
| 5945 | 1312 | 1120 | 4298 | 75.5 | ACGGTCTGGCAAAGCCGCAA | 35 | 8 | 21 | 36 | 21 | 0 |
| 5946 | 1313 | 1121 | 40213 | 71.5 | ACGGCTTGCCTATCCCGGTA | 35 | 11 | 26 | 28 | 18 | 0 |
| 5947 | 1314 | 1122 | 4304 | 71.2 | ACGGGCAATCTGAGTGCACG | 35 | 21 | 8 | 22 | 30 | 0 |
| 5948 | 1315 | 1123 | 4309 | 71.2 | ACGGGACCCTGTAGCCGGTA | 35 | 32 | 14 | 36 | 18 | 0 |
| 5949 | 1316 | 1124 | 30227 | 71.9 | ACGGGTGCTCGTCCATCGTT | 35 | 33 | 10 | 15 | 12 | 0 |
| 5950 | 1317 | 1125 | 14321 | 74.6 | CCATAGCCGTGCGCAACGAA | 15 | 36 | 33 | 21 | 16 | 0 |
| 5951 | 1318 | 1127 | 4335 | 71.1 | TGATTGCGCCATTGATGCAA | 2 | 29 | 15 | 2 | 21 | 0 |
| 5952 | 1319 | 1128 | 20626 | 70.2 | TGATCACGCTGTACGGGCAA | 2 | 30 | 14 | 35 | 21 | 0 |
| 5953 | 1320 | 1130 | 40217 | 68.7 | CGAAAATCCACGACGGTTGA | 16 | 4 | 30 | 35 | 1 | 1 |
| 5954 | 1321 | 1131 | 30232 | 72 | CGAAAATCGTGCCTGTTGCG | 16 | 4 | 33 | 14 | 29 | 0 |
| 5955 | 1322 | 1132 | 40218 | 68.7 | CGAAAATCGGACTTGATGCG | 16 | 4 | 34 | 1 | 29 | 0 |
| 5956 | 1323 | 1133 | 20631 | 72.9 | ATACGCTTTCCCGCAATGCG | 5 | 17 | 28 | 21 | 29 | 0 |
| 5957 | 1324 | 1134 | 30233 | 68.6 | AAAGCGAAATCGTTGATGCG | 6 | 16 | 24 | 1 | 29 | 0 |
| 5958 | 1325 | 1135 | 30234 | 68.9 | CGAAAAGTCCCTGCGGAGT | 16 | 6 | 28 | 29 | 20 | 1 |
| 5959 | 1326 | 1136 | 30235 | 67.8 | CGAAAAGCACGAAAGCCAT | 16 | 6 | 30 | 6 | 15 | 0 |
| 5960 | 1327 | 1137 | 4381 | 70.8 | CGAAAAGCAGCGGACCTCA | 16 | 6 | 31 | 34 | 13 | 0 |
| 5961 | 1328 | 1138 | 14350 | 73.4 | CGAAAAGGTGCCACGCAGC | 16 | 6 | 33 | 30 | 31 | 0 |
| 5962 | 1329 | 1139 | 4385 | 70.8 | CGAAAAGAGCCGTGCCTCA | 16 | 6 | 36 | 33 | 13 | 0 |
| 5963 | 1330 | 1140 | 4388 | 73.9 | TCTGTCGTTGCGCGAAAGCC | 8 | 10 | 29 | 16 | 36 | 0 |
| 5964 | 1331 | 1141 | 30236 | 67.8 | TCTGCCATAGGAGACCACGG | 8 | 15 | 25 | 32 | 35 | 0 |
| 5965 | 1332 | 1143 | 4399 | 68.1 | TCTGCACGTACACAGCCACG | 8 | 30 | 7 | 31 | 30 | 0 |
| 5966 | 1333 | 1144 | 4403 | 72.9 | TGTCCTCAAGCCGTGCCCAT | 9 | 13 | 36 | 33 | 15 | 0 |
| 5967 | 1334 | 1146 | 20640 | 68.9 | TGTCGTCTCTGTTGCGAGCC | 9 | 19 | 14 | 29 | 36 | 0 |
| 5968 | 1335 | 1149 | 4421 | 70 | CGAATCGTCTGTCAGCGCAA | 16 | 10 | 14 | 31 | 21 | 0 |
| 5969 | 1336 | 1150 | 14364 | 69 | TCGTGCTTCCATAGCCATCG | 10 | 17 | 15 | 36 | 24 | 0 |
| 5970 | 1337 | 1153 | 4437 | 71.5 | CTTGTCGTGACCCAGCCACG | 11 | 10 | 32 | 31 | 30 | 0 |
| 5971 | 1338 | 1154 | 40222 | 70.8 | CGAACTTGGCTTGACCCACG | 16 | 11 | 17 | 32 | 30 | 0 |
| 5972 | 1339 | 1155 | 30240 | 70 | CTTGCAGCAGTGGATGCGAA | 11 | 31 | 22 | 27 | 16 | 0 |
| 5973 | 1340 | 1156 | 4448 | 70.8 | CGAACTTGGACCCTTGTGCG | 16 | 11 | 32 | 11 | 29 | 0 |
| 5974 | 1341 | 1157 | 14373 | 72.7 | CGAACTTGGTGCCAGCCGTT | 16 | 11 | 33 | 31 | 12 | 0 |
| 5975 | 1342 | 1158 | 20649 | 68.3 | CTTGAGCCGATGGAGTCACG | 11 | 36 | 27 | 20 | 30 | 0 |
| 5976 | 1343 | 1160 | 20650 | 66.9 | CGAACGTTGAGTCGAACACG | 16 | 12 | 20 | 16 | 30 | 0 |
| 5977 | 1344 | 1161 | 4464 | 69.7 | CGAACGTTGTGCTCTGCAGC | 16 | 12 | 33 | 8 | 31 | 0 |

FIG. 29CC

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 5978 | 1345 | 1163 | 4468 | 71.2 | CTCACCATGCAAACGGCGTT | 13 | 15 | 21 | 35 | 12 | 0 |
| 5979 | 1346 | 1164 | 4469 | 71.3 | CTCAGCTTTGCGAGGATGCG | 13 | 17 | 29 | 25 | 29 | 0 |
| 5980 | 1347 | 1165 | 4471 | 66.6 | CTCATCCCATACGCAAGCAA | 13 | 28 | 5 | 21 | 21 | 0 |
| 5981 | 1348 | 1166 | 4473 | 72.1 | CTCACAGCCAGCGCTTGTGC | 13 | 31 | 31 | 17 | 33 | 0 |
| 5982 | 1349 | 1168 | 40224 | 70.1 | CCATCGAACCATGACCGGAC | 15 | 16 | 15 | 32 | 34 | 0 |
| 5983 | 1350 | 1169 | 4487 | 68.4 | CCATATCGAGTGCAGCGGAC | 15 | 24 | 22 | 31 | 34 | 0 |
| 5984 | 1351 | 1170 | 14385 | 67.9 | CCATCCTAAATCCGTTTGCG | 15 | 26 | 4 | 12 | 29 | 0 |
| 5985 | 1352 | 1171 | 20658 | 66.7 | CCATCACGTTAGGCAAGCAA | 15 | 30 | 3 | 21 | 21 | 0 |
| 5986 | 1353 | 1173 | 4493 | 70.5 | CCATGGACCTCATCCCTCCC | 15 | 34 | 13 | 28 | 28 | 0 |
| 5987 | 1354 | 1174 | 30244 | 70.9 | CGAAAAAGACCTTGCGGCAA | 16 | 6 | 23 | 29 | 21 | 0 |
| 5988 | 1355 | 1175 | 14389 | 67.3 | CGAATCGTTTAGCGTTGCAA | 16 | 10 | 3 | 12 | 21 | 0 |
| 5989 | 1356 | 1176 | 14395 | 68.5 | CGAAGCTTTGATCACGCGTT | 16 | 17 | 2 | 30 | 12 | 0 |
| 5990 | 1357 | 1177 | 4513 | 67.4 | GCTTTACATGCGTTGATGCG | 17 | 7 | 29 | 1 | 29 | 0 |
| 5991 | 1358 | 1178 | 4517 | 67.3 | GCTTCGTTCGAAGGACAGGA | 17 | 12 | 16 | 34 | 25 | 0 |
| 5992 | 1359 | 1180 | 30245 | 69.4 | CGAAGCTTCGAATCGTGCAA | 16 | 17 | 16 | 10 | 21 | 0 |
| 5993 | 1360 | 1181 | 20663 | 68.9 | CGAAGCTTGTGCGGACAAAG | 16 | 17 | 33 | 34 | 6 | 0 |
| 5994 | 1361 | 1182 | 20668 | 68.6 | GAGTCCATACGGTCCCAGCC | 20 | 15 | 35 | 28 | 36 | 1 |
| 5995 | 1362 | 1183 | 20670 | 69.9 | GCAATTGAACCTTGCGGGAC | 21 | 1 | 23 | 29 | 34 | 0 |
| 5996 | 1363 | 1184 | 4548 | 67.8 | GCAAAATCAGCCACCTACGG | 21 | 4 | 36 | 23 | 35 | 0 |
| 5997 | 1364 | 1185 | 40225 | 71.3 | GCAAAAAGCCATCGTTTGCG | 21 | 6 | 15 | 12 | 29 | 0 |
| 5998 | 1365 | 1186 | 30248 | 70.6 | CGAAGCAACCATACGGCGTT | 16 | 21 | 15 | 35 | 12 | 0 |
| 5999 | 1366 | 1187 | 20673 | 68.3 | GCAAGATGAGCCTGTCCACG | 21 | 27 | 36 | 9 | 30 | 0 |
| 6000 | 1367 | 1188 | 4557 | 69 | AGTGCTTGGCAACGTTCACG | 22 | 11 | 21 | 12 | 30 | 0 |
| 6001 | 1368 | 1189 | 20675 | 71.4 | AGTGCGTTTGCGTCTGGTGC | 22 | 12 | 29 | 8 | 33 | 0 |
| 6002 | 1369 | 1190 | 4558 | 66.9 | AGTGCGAATGTCAGTGCGAA | 22 | 16 | 9 | 22 | 16 | 0 |
| 6003 | 1370 | 1191 | 14414 | 68.4 | AGTGGCTTGGACTCGTTCCC | 22 | 17 | 34 | 10 | 28 | 0 |
| 6004 | 1371 | 1192 | 14416 | 72.5 | AGTGGATGGACCCAGCTGCG | 22 | 27 | 32 | 31 | 29 | 0 |
| 6005 | 1372 | 1194 | 4578 | 70.1 | ACCTGAGTACGGTGCGCGTT | 23 | 20 | 35 | 29 | 12 | 0 |
| 6006 | 1373 | 1195 | 4579 | 66.3 | ACCTGCAACTGTGGTATGCG | 23 | 21 | 14 | 18 | 29 | 0 |
| 6007 | 1374 | 1196 | 4584 | 69.2 | ACCTTGCGGGTAACCTCGAA | 23 | 29 | 18 | 23 | 16 | 0 |
| 6008 | 1375 | 1197 | 30249 | 70.4 | ACCTGACCTTGATGCGCAGC | 23 | 32 | 1 | 29 | 31 | 0 |
| 6009 | 1376 | 1198 | 4585 | 69.9 | ACCTGTGCGTCTGACCGGAC | 23 | 33 | 19 | 32 | 34 | 0 |
| 6010 | 1377 | 1199 | 30250 | 70.4 | ATCGGAGTTCTGCCATTGCG | 24 | 20 | 8 | 15 | 29 | 0 |
| 6011 | 1378 | 1202 | 14431 | 69.4 | AGGAAGTGCACGGATGAGCC | 25 | 22 | 30 | 27 | 36 | 0 |
| 6012 | 1379 | 1203 | 4616 | 69.6 | AGGATCCCGGTAGGACGACC | 25 | 28 | 18 | 34 | 32 | 0 |
| 6013 | 1380 | 1204 | 40232 | 69.5 | AGGAAGCCAGCCTGTCGATG | 25 | 36 | 36 | 9 | 27 | 0 |
| 6014 | 1381 | 1205 | 14434 | 67.1 | CCTAGCAATGTCGCAAGCAA | 26 | 21 | 9 | 21 | 21 | 0 |
| 6015 | 1382 | 1206 | 14435 | 67.7 | CCTAGTGCAATCAGCCGCTT | 26 | 33 | 4 | 36 | 17 | 0 |
| 6016 | 1383 | 1207 | 4628 | 72.7 | GATGTCGTTGCGACGGTCCC | 27 | 10 | 29 | 35 | 28 | 1 |
| 6017 | 1384 | 1208 | 20694 | 67.1 | GATGGTCTATCGAGCCCGAA | 27 | 19 | 24 | 36 | 16 | 0 |
| 6018 | 1385 | 1209 | 4633 | 69.5 | GATGTCCCCTCAAGCCATCG | 27 | 28 | 13 | 36 | 24 | 0 |
| 601 | 1386 | 1210 | 4634 | 70.9 | CGAAGATGCACGCTGTGCAA | 16 | 27 | 30 | 14 | 21 | 0 |
| 6020 | 1387 | 1211 | 40233 | 71.8 | CGAAGATGGGACTCCCACGG | 16 | 27 | 34 | 28 | 35 | 0 |
| 6021 | 1388 | 1212 | 30252 | 69.7 | GATGAGCCTGATGTGCGCAA | 27 | 36 | 2 | 33 | 21 | 0 |
| 6022 | 1389 | 1213 | 4640 | 70 | TCCCTGTCCAGCAATCGCTT | 28 | 9 | 31 | 4 | 17 | 0 |
| 6023 | 1390 | 1214 | 30254 | 69.8 | TCCCGATGATACGACCGGAC | 28 | 27 | 5 | 32 | 34 | 0 |
| 6024 | 1391 | 1215 | 4649 | 71.8 | TCCCCACGAATCAGTGTGCG | 28 | 30 | 4 | 22 | 29 | 0 |
| 6025 | 1392 | 1216 | 4650 | 74 | TCCCCAGCGTGCTGATCGAA | 28 | 31 | 33 | 2 | 16 | 0 |

FIG. 29DD

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6026 | 1393 | 1217 | 4652 | 72.3 | CGAATCCCACGGATCGTCGT | 16 | 28 | 35 | 24 | 10 | 0 |
| 6027 | 1394 | 1218 | 14444 | 68.8 | TGCGTGATCAGCAAAGGCTT | 29 | 2 | 31 | 6 | 17 | 0 |
| 6028 | 1395 | 1219 | 40235 | 73.3 | TGCGTACACAGCGTGCCAGC | 29 | 7 | 31 | 33 | 31 | 0 |
| 6029 | 1396 | 1220 | 4658 | 74.8 | CGAATGCGCGAACAGCAGGA | 16 | 29 | 16 | 31 | 25 | 0 |
| 6030 | 1397 | 1223 | 4665 | 72.4 | TGCGCAGCTACAGACCCACG | 29 | 31 | 7 | 32 | 30 | 0 |
| 6031 | 1398 | 1224 | 4668 | 69.5 | CACGTCTGTCTGGTGCCGAA | 30 | 8 | 8 | 33 | 16 | 0 |
| 6032 | 1399 | 1225 | 20704 | 72.1 | CACGCCATTCCCAATCCCAT | 30 | 15 | 28 | 4 | 15 | 0 |
| 6033 | 1400 | 1226 | 4671 | 67.8 | CACGGAGTTTAGTCCCTGCG | 30 | 20 | 3 | 28 | 29 | 0 |
| 6034 | 1401 | 1227 | 4674 | 72.9 | CACGTGCGGATGGTCTGCAA | 30 | 29 | 27 | 19 | 21 | 0 |
| 6035 | 1402 | 1228 | 14449 | 72 | CACGCACGCACGTTAGAGCC | 30 | 30 | 30 | 3 | 36 | 0 |
| 6036 | 1403 | 1229 | 14453 | 71.6 | CGAACAGCAATCACGGACGG | 16 | 31 | 4 | 35 | 35 | 0 |
| 6037 | 1404 | 1230 | 30255 | 67.5 | CAGCTCGTAGTGCTGTTGCG | 31 | 10 | 22 | 14 | 29 | 0 |
| 6038 | 1405 | 1231 | 40236 | 72.5 | CAGCCTTGCCATGCAAGCAA | 31 | 11 | 15 | 21 | 21 | 0 |
| 6039 | 1406 | 1232 | 4689 | 67.6 | CGAACAGCGAGTTTGATCCC | 16 | 31 | 20 | 1 | 28 | 0 |
| 6040 | 1407 | 1233 | 4690 | 66.6 | CAGCAGTGTTAGCAGCAGCC | 31 | 22 | 3 | 31 | 36 | 0 |
| 6041 | 1408 | 1234 | 40238 | 69.4 | CAGCGATGAAAGGTGCGATG | 31 | 27 | 6 | 33 | 27 | 0 |
| 6042 | 1409 | 1236 | 4696 | 73.7 | CGAACAGCCAGCGACCGGTA | 16 | 31 | 31 | 32 | 18 | 0 |
| 6043 | 1410 | 1237 | 4704 | 68.1 | GACCCTGTCTCAGTGCGTGC | 32 | 14 | 13 | 33 | 33 | 0 |
| 6044 | 1411 | 1238 | 14466 | 65.8 | GACCGTCTAGGATCCCCTCA | 32 | 19 | 25 | 28 | 13 | 0 |
| 6045 | 1412 | 1239 | 4713 | 68.3 | CGAAGACCTCCCCCTAATCG | 16 | 32 | 28 | 26 | 24 | 0 |
| 6046 | 1413 | 1240 | 14470 | 67.2 | GACCTGCGTTAGCTCAAGCC | 32 | 29 | 3 | 13 | 36 | 0 |
| 6047 | 1414 | 1241 | 40239 | 68.8 | GTGCGGTAAATCTCGTTGCG | 33 | 18 | 4 | 10 | 29 | 0 |
| 6048 | 1415 | 1242 | 14481 | 69.8 | CGAAGTGCAGGAAGCCTCGT | 16 | 33 | 25 | 36 | 10 | 0 |
| 6049 | 1416 | 1243 | 4734 | 69.6 | GTGCTCCCCCTAGATGCGAA | 33 | 28 | 26 | 27 | 16 | 0 |
| 6050 | 1417 | 1244 | 14485 | 73 | CGAAGTGCAGCCGATGGGAC | 16 | 33 | 36 | 27 | 34 | 0 |
| 6051 | 1418 | 1245 | 4747 | 68.8 | GGACGCTTGACCTGATGCAA | 34 | 17 | 32 | 2 | 21 | 0 |
| 6052 | 1419 | 1247 | 14491 | 69.3 | GGACACCTTCTGTCCCACGG | 34 | 23 | 8 | 28 | 35 | 0 |
| 6053 | 1420 | 1248 | 4755 | 68.5 | GGACGATGGAGTACGGGCTT | 34 | 27 | 20 | 35 | 17 | 0 |
| 6054 | 1421 | 1250 | 30260 | 68.8 | ACGGTGATTCCCTGTCGACC | 35 | 2 | 28 | 9 | 32 | 0 |
| 6055 | 1422 | 1252 | 14498 | 69.5 | ACGGTCTGCAGCAAAGTCCC | 35 | 8 | 31 | 6 | 28 | 1 |
| 6056 | 1423 | 1253 | 30262 | 70.2 | CGAAACGGGAGTGGACGGTA | 16 | 35 | 20 | 34 | 18 | 0 |
| 6057 | 1424 | 1254 | 20723 | 66.5 | CGAAACGGACCTAGGACGTT | 16 | 35 | 23 | 25 | 12 | 0 |
| 6058 | 1425 | 1255 | 40241 | 68.5 | ACGGAGGACTTGATCGAGCC | 35 | 25 | 11 | 24 | 36 | 0 |
| 6059 | 1426 | 1256 | 4775 | 71.5 | CGAAACGGCCTATCGTGCAA | 16 | 35 | 26 | 10 | 21 | 0 |
| 6060 | 1427 | 1257 | 4778 | 73.7 | CGAAACGGTGCGCTGTTCGT | 16 | 35 | 29 | 14 | 10 | 0 |
| 6061 | 1428 | 1258 | 4781 | 76.1 | CGAAACGGACGGCACGATCG | 16 | 35 | 35 | 30 | 24 | 0 |
| 6062 | 1429 | 1260 | 30263 | 67.5 | AGCCTGATCCTATCCCGGAC | 36 | 2 | 26 | 28 | 34 | 0 |
| 6063 | 1430 | 1261 | 4786 | 70.8 | CGAAAGCCTCTGGCAACGAA | 16 | 36 | 8 | 21 | 16 | 0 |
| 6064 | 1431 | 1262 | 40243 | 68.3 | AGCCCTCAAATCGATGGGAC | 36 | 13 | 4 | 27 | 34 | 0 |
| 6065 | 1432 | 1264 | 14508 | 67.6 | CGAAAGCCACCTTTAGCAGC | 16 | 36 | 23 | 3 | 31 | 0 |
| 6066 | 1433 | 1265 | 4795 | 70.7 | AGCCATCGGTCTGATGCGAA | 36 | 24 | 19 | 27 | 16 | 0 |
| 6067 | 1434 | 1266 | 30266 | 68.2 | AGCCAGGAAGTGGATGGCTT | 36 | 25 | 22 | 27 | 17 | 0 |
| 6068 | 1435 | 1267 | 14510 | 70.6 | CGAAAGCCGATGCGAATGAT | 16 | 36 | 27 | 16 | 2 | 0 |
| 6069 | 1436 | 1268 | 14511 | 75.3 | CGAAAGCCGTGCGATGGGAC | 16 | 36 | 33 | 27 | 34 | 0 |
| 6070 | 1437 | 1269 | 20732 | 67.8 | TGATATCGCTTGACGGGACC | 2 | 24 | 11 | 35 | 32 | 0 |
| 6071 | 1438 | 1270 | 4811 | 73.6 | TGATCAGCTCCCGACCTGCG | 2 | 31 | 28 | 32 | 29 | 0 |
| 6072 | 1439 | 1271 | 4812 | 71.8 | TGATGACCCCATTCCCGACC | 2 | 32 | 15 | 28 | 32 | 0 |
| 6073 | 1440 | 1272 | 4829 | 71.5 | AATCCAGCGGTATCCCCACG | 4 | 31 | 18 | 28 | 30 | 0 |

FIG. 29EE

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 6074 | 1441 | 1273 | 30268 | 73.8 | AAAGCGTTTGCGCCATGTGC | 6 | 12 | 29 | 15 33 | 0 |
| 6075 | 1442 | 1274 | 30269 | 72 | AAAGCAGCGACCGCTTCGTT | 6 | 31 | 32 | 17 12 | 0 |
| 6076 | 1443 | 1275 | 14530 | 72 | TCTGCTTGACGGCTTGGCAA | 8 | 11 | 35 | 11 21 | 0 |
| 6077 | 1444 | 1276 | 14532 | 67.9 | TCTGCTCAGGACGCTTTCGT | 8 | 13 | 34 | 17 10 | 0 |
| 6078 | 1445 | 1277 | 4845 | 70.7 | TCTGCTGTTCCCCAGCCTCA | 8 | 14 | 28 | 31 13 | 0 |
| 6079 | 1446 | 1278 | 14535 | 68.3 | TCTGCCTAAGGATGCGATCG | 8 | 26 | 25 | 29 24 | 0 |
| 6080 | 1447 | 1279 | 14536 | 71 | TCTGGGACGCAAATCGCCTA | 8 | 34 | 21 | 24 26 | 0 |
| 6081 | 1448 | 1280 | 20744 | 68.8 | TGTCGAGTGTCTTCCCTGCG | 9 | 20 | 19 | 28 29 | 0 |
| 6082 | 1449 | 1281 | 14544 | 72 | TGTCGACCGCTTCGAAGCAA | 9 | 32 | 17 | 16 21 | 0 |
| 6083 | 1450 | 1282 | 4867 | 73.8 | TCGTTGTCGTGCTGCGCTCA | 10 | 9 | 33 | 29 13 | 0 |
| 6084 | 1451 | 1283 | 14548 | 70.3 | TCGTCGTTGTGCAGGAGCAA | 10 | 12 | 33 | 25 21 | 0 |
| 6085 | 1452 | 1285 | 14552 | 71.2 | TCGTGATGCCTATCCCTGCG | 10 | 27 | 26 | 28 29 | 0 |
| 6086 | 1453 | 1286 | 30272 | 68.2 | TCGTAGCCTTAGTCCCGCAA | 10 | 36 | 3 | 28 21 | 0 |
| 6087 | 1454 | 1287 | 30273 | 69.3 | CTTGCCATCTTGGATGTGCG | 11 | 15 | 11 | 27 29 | 0 |
| 6088 | 1455 | 1288 | 30274 | 69 | CTTGGCAAAGTGCGTTACGG | 11 | 21 | 22 | 12 35 | 0 |
| 6089 | 1456 | 1289 | 4887 | 72.7 | CTTGATCGACGGTCCCACGG | 11 | 24 | 35 | 28 35 | 1 |
| 6090 | 1457 | 1291 | 4907 | 71.1 | CGTTCAGCCGTTGACCAGGA | 12 | 31 | 12 | 32 25 | 0 |
| 6091 | 1458 | 1292 | 30275 | 73.8 | GCTTCGTTGTGCAGCCCGAA | 17 | 12 | 33 | 36 16 | 0 |
| 6092 | 1459 | 1293 | 4917 | 74.2 | CTCAGTGCGCTTTGCGCGTT | 13 | 33 | 17 | 29 12 | 0 |
| 6093 | 1460 | 1294 | 14568 | 73 | CTGTACGGGACCGACCTGCG | 14 | 35 | 32 | 32 29 | 0 |
| 6094 | 1461 | 1295 | 30276 | 72.9 | CCATTCCCGATGTCCCTCCC | 15 | 28 | 27 | 28 28 | 0 |
| 6095 | 1462 | 1296 | 14575 | 73 | CGAACTTGGCAATCCCGTGC | 16 | 11 | 21 | 28 33 | 0 |
| 6096 | 1463 | 1297 | 4950 | 71.1 | CGAACTGTGCAAAGCCCAGC | 16 | 14 | 21 | 36 31 | 0 |
| 6097 | 1464 | 1298 | 4953 | 70.8 | CGAAAGTGGCAAACGGGATG | 16 | 22 | 21 | 35 27 | 0 |
| 6098 | 1465 | 1299 | 30277 | 70 | GCTTCGAAAGGATGCGCTGT | 17 | 16 | 25 | 29 14 | 0 |
| 6099 | 1466 | 1300 | 20755 | 66.2 | GCTTCTTGATACAGCCGCAA | 17 | 11 | 5 | 36 21 | 0 |
| 6100 | 1467 | 1301 | 40247 | 68.7 | GCTTGCTTTCCCTCTGAGCC | 17 | 17 | 28 | 8 36 | 0 |
| 6101 | 1468 | 1302 | 4982 | 67.9 | GCTTGGTAGCAAGTGCGGAC | 17 | 18 | 21 | 33 34 | 0 |
| 6102 | 1469 | 1303 | 4991 | 71.2 | GAGTCGTTTCCCGACCAGCC | 20 | 12 | 28 | 32 36 | 1 |
| 6103 | 1470 | 1304 | 4994 | 73 | GAGTGTGCTGCGCTTGCACG | 20 | 33 | 29 | 11 30 | 0 |
| 6104 | 1471 | 1305 | 14589 | 72 | GCTTGCAAAAAGCACGCGAA | 17 | 21 | 6 | 30 16 | 0 |
| 6105 | 1472 | 1306 | 30279 | 69.6 | GCAATCGTCTCAGCAATGCG | 21 | 10 | 13 | 21 29 | 0 |
| 6106 | 1473 | 1307 | 30280 | 69.4 | GCAACGAAGTCTCAGCGCAA | 21 | 16 | 19 | 31 21 | 0 |
| 6107 | 1474 | 1308 | 30281 | 70.5 | GCTTGCAAACCTCACGCCAT | 17 | 21 | 23 | 30 15 | 0 |
| 6108 | 1475 | 1309 | 5005 | 70.3 | GCTTGCAAGATGCAGCTCCC | 17 | 21 | 27 | 31 28 | 0 |
| 6109 | 1476 | 1310 | 5022 | 73.2 | ACCTCAGCTCCCAGCCAGCC | 23 | 31 | 28 | 36 36 | 0 |
| 6110 | 1477 | 1311 | 40248 | 69.4 | ATCGCTTGTCTGGTGCTCCC | 24 | 11 | 8 | 33 28 | 0 |
| 6111 | 1478 | 1312 | 30283 | 69.4 | ATCGCCTATTGAACGGCGTT | 24 | 26 | 1 | 35 12 | 0 |
| 6112 | 1479 | 1313 | 14603 | 73.4 | ATCGGACCGACCCTTGCGTT | 24 | 32 | 32 | 11 12 | 0 |
| 6113 | 1480 | 1314 | 5045 | 71.9 | CCTACGTTTGCGCTTGCGAA | 26 | 12 | 29 | 11 16 | 0 |
| 6114 | 1481 | 1315 | 30284 | 70.5 | GATGGCAAAGGACACGACGG | 27 | 21 | 25 | 30 35 | 0 |
| 6115 | 1482 | 1316 | 30285 | 68.5 | GCTTGATGCACGAAAGCGTT | 17 | 27 | 30 | 6 12 | 0 |
| 6116 | 1483 | 1317 | 20770 | 67.1 | GATGGTGCATACCGTTTCCC | 27 | 33 | 5 | 12 28 | 1 |
| 6117 | 1484 | 1318 | 5072 | 71.1 | TCCCATCGGTCTGACCTCCC | 28 | 24 | 19 | 32 28 | 0 |
| 6118 | 1485 | 1319 | 14622 | 73.7 | TCCCGACCGGTATGTCGCAA | 28 | 32 | 18 | 9 21 | 0 |
| 6119 | 1486 | 1320 | 30289 | 73.3 | TGCGTACAACGGGCAATCCC | 29 | 7 | 35 | 21 28 | 0 |
| 6120 | 1487 | 1321 | 14629 | 72.2 | TGCGCGAAGAGTATCGGCAA | 29 | 16 | 20 | 24 21 | 0 |
| 6121 | 1488 | 1322 | 5087 | 68.3 | TGCGGGTAAATCGAGTACGG | 29 | 18 | 4 | 20 35 | 0 |

FIG. 29FF

| SEQ ID NO: | ZIP ID# | 4,633 HEX ID# | Tm | ZIPCODE (NH2 -> CONH2) | TETRAMER NUMBERS | | | | | "UNALLOWED DIMERS" |
|---|---|---|---|---|---|---|---|---|---|---|
| 6122 | 1489 | 1323 | 30290 | 72.6 | TGCGAGTGGGACCTTGAGCC | 29 | 22 | 34 | 11 | 36 | 0 |
| 6123 | 1490 | 1324 | 14631 | 74.5 | GCTTTGCGATCGGCAATCCC | 17 | 29 | 24 | 21 | 28 | 0 |
| 6124 | 1491 | 1325 | 14632 | 72.6 | TGCGACGGTGTCAAAGGCAA | 29 | 35 | 9 | 6 | 21 | 0 |
| 6125 | 1492 | 1326 | 5097 | 74.3 | CACGTGTCCACGTCCCCACG | 30 | 9 | 30 | 28 | 30 | 0 |
| 6126 | 1493 | 1327 | 40252 | 68.7 | CACGCTTGAAAGCAGCGAGT | 30 | 11 | 6 | 31 | 20 | 0 |
| 6127 | 1494 | 1328 | 5100 | 67.6 | CACGCTGTTACAATCGGCAA | 30 | 14 | 7 | 24 | 21 | 0 |
| 6128 | 1495 | 1329 | 14636 | 72.7 | CACGTCCCGATGCTTGGACC | 30 | 28 | 27 | 11 | 32 | 0 |
| 6129 | 1496 | 1330 | 30293 | 73.2 | CACGGACCCACGGAGTCGAA | 30 | 32 | 30 | 20 | 16 | 0 |
| 6130 | 1497 | 1331 | 5108 | 71.5 | CAGCAATCTCCCCGAAAGCC | 31 | 4 | 28 | 16 | 36 | 0 |
| 6131 | 1498 | 1332 | 5109 | 72.4 | CAGCTCTGAGCCTCCCCACG | 31 | 8 | 36 | 28 | 30 | 0 |
| 6132 | 1499 | 1333 | 30294 | 66.9 | CAGCTCGTAATCTCCCCAGC | 31 | 10 | 4 | 28 | 31 | 0 |
| 6133 | 1500 | 1334 | 5117 | 68.1 | CAGCGCAAAAAGAATCGACC | 31 | 21 | 6 | 4 | 32 | 0 |
| 6134 | 1501 | 1335 | 40256 | 70.8 | CAGCACCTGGTAAGCCACGG | 31 | 23 | 18 | 36 | 35 | 0 |
| 6135 | 1502 | 1336 | 5123 | 72.4 | CAGCCACGGCAACTCAGCAA | 31 | 30 | 21 | 13 | 21 | 0 |
| 6136 | 1503 | 1337 | 5128 | 72.9 | GACCAATCCACGTGCGAGCC | 32 | 4 | 30 | 29 | 36 | 0 |
| 6137 | 1504 | 1338 | 30296 | 69.6 | GCTTGACCCCATGCTTGCTT | 17 | 32 | 15 | 17 | 17 | 0 |
| 6138 | 1505 | 1339 | 40258 | 71.8 | GACCCCTAAGCCCACGCTCA | 32 | 26 | 36 | 30 | 13 | 0 |
| 6139 | 1506 | 1340 | 14653 | 75.4 | GCTTGACCCAGCGACCGTGC | 17 | 32 | 31 | 32 | 33 | 0 |
| 6140 | 1507 | 1341 | 14656 | 71.7 | GCTTGTGCATCGGTGCCTTG | 17 | 33 | 24 | 33 | 11 | 0 |
| 6141 | 1508 | 1342 | 5148 | 71 | GCTTGTGCTCCCAATCTGCG | 17 | 33 | 28 | 4 | 29 | 0 |
| 6142 | 1509 | 1343 | 20786 | 71.3 | GGACCGTTTCTGGTGCCCAT | 34 | 12 | 8 | 33 | 15 | 0 |
| 6143 | 1510 | 1344 | 5158 | 70.4 | GCTTGGACCGAATCTGGCAA | 17 | 34 | 16 | 8 | 21 | 0 |
| 6144 | 1511 | 1345 | 5161 | 70.1 | GGACTCCCCTTGTGTCGCAA | 34 | 28 | 11 | 9 | 21 | 0 |
| 6145 | 1512 | 1346 | 40259 | 69.3 | GGACCACGTACATCCCAGCC | 34 | 30 | 7 | 28 | 36 | 0 |
| 6146 | 1513 | 1347 | 14668 | 72.9 | ACGGTCTGACGGTGCGTCGT | 35 | 8 | 35 | 29 | 10 | 0 |
| 6147 | 1514 | 1348 | 30301 | 69.9 | AGCCCTGTAATCACGGGCAA | 36 | 14 | 4 | 35 | 21 | 0 |
| 6148 | 1515 | 1349 | 5192 | 70.5 | AGCCATCGCTCAAAAGCGAA | 36 | 24 | 13 | 6 | 16 | 0 |
| 6149 | 1516 | 1350 | 5216 | 72.1 | TCTGGTGCAGGACGAATGCG | 8 | 33 | 25 | 16 | 29 | 0 |
| 6150 | 1517 | 1351 | 5219 | 76.2 | TGTCGCTTTGCGCAGCTCCC | 9 | 17 | 29 | 31 | 28 | 0 |
| 6151 | 1518 | 1352 | 5252 | 74 | CGAACAGCGGTAAGCCGCAA | 16 | 31 | 18 | 36 | 21 | 0 |
| 6152 | 1519 | 1353 | 30304 | 70.1 | CGAAAGCCTACAAGCCCGAA | 16 | 36 | 7 | 36 | 16 | 0 |
| 6153 | 1520 | 1354 | 5266 | 75.5 | GCAACAGCGACCCAGCCAGC | 21 | 31 | 32 | 31 | 31 | 0 |
| 6154 | 1521 | 1355 | 5268 | 71.9 | GCAAGGACTGCGTCTGTGCG | 21 | 34 | 29 | 8 | 29 | 0 |
| 6155 | 1522 | 1356 | 5277 | 74.7 | ACCTCACGTGCGCTGTTGCG | 23 | 30 | 29 | 14 | 29 | 0 |
| 6156 | 1523 | 1357 | 40264 | 70.4 | ATCGGCAACGTTCTTGACGG | 24 | 21 | 12 | 11 | 35 | 0 |
| 6157 | 1524 | 1358 | 5296 | 71.3 | GATGGCTTCGTTTCCCCAGC | 27 | 17 | 12 | 28 | 31 | 1 |
| 6158 | 1525 | 1359 | 14728 | 72.2 | TGCGGCAACTGTATCGGTGC | 29 | 21 | 14 | 24 | 33 | 0 |
| 6159 | 1526 | 1360 | 5328 | 72.2 | TGCGAGTGGTGCGGTAGTGC | 29 | 22 | 33 | 18 | 33 | 0 |
| 6160 | 1527 | 1361 | 30306 | 71.1 | CACGGCAACGTTCCATTCGT | 30 | 21 | 12 | 15 | 10 | 0 |
| 6161 | 1528 | 1362 | 5341 | 73.7 | CACGATCGGACCAGGATGCG | 30 | 24 | 32 | 25 | 29 | 0 |
| 6162 | 1529 | 1363 | 5344 | 73.2 | CACGAGCCGAGTCAGCGCTT | 30 | 36 | 20 | 31 | 17 | 0 |
| 6163 | 1530 | 1364 | 30307 | 70.4 | CAGCGCTTAGGAGGACGTGC | 31 | 17 | 25 | 34 | 33 | 0 |
| 6164 | 1531 | 1365 | 5355 | 73.3 | CAGCGACCCTGTTCCCTCCC | 31 | 32 | 14 | 28 | 28 | 0 |
| 6165 | 1532 | 1366 | 5360 | 71.3 | GACCGGTACAGCATCGCGAA | 32 | 18 | 31 | 24 | 16 | 0 |
| 6166 | 1533 | 1367 | 5362 | 74.9 | GACCATCGCAGCGTGCATCG | 32 | 24 | 31 | 33 | 24 | 0 |
| 6167 | 1534 | 1368 | 40267 | 75.8 | GACCGTGCCCATCCATTGCG | 32 | 33 | 15 | 15 | 29 | 0 |
| 6168 | 1535 | 1369 | 5368 | 69.9 | GACCACGGTTAGTGCGAGCC | 32 | 35 | 3 | 29 | 36 | 0 |
| 6169 | 1536 | 1370 | 30308 | 70.5 | ACGGTCGTTTAGACGGTGCG | 35 | 10 | 3 | 35 | 29 | 0 |

FIG. 29GG

| SEQ ID NO: | ZIP ID# | 4,633 HEX ID# | Tm | ZIPCODE (NH2 -> CONH2) | TETRAMER NUMBERS | | | | | "UNALLOWED DIMERS" |
|---|---|---|---|---|---|---|---|---|---|---|
| 6170 | 1537 | 1371 | 30309 | 71.8 | ACGGCTGTGTGCGATGGATG | 35 | 14 | 33 | 27 | 27 | 0 |
| 6171 | 1538 | 1372 | 30310 | 69.5 | AGCCGAGTACCTTGCGCTGT | 36 | 20 | 23 | 29 | 14 | 0 |
| 6172 | 1539 | 1373 | 5420 | 72.6 | TTGATGCGCGTTTGCGAAAG | 1 | 29 | 12 | 29 | 6 | 0 |
| 6173 | 1540 | 1374 | 5425 | 74.5 | TCTGCAGCTGCGCTTGCCAT | 8 | 31 | 29 | 11 | 15 | 0 |
| 6174 | 1541 | 1376 | 5437 | 76.4 | CTTGCAGCACGGTCCCTGCG | 11 | 31 | 35 | 28 | 29 | 1 |
| 6175 | 1542 | 1377 | 5440 | 73.2 | CGTTCGAACAGCAGCCGCTT | 12 | 16 | 31 | 36 | 17 | 0 |
| 6176 | 1543 | 1378 | 5444 | 75.8 | CGTTGTGCCACGTCGTTGCG | 12 | 33 | 30 | 10 | 29 | 0 |
| 6177 | 1544 | 1379 | 5449 | 72.1 | CCATTCCCACGGCTGTAGCC | 15 | 28 | 35 | 14 | 36 | 0 |
| 6178 | 1545 | 1380 | 5450 | 72.9 | CGAACGAACAGCGCAACACG | 16 | 16 | 31 | 21 | 30 | 0 |
| 6179 | 1546 | 1381 | 5453 | 74.4 | CGAAATCGCGAAACGGGACC | 16 | 24 | 16 | 35 | 32 | 0 |
| 6180 | 1547 | 1382 | 20836 | 68.6 | GCAAATCGAATCTCCCCGTT | 21 | 24 | 4 | 28 | 12 | 0 |
| 6181 | 1548 | 1383 | 5481 | 75.4 | GATGCAGCATCGTGCGGCAA | 27 | 31 | 24 | 29 | 21 | 0 |
| 6182 | 1549 | 1384 | 30311 | 76.1 | TCCCCTTGACGGCGTTGCAA | 28 | 11 | 35 | 12 | 21 | 0 |
| 6183 | 1550 | 1385 | 30312 | 71.7 | TCCCCCATTCTGACGGGGTA | 28 | 15 | 8 | 35 | 18 | 0 |
| 6184 | 1551 | 1386 | 40269 | 74 | TCCCACGGAGTGCCATGTGC | 28 | 35 | 22 | 15 | 33 | 0 |
| 6185 | 1552 | 1387 | 5498 | 73.7 | TGCGAGTGATCGAGCCAGCC | 29 | 22 | 24 | 36 | 36 | 0 |
| 6186 | 1553 | 1388 | 30313 | 72.5 | TGCGGACCTCCCTACAACGG | 29 | 32 | 28 | 7 | 35 | 0 |
| 6187 | 1554 | 1389 | 5507 | 73.7 | CACGCTCAACGGCTTGCCAT | 30 | 13 | 35 | 11 | 15 | 0 |
| 6188 | 1555 | 1390 | 30314 | 74.1 | CACGGCTTTGTCAGCCGTGC | 30 | 17 | 9 | 36 | 33 | 0 |
| 6189 | 1556 | 1391 | 5509 | 73.8 | CACGCCTAGACCTGCGGCAA | 30 | 26 | 32 | 29 | 21 | 0 |
| 6190 | 1557 | 1392 | 5510 | 74 | CACGTCCCCTGTGCTTTGCG | 30 | 28 | 14 | 17 | 29 | 0 |
| 6191 | 1558 | 1393 | 14801 | 74.9 | CACGACGGCGTTCGTTGTGC | 30 | 35 | 12 | 12 | 33 | 0 |
| 6192 | 1559 | 1394 | 5519 | 71.6 | CAGCCAGCTCGTTCGTCGAA | 31 | 31 | 10 | 10 | 16 | 0 |
| 6193 | 1560 | 1395 | 5520 | 74.8 | CAGCGGACGGACGGACCCTA | 31 | 34 | 34 | 34 | 26 | 0 |
| 6194 | 1561 | 1396 | 40271 | 72.8 | GTGCGCTTCACGTTGATGCG | 33 | 17 | 30 | 1 | 29 | 0 |
| 6195 | 1562 | 1397 | 40272 | 72.5 | GTGCGCAAGGACCGTTCCAT | 33 | 21 | 34 | 12 | 15 | 0 |
| 6196 | 1563 | 1399 | 40273 | 75 | GTGCAGCCGCTTTCCCAGGA | 33 | 36 | 17 | 28 | 25 | 0 |
| 6197 | 1564 | 1400 | 30315 | 70.7 | GTCTGGACGCTTACGGCGAA | 19 | 34 | 17 | 35 | 16 | 0 |
| 6198 | 1565 | 1401 | 5540 | 76.1 | GGACTCCCGCAACACGTGCG | 34 | 28 | 21 | 30 | 29 | 0 |
| 6199 | 1566 | 1402 | 5545 | 73.9 | GGACAGCCATCGATCGTGCG | 34 | 36 | 24 | 24 | 29 | 0 |
| 6200 | 1567 | 1403 | 14814 | 71.8 | AGCCGGTACAGCTCCCATCG | 36 | 18 | 31 | 28 | 24 | 0 |
| 6201 | 1568 | 1404 | 5568 | 79.2 | TCTGTGCGCACGCACGGCAA | 8 | 29 | 30 | 30 | 21 | 0 |
| 6202 | 1569 | 1405 | 5569 | 76.6 | TCTGCACGACGGCACGTCCC | 8 | 30 | 35 | 30 | 28 | 0 |
| 6203 | 1570 | 1407 | 5577 | 74.1 | CTTGCACGCCATAGCCCACG | 11 | 30 | 15 | 36 | 30 | 0 |
| 6204 | 1571 | 1408 | 5580 | 72 | CGTTCGTTAGCCATCGTGCG | 12 | 12 | 36 | 24 | 29 | 0 |
| 6205 | 1572 | 1409 | 20857 | 72.3 | CTGTCACGCAGCAGCCAGGA | 14 | 30 | 31 | 36 | 25 | 0 |
| 6206 | 1573 | 1410 | 30317 | 72.8 | CGAAAGCCTGCGTCGTCCAT | 16 | 36 | 29 | 10 | 15 | 0 |
| 6207 | 1574 | 1411 | 5597 | 71.4 | GCTTGCAACACGCACGACCT | 17 | 21 | 30 | 30 | 23 | 0 |
| 6208 | 1575 | 1412 | 5599 | 76.4 | GCTTCACGGTGCGTGCAGCC | 17 | 30 | 33 | 33 | 36 | 0 |
| 6209 | 1576 | 1413 | 5612 | 72.8 | ATCGTGCGATCGGACCCTCA | 24 | 29 | 24 | 32 | 13 | 0 |
| 6210 | 1577 | 1414 | 20866 | 72.8 | CCTACAGCTCCCGCTTTGCG | 26 | 31 | 28 | 17 | 29 | 0 |
| 6211 | 1578 | 1415 | 5633 | 73.3 | TCCCGTGCCCTATCGTGTGC | 28 | 33 | 26 | 10 | 33 | 0 |
| 6212 | 1579 | 1416 | 14828 | 76.8 | TGCAAAGCACGGGACGTGC | 29 | 6 | 30 | 34 | 33 | 0 |
| 6213 | 1580 | 1417 | 5645 | 71.6 | TGCGCCATTACATCCCGGTA | 29 | 15 | 7 | 28 | 18 | 0 |
| 6214 | 1581 | 1418 | 40276 | 72.3 | TGCGGGTAGCAATCTGCACG | 29 | 18 | 21 | 8 | 30 | 0 |
| 6215 | 1582 | 1419 | 40277 | 75.2 | TGCGACCTAGCCTCCCTGCG | 29 | 23 | 36 | 28 | 29 | 0 |
| 6216 | 1583 | 1420 | 5671 | 77 | CAGCGATGGTGCGGACACGG | 31 | 27 | 33 | 34 | 35 | 0 |
| 6217 | 1584 | 1421 | 20874 | 70.8 | CAGCTCCCTCTGGACCCGTT | 31 | 28 | 8 | 32 | 12 | 0 |

FIG. 29HH

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6218 | 1585 | 1422 | 5673 | 74.2 | CAGCGGACAGCCGAGTCACG | 31 | 34 | 36 | 20 | 30 | 0 |
| 6219 | 1586 | 1423 | 5676 | 71.4 | GAGTGACCCGTTTCCCCGAA | 20 | 32 | 12 | 28 | 16 | 1 |
| 6220 | 1587 | 1425 | 14843 | 75.2 | GACCGTGCGACCAGCCCTTG | 32 | 33 | 32 | 36 | 11 | 0 |
| 6221 | 1588 | 1426 | 20876 | 69.8 | GTGCTTGAGGACTCCCGTGC | 33 | 1 | 34 | 28 | 33 | 0 |
| 6222 | 1589 | 1428 | 5693 | 71.5 | GGACCCATTGTCGGACGGAC | 34 | 15 | 9 | 34 | 34 | 0 |
| 6223 | 1590 | 1429 | 5699 | 71.3 | GGACGGACTGTCATCGCACG | 34 | 34 | 9 | 24 | 30 | 0 |
| 6224 | 1591 | 1430 | 14849 | 71.7 | ACGGCCATTTAGTGCGGCTT | 35 | 15 | 3 | 29 | 17 | 0 |
| 6225 | 1592 | 1431 | 5716 | 76.9 | AGCCATCGGACCAGCCCACG | 36 | 24 | 32 | 36 | 30 | 0 |
| 6226 | 1593 | 1432 | 5730 | 71.3 | GCAATTGAGTGCGGACCGAA | 21 | 1 | 33 | 34 | 16 | 0 |
| 6227 | 1594 | 1433 | 5732 | 71.1 | TGATTCGTTCCCCTTGCACG | 2 | 10 | 28 | 11 | 30 | 0 |
| 6228 | 1595 | 1434 | 5737 | 72.8 | TGATCAGCGCTTTCCCAGCC | 2 | 31 | 17 | 28 | 36 | 0 |
| 6229 | 1596 | 1435 | 5752 | 71.2 | GCAAAATCATCGGTGCCGAA | 21 | 4 | 24 | 33 | 16 | 0 |
| 6230 | 1597 | 1436 | 40281 | 68.2 | AATCTCCCATCGCTCATCCC | 4 | 28 | 24 | 13 | 28 | 0 |
| 6231 | 1598 | 1437 | 14874 | 70.5 | GCAAAATCCACGCAGCCTGT | 21 | 4 | 30 | 31 | 14 | 0 |
| 6232 | 1599 | 1438 | 5778 | 66.6 | AAAGACCTAGGAAGCCGCAA | 6 | 23 | 25 | 36 | 21 | 0 |
| 6233 | 1600 | 1440 | 30319 | 68.2 | TCTGCGTTTTAGGGACACGG | 8 | 12 | 3 | 34 | 35 | 0 |
| 6234 | 1601 | 1441 | 30320 | 68.8 | TCTGGCAACGTTATCGCGTT | 8 | 21 | 12 | 24 | 12 | 0 |
| 6235 | 1602 | 1442 | 5792 | 70.4 | TCTGTCCCGCAACTCAAGCC | 8 | 28 | 21 | 13 | 36 | 0 |
| 6236 | 1603 | 1443 | 5793 | 73.1 | TCTGTGCGCTGTGGACGTGC | 8 | 29 | 14 | 34 | 33 | 0 |
| 6237 | 1604 | 1444 | 30321 | 69.4 | TCTGGACCAATCAGCCCCAT | 8 | 32 | 4 | 36 | 15 | 0 |
| 6238 | 1605 | 1445 | 40284 | 75.8 | TCTGGGACAGCCGTGCCAGC | 8 | 34 | 36 | 33 | 31 | 0 |
| 6239 | 1606 | 1446 | 5796 | 72.7 | TGTCTCGTGACCTGCGCGAA | 9 | 10 | 32 | 29 | 16 | 0 |
| 6240 | 1607 | 1447 | 30323 | 70.3 | TGTCGCTTTCGTGTGCCTCA | 9 | 17 | 10 | 33 | 13 | 0 |
| 6241 | 1608 | 1448 | 20893 | 69.1 | TGTCGGTAGACCTCCCGCTT | 9 | 18 | 32 | 28 | 17 | 0 |
| 6242 | 1609 | 1449 | 14901 | 73 | TGTCATCGTCCCTCCCCACG | 9 | 24 | 28 | 28 | 30 | 0 |
| 6243 | 1610 | 1450 | 5804 | 72.2 | GCAATGTCTGCGGATGCGAA | 21 | 9 | 29 | 27 | 16 | 0 |
| 6244 | 1611 | 1451 | 14902 | 71.7 | GCAATGTCCACGCGAAATCG | 21 | 9 | 30 | 16 | 24 | 0 |
| 6245 | 1612 | 1452 | 5812 | 69.4 | TCGTCTGTTGCGAATCCGAA | 10 | 14 | 29 | 4 | 16 | 0 |
| 6246 | 1613 | 1453 | 5818 | 69.5 | TCGTACCTGCTTGTGCCGAA | 10 | 23 | 17 | 33 | 16 | 0 |
| 6247 | 1614 | 1455 | 30324 | 69.6 | TCGTAGCCTGATTCCCCAGC | 10 | 36 | 2 | 28 | 31 | 0 |
| 6248 | 1615 | 1456 | 5835 | 73.6 | CTTGGATGAGCCCACGCGAA | 11 | 27 | 36 | 30 | 16 | 0 |
| 6249 | 1616 | 1457 | 14911 | 71.8 | GCAACTTGCAGCCGAAGCAA | 21 | 11 | 31 | 16 | 21 | 0 |
| 6250 | 1617 | 1458 | 40286 | 68.5 | CGTTTTGATCGTCACGAGCC | 12 | 1 | 10 | 30 | 36 | 1 |
| 6251 | 1618 | 1459 | 5842 | 72.6 | CGTTTACAACGGCAGCGCAA | 12 | 7 | 35 | 31 | 21 | 0 |
| 6252 | 1619 | 1460 | 14919 | 73.9 | CGTTGATGGTGCTCCCTGCG | 12 | 27 | 33 | 28 | 29 | 0 |
| 6253 | 1620 | 1461 | 30326 | 69.2 | CGTTTCCCACCTTTGAAGCC | 12 | 28 | 23 | 1 | 36 | 2 |
| 6254 | 1621 | 1464 | 5860 | 70.4 | CTCAATCGCGAAGTGCCCAT | 13 | 24 | 16 | 33 | 15 | 0 |
| 6255 | 1622 | 1466 | 5863 | 71.8 | CTCACACGACGGGTGCAGGA | 13 | 30 | 35 | 33 | 25 | 0 |
| 6256 | 1623 | 1467 | 5864 | 70.2 | CTCAACGGGCTTGGACAGGA | 13 | 35 | 17 | 34 | 25 | 0 |
| 6257 | 1624 | 1468 | 30327 | 72.5 | GCAACTGTTGCGGCAAGCAA | 21 | 14 | 29 | 21 | 21 | 0 |
| 6258 | 1625 | 1469 | 5875 | 71.2 | CCATCTCAGGACCAGCGCAA | 15 | 13 | 34 | 31 | 21 | 0 |
| 6259 | 1626 | 1470 | 20911 | 68.9 | GCAACCATCGAATGTCACGG | 21 | 15 | 16 | 9 | 35 | 0 |
| 6260 | 1627 | 1471 | 5881 | 70.4 | CCATGATGACGGTCCCAGGA | 15 | 27 | 35 | 28 | 25 | 1 |
| 6261 | 1628 | 1472 | 5882 | 67.8 | GCAACCATTGCGTCCCTTAG | 21 | 15 | 29 | 28 | 3 | 0 |
| 6262 | 1629 | 1473 | 5885 | 71.9 | GCAACCATGGACGATGCGAA | 21 | 15 | 34 | 27 | 16 | 0 |
| 6263 | 1630 | 1474 | 20915 | 67.6 | CGAAGCTTGACCTGTCGCTT | 16 | 17 | 32 | 9 | 17 | 0 |
| 6264 | 1631 | 1475 | 40288 | 68.5 | GCTTGCTTTGTCCTTGGCAA | 17 | 17 | 9 | 11 | 21 | 0 |
| 6265 | 1632 | 1476 | 5912 | 70.5 | GCAAGCTTCACGGCTTCAGC | 21 | 17 | 30 | 17 | 31 | 0 |

FIG. 29II

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6266 | 1633 | 1477 | 5914 | 70.6 | GCTTAGCCGATGGTGCCTCA | 17 | 36 | 27 | 33 | 13 | 0 |
| 6267 | 1634 | 1478 | 5924 | 66 | GTCTGCTTAATCGACCGCAA | 19 | 17 | 4 | 32 | 21 | 0 |
| 6268 | 1635 | 1480 | 14946 | 70 | GCAAAATCGCAATCGTTCCC | 21 | 4 | 21 | 10 | 28 | 0 |
| 6269 | 1636 | 1481 | 5946 | 71.2 | GCAACTTGCTCATGCGAGCC | 21 | 11 | 13 | 29 | 36 | 0 |
| 6270 | 1637 | 1482 | 5948 | 68.4 | GCAAGCAACTCAGACCCACG | 21 | 21 | 13 | 32 | 30 | 0 |
| 6271 | 1638 | 1483 | 5952 | 70.4 | GCAAGCAAGCTTTCCCGATG | 21 | 21 | 17 | 28 | 27 | 0 |
| 6272 | 1639 | 1484 | 40290 | 70 | GCAACAGCATACGACCGCAA | 21 | 31 | 5 | 32 | 21 | 0 |
| 6273 | 1640 | 1486 | 14955 | 68.5 | GCAAAGTGGGTACCATTGCG | 21 | 22 | 18 | 15 | 29 | 0 |
| 6274 | 1641 | 1487 | 20929 | 69.7 | ACCTTCTGAGCCCTTGCACG | 23 | 8 | 36 | 11 | 30 | 0 |
| 6275 | 1642 | 1488 | 5978 | 70.6 | ACCTTGTCCAGCTCCCGGAC | 23 | 9 | 31 | 28 | 34 | 0 |
| 6276 | 1643 | 1490 | 20930 | 72 | GCAAACCTCCATTGCGGGAC | 21 | 23 | 15 | 29 | 34 | 0 |
| 6277 | 1644 | 1491 | 30333 | 68 | GCAAACCTGCAAGACCCTCA | 21 | 23 | 21 | 32 | 13 | 0 |
| 6278 | 1645 | 1492 | 40294 | 72.4 | GCAAACCTGACCGCAAAGCC | 21 | 23 | 32 | 21 | 36 | 0 |
| 6279 | 1646 | 1493 | 14961 | 71.5 | ACCTGGACGCAAGACCGACC | 23 | 34 | 21 | 32 | 32 | 0 |
| 6280 | 1647 | 1494 | 40295 | 67.3 | GCAAATCGCTCACCTAAGCC | 21 | 24 | 13 | 26 | 36 | 0 |
| 6281 | 1648 | 1495 | 30334 | 69.4 | ATCGGAGTTGTCCAGCAGCC | 24 | 20 | 9 | 31 | 36 | 0 |
| 6282 | 1649 | 1497 | 40297 | 70.8 | ATCGTCCCCAGCTGTCCCAT | 24 | 28 | 31 | 9 | 15 | 0 |
| 6283 | 1650 | 1498 | 6006 | 68.3 | GCAAATCGGACCATACGTGC | 21 | 24 | 32 | 5 | 33 | 0 |
| 6284 | 1651 | 1500 | 6010 | 71.4 | GCAAGGATCTGTGCGGCAA | 21 | 25 | 8 | 29 | 21 | 0 |
| 6285 | 1652 | 1501 | 14971 | 72.4 | AGGACTTGGGACACGGTGCG | 25 | 11 | 34 | 35 | 29 | 0 |
| 6286 | 1653 | 1502 | 6012 | 71 | AGGACTCAGTGCAGCCGCAA | 25 | 13 | 33 | 36 | 21 | 0 |
| 6287 | 1654 | 1503 | 40298 | 66 | AGGAACCTATCGGATGCGTT | 25 | 23 | 24 | 27 | 12 | 0 |
| 6288 | 1655 | 1504 | 14972 | 70.5 | GCAAGGAATCGCACGGGTA | 21 | 25 | 24 | 30 | 18 | 0 |
| 6289 | 1656 | 1505 | 6024 | 71.5 | CCTAGACCGCTTTCCCACGG | 26 | 32 | 17 | 28 | 35 | 0 |
| 6290 | 1657 | 1506 | 14975 | 68.3 | CCTAAGCCAGGATCGTTCCC | 26 | 36 | 25 | 10 | 28 | 0 |
| 6291 | 1658 | 1507 | 30336 | 67.4 | GATGCGTTAGTGGGACAGCC | 27 | 12 | 22 | 34 | 36 | 0 |
| 6292 | 1659 | 1508 | 14978 | 70.2 | GATGCCTACACGCGAAAGCC | 27 | 26 | 30 | 16 | 36 | 0 |
| 6293 | 1660 | 1509 | 6038 | 68.1 | GATGTGCGTTGAGACCCAGC | 27 | 29 | 1 | 32 | 31 | 0 |
| 6294 | 1661 | 1510 | 14982 | 73.4 | GCAATCCCAATCACGGCGAA | 21 | 28 | 4 | 35 | 16 | 0 |
| 6295 | 1662 | 1511 | 14983 | 70.3 | TCCCTCTGCAGCGAGTGCTT | 28 | 8 | 31 | 20 | 17 | 0 |
| 6296 | 1663 | 1512 | 30342 | 75.3 | TCCCACGGGGACAATCGTGC | 28 | 35 | 34 | 4 | 33 | 0 |
| 6297 | 1664 | 1513 | 40304 | 72.3 | TGCGTTAGGATGCCATTGCG | 29 | 3 | 27 | 15 | 29 | 0 |
| 6298 | 1665 | 1514 | 40305 | 72 | TGCGAAAGGATGCGTTCGAA | 29 | 6 | 27 | 12 | 16 | 0 |
| 6299 | 1666 | 1515 | 6065 | 71.3 | GCAATGCGTCGTCGAATCGT | 21 | 29 | 10 | 16 | 10 | 0 |
| 6300 | 1667 | 1516 | 6067 | 74.5 | GCAATGCGCGTTGTGCCTGT | 21 | 29 | 12 | 33 | 14 | 0 |
| 6301 | 1668 | 1517 | 30344 | 72.3 | TGCGCTCAACCTCGTTGTGC | 29 | 13 | 23 | 12 | 33 | 0 |
| 6302 | 1669 | 1518 | 6069 | 72.1 | TGCGCGAATCTGGATGATCG | 29 | 16 | 8 | 27 | 24 | 0 |
| 6303 | 1670 | 1519 | 6071 | 75 | TGCGCAGCGCTTTCTGATCG | 29 | 31 | 17 | 8 | 24 | 0 |
| 6304 | 1671 | 1520 | 6072 | 68.6 | TGCGGGACTTAGACCTTCCC | 29 | 34 | 3 | 23 | 28 | 1 |
| 6305 | 1672 | 1521 | 6075 | 71.6 | CACGAATCGATGCAGCGGAC | 30 | 4 | 27 | 31 | 34 | 0 |
| 6306 | 1673 | 1522 | 6077 | 71.3 | CACGTCTGCCTATGCGCCAT | 30 | 8 | 26 | 29 | 15 | 0 |
| 6307 | 1674 | 1523 | 14994 | 69.4 | CACGCGTTCTGTGGTAACGG | 30 | 12 | 14 | 18 | 35 | 0 |
| 6308 | 1675 | 1524 | 40306 | 68.8 | CACGCTCAGCAAAAAGCGTT | 30 | 13 | 21 | 6 | 12 | 0 |
| 6309 | 1676 | 1525 | 6091 | 71.9 | GCAACACGTCCCGTCTTCCC | 21 | 30 | 28 | 19 | 28 | 0 |
| 6310 | 1677 | 1526 | 15001 | 73.6 | GCAACACGGGACCACGATCG | 21 | 30 | 34 | 30 | 24 | 0 |
| 6311 | 1678 | 1527 | 15002 | 72.7 | CAGCTTGATGCGCCATCACG | 31 | 1 | 29 | 15 | 30 | 0 |
| 6312 | 1679 | 1528 | 40308 | 66.9 | CAGCTCGTAGGAATCGGCTT | 31 | 10 | 25 | 24 | 17 | 0 |
| 6313 | 1680 | 1529 | 20970 | 69.3 | CAGCCCATAGTGATCGCACG | 31 | 15 | 22 | 24 | 30 | 0 |

FIG. 29JJ

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6314 | 1681 | 1530 | 30346 | 67.6 | CAGCGGTAAAAGGCTTCAGC | 31 | 18 | 6 | 17 | 31 | 0 |
| 6315 | 1682 | 1531 | 30347 | 68.7 | CAGCGAGTAGGAGTGCCACG | 31 | 20 | 25 | 33 | 30 | 0 |
| 6316 | 1683 | 1532 | 15007 | 66.8 | CAGCCCTAATACAGCCCGTT | 31 | 26 | 5 | 36 | 12 | 0 |
| 6317 | 1684 | 1533 | 15008 | 74.4 | GCAACAGCCACGCTTGCAGC | 21 | 31 | 30 | 11 | 31 | 0 |
| 6318 | 1685 | 1534 | 40312 | 69.3 | GCAAGACCCCATTCGTCGTT | 21 | 32 | 15 | 10 | 12 | 0 |
| 6319 | 1686 | 1535 | 30348 | 67.1 | GACCACCTAATCGGACACGG | 32 | 23 | 4 | 34 | 35 | 0 |
| 6320 | 1687 | 1536 | 40313 | 75.1 | GCAAGACCGGACGGACCACG | 21 | 32 | 34 | 34 | 30 | 0 |
| 6321 | 1688 | 1537 | 30349 | 69.8 | GTGCCTTGAATCTGCGGGAC | 33 | 11 | 4 | 29 | 34 | 0 |
| 6322 | 1689 | 1538 | 30350 | 70.4 | GTGCCTGTCTGTTCCCACGG | 33 | 14 | 14 | 28 | 35 | 0 |
| 6323 | 1690 | 1539 | 20980 | 69.5 | GCAAGTGCGGTATCCCGAGT | 21 | 33 | 18 | 28 | 20 | 0 |
| 6324 | 1691 | 1540 | 40314 | 69.7 | GTGCGCAATTAGATCGTGCG | 33 | 21 | 3 | 24 | 29 | 0 |
| 6325 | 1692 | 1541 | 40315 | 72.6 | GTGCACCTGACCTCCCCACG | 33 | 23 | 32 | 28 | 30 | 0 |
| 6326 | 1693 | 1542 | 6133 | 70 | GTGCATCGCCTAGTGCTCCC | 33 | 24 | 26 | 33 | 28 | 0 |
| 6327 | 1694 | 1543 | 15018 | 71.1 | GCAAGTGCCCTAGTGCGTGC | 21 | 33 | 26 | 33 | 33 | 0 |
| 6328 | 1695 | 1544 | 6137 | 72.3 | GTGCTCCCGTCTGTGCCCAT | 33 | 28 | 19 | 33 | 15 | 0 |
| 6329 | 1696 | 1545 | 15020 | 70.9 | GCAAGTGCGTGCAAAGGCTT | 21 | 33 | 33 | 6 | 17 | 0 |
| 6330 | 1697 | 1546 | 15021 | 70.3 | GCAAGTGCACGGACCTTCGT | 21 | 33 | 35 | 23 | 10 | 0 |
| 6331 | 1698 | 1547 | 6142 | 73.4 | GGACAATCCGAATGCGGCAA | 34 | 4 | 16 | 29 | 21 | 0 |
| 6332 | 1699 | 1548 | 40316 | 73.8 | GGACTCGTGGACGTGCGTGC | 34 | 10 | 34 | 33 | 33 | 0 |
| 6333 | 1700 | 1549 | 30351 | 69.7 | GGACCTGTTCTGGCAAACGG | 34 | 14 | 8 | 21 | 35 | 0 |
| 6334 | 1701 | 1551 | 6151 | 71.9 | GCAAGGACATCGCCATTCCC | 21 | 34 | 24 | 15 | 28 | 0 |
| 6335 | 1702 | 1552 | 40317 | 69.2 | GGACCAGCTTAGGGACTGCG | 34 | 31 | 3 | 34 | 29 | 0 |
| 6336 | 1703 | 1553 | 6156 | 68.8 | GCAAGGACGGACAGGAGCTT | 21 | 34 | 34 | 25 | 17 | 0 |
| 6337 | 1704 | 1554 | 6159 | 69 | ACGGCTGTCACGTGATCGAA | 35 | 14 | 30 | 2 | 16 | 0 |
| 6338 | 1705 | 1555 | 6160 | 72.8 | GCAAACGGGCTTGTGCCCTA | 21 | 35 | 17 | 33 | 26 | 0 |
| 6339 | 1706 | 1556 | 40318 | 71 | ACGGGTCTGAGTCACGCACG | 35 | 19 | 20 | 30 | 30 | 0 |
| 6340 | 1707 | 1557 | 15029 | 69.9 | ACGGAGTGCTCACAGCCGTT | 35 | 22 | 13 | 31 | 12 | 0 |
| 6341 | 1708 | 1558 | 6164 | 73.7 | ACGGTGCGCGAAGTCTGTGC | 35 | 29 | 16 | 19 | 33 | 0 |
| 6342 | 1709 | 1559 | 6167 | 72.9 | ACGGGGACGATGTCTGCGAA | 35 | 34 | 27 | 8 | 16 | 0 |
| 6343 | 1710 | 1562 | 6175 | 69.2 | GCAAAGCCGTCTGTCTGCAA | 21 | 36 | 19 | 19 | 21 | 0 |
| 6344 | 1711 | 1563 | 6176 | 70.4 | GCAAAGCCACCTCCATCGAA | 21 | 36 | 23 | 15 | 16 | 0 |
| 6345 | 1712 | 1564 | 20998 | 66.4 | AGCCAGGAACCTAAAGGCAA | 36 | 25 | 23 | 6 | 21 | 0 |
| 6346 | 1713 | 1565 | 30357 | 72.1 | GCAAAGCCCCTAGTGCCGAA | 21 | 36 | 26 | 33 | 16 | 0 |
| 6347 | 1714 | 1566 | 6178 | 70 | AGCCTCCCCTGTGGTAAGCC | 36 | 28 | 14 | 18 | 36 | 0 |
| 6348 | 1715 | 1567 | 6183 | 69.8 | AATCCGAAAGGAGTGCTGCG | 4 | 16 | 25 | 33 | 29 | 0 |
| 6349 | 1716 | 1568 | 6187 | 75.8 | AATCACGGCAGCAGCCACGG | 4 | 35 | 31 | 36 | 35 | 0 |
| 6350 | 1717 | 1569 | 6195 | 76.7 | TCTGCACGCAGCCACGGACC | 8 | 30 | 31 | 30 | 32 | 0 |
| 6351 | 1718 | 1570 | 6200 | 74.6 | TCGTACGGACCTTGCGTGCG | 10 | 35 | 23 | 29 | 29 | 0 |
| 6352 | 1719 | 1571 | 40320 | 69.8 | AGTGCTTGCCATAGCCAGCC | 22 | 11 | 15 | 36 | 36 | 0 |
| 6353 | 1720 | 1572 | 6205 | 68.4 | CTTGGGTAGGACGTGCGATG | 11 | 18 | 34 | 33 | 27 | 0 |
| 6354 | 1721 | 1573 | 15037 | 67.6 | CTTGCCTACCATAGCCCGAA | 11 | 26 | 15 | 36 | 16 | 0 |
| 6355 | 1722 | 1574 | 30358 | 69.9 | AGTGCTTGGGACTGCGGGTA | 22 | 11 | 34 | 29 | 18 | 0 |
| 6356 | 1723 | 1575 | 30359 | 68.6 | CGTTTCGTAGTGGGACTGCG | 12 | 10 | 22 | 34 | 29 | 0 |
| 6357 | 1724 | 1576 | 6219 | 70.4 | CGTTGTCTGATGCGTTTGCG | 12 | 19 | 27 | 12 | 29 | 0 |
| 6358 | 1725 | 1577 | 6230 | 71 | CTCATCCCCGAAGGACGACC | 13 | 28 | 16 | 34 | 32 | 0 |
| 6359 | 1726 | 1578 | 30360 | 72.9 | CTGTTCCCATCGGTGCCAGC | 14 | 28 | 24 | 33 | 31 | 0 |
| 6360 | 1727 | 1579 | 6238 | 70.7 | CCATCTTGACGGCTCAACGG | 15 | 11 | 35 | 13 | 35 | 0 |
| 6361 | 1728 | 1581 | 6258 | 68.1 | CGAATGCGAAAGTTGAAGCC | 16 | 29 | 6 | 1 | 36 | 1 |

FIG. 29KK

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6362 | 1729 | 1582 | 40323 | 70 | GCTTCGTTCTTGCACGTCCC | 17 | 12 | 11 | 30 | 28 | 0 |
| 6363 | 1730 | 1583 | 40324 | 71.3 | GCTTTCCCGGACCCTACACG | 17 | 28 | 34 | 26 | 30 | 0 |
| 6364 | 1731 | 1584 | 6269 | 69.4 | GCTTTGCGCCTAGATGGCTT | 17 | 29 | 26 | 27 | 17 | 0 |
| 6365 | 1732 | 1585 | 6270 | 70.1 | GCTTGACCCTGTACGGCAGC | 17 | 32 | 14 | 35 | 31 | 0 |
| 6366 | 1733 | 1586 | 30364 | 70.1 | GCTTAGCCTCGTGACCCACG | 17 | 36 | 10 | 32 | 30 | 0 |
| 6367 | 1734 | 1587 | 6273 | 69.2 | GGTACGTTACGGGTGCCCAT | 18 | 12 | 35 | 33 | 15 | 0 |
| 6368 | 1735 | 1588 | 6278 | 70.3 | GGTATGCGGCTTGACCCTCA | 18 | 29 | 17 | 32 | 13 | 0 |
| 6369 | 1736 | 1589 | 6283 | 66.7 | GCAAAAAGTCTGCTGTTGCG | 21 | 6 | 8 | 14 | 29 | 0 |
| 6370 | 1737 | 1590 | 6290 | 73.7 | GCAAAGTGAGCCTGCGCAGC | 21 | 22 | 36 | 29 | 31 | 0 |
| 6371 | 1738 | 1591 | 40325 | 71.8 | GCAAGACCTCGTGTGCGTGC | 21 | 32 | 10 | 33 | 33 | 0 |
| 6372 | 1739 | 1592 | 6300 | 72.4 | ATCGCTCAACGGAGCCGGTA | 24 | 13 | 35 | 36 | 18 | 0 |
| 6373 | 1740 | 1593 | 15068 | 71 | ATCGTGCGACCTTGTCACGG | 24 | 29 | 23 | 9 | 35 | 0 |
| 6374 | 1741 | 1594 | 15069 | 72.4 | ATCGCAGCACCTTGCGGAGT | 24 | 31 | 23 | 29 | 20 | 0 |
| 6375 | 1742 | 1595 | 40327 | 74 | ATCGGTGCATCGGCTTGCAA | 24 | 33 | 24 | 17 | 21 | 0 |
| 6376 | 1743 | 1596 | 15071 | 73.4 | ATCGACGGGTATCCCACGG | 24 | 35 | 18 | 28 | 35 | 0 |
| 6377 | 1744 | 1597 | 6313 | 68 | CCTATCCCCTTGGCTTCGTT | 26 | 28 | 11 | 17 | 12 | 0 |
| 6378 | 1745 | 1598 | 6316 | 75.2 | CCTACAGCGCAATGCGCACG | 26 | 31 | 21 | 29 | 30 | 0 |
| 6379 | 1746 | 1599 | 21014 | 71 | CCTAGTGCGCTTACGGGCAA | 26 | 33 | 17 | 35 | 21 | 0 |
| 6380 | 1747 | 1600 | 6325 | 72.6 | GATGAGCCGGACACGGCCTA | 27 | 36 | 34 | 35 | 26 | 0 |
| 6381 | 1748 | 1601 | 15080 | 72.3 | TCCCTCGTAGCCAGCCAGGA | 28 | 10 | 36 | 36 | 25 | 0 |
| 6382 | 1749 | 1602 | 6329 | 74.7 | TCCCCTGTTCCCGATGCAGC | 28 | 14 | 28 | 27 | 31 | 0 |
| 6383 | 1750 | 1604 | 6337 | 71.1 | TCCCGTGCATACCGAAATCG | 28 | 33 | 5 | 16 | 24 | 0 |
| 6384 | 1751 | 1605 | 6341 | 75.3 | TGCGAATCTGCGCAGCAGGA | 29 | 4 | 29 | 31 | 25 | 0 |
| 6385 | 1752 | 1606 | 6343 | 74.4 | TGCGCTTGGTCTGACCACGG | 29 | 11 | 19 | 32 | 35 | 0 |
| 6386 | 1753 | 1607 | 6347 | 72.5 | TGCGCGAACTGTGATGCCAT | 29 | 16 | 14 | 27 | 15 | 0 |
| 6387 | 1754 | 1608 | 30366 | 70 | TGCGCCTAGAGTAGCCGCTT | 29 | 26 | 20 | 36 | 17 | 0 |
| 6388 | 1755 | 1609 | 15086 | 73.4 | TGCGTGCGTACACACGCCAT | 29 | 29 | 7 | 30 | 15 | 0 |
| 6389 | 1756 | 1610 | 40331 | 67.8 | AGTGCACGCGTTAAAGAGCC | 22 | 30 | 12 | 6 | 36 | 0 |
| 6390 | 1757 | 1611 | 15088 | 70.3 | CACGCGAATACACAGCACGG | 30 | 16 | 7 | 31 | 35 | 0 |
| 6391 | 1758 | 1612 | 40332 | 72.1 | CACGTGCGCGTTTACAAGCC | 30 | 29 | 12 | 7 | 36 | 0 |
| 6392 | 1759 | 1613 | 30369 | 68.5 | CACGGACCTTAGAGCCCCAT | 30 | 32 | 3 | 36 | 15 | 0 |
| 6393 | 1760 | 1614 | 15093 | 67.6 | CAGCGCTTCCTAAAAGGTGC | 31 | 17 | 26 | 6 | 33 | 0 |
| 6394 | 1761 | 1615 | 6392 | 68.5 | GACCGCAACCTAGTGCATCG | 32 | 21 | 26 | 33 | 24 | 0 |
| 6395 | 1762 | 1616 | 40333 | 70.8 | GACCGGACTCTGTCCCGACC | 32 | 34 | 8 | 28 | 32 | 0 |
| 6396 | 1763 | 1617 | 21032 | 67.2 | GTGCAATCCTCAGTGCTCCC | 33 | 4 | 13 | 33 | 28 | 0 |
| 6397 | 1764 | 1618 | 30374 | 69.8 | GTGCCCATCGAAGCTTGGAC | 33 | 15 | 16 | 17 | 34 | 0 |
| 6398 | 1765 | 1619 | 15105 | 66.6 | GTGCGTCTATACTGCGCAGC | 33 | 19 | 5 | 29 | 31 | 0 |
| 6399 | 1766 | 1620 | 40334 | 69.8 | GTGCGAGTCCTATGCGGACC | 33 | 20 | 26 | 29 | 32 | 0 |
| 6400 | 1767 | 1621 | 6416 | 68.3 | GGACTCGTCTTGATCGTGCG | 34 | 10 | 11 | 24 | 29 | 0 |
| 6401 | 1768 | 1622 | 40335 | 67.3 | GGACCCATAATCCTTGTGCG | 34 | 15 | 4 | 11 | 29 | 0 |
| 6402 | 1769 | 1623 | 30377 | 75.6 | ACGGCTCAGTGCTGCGCCAT | 35 | 13 | 33 | 29 | 15 | 0 |
| 6403 | 1770 | 1624 | 30378 | 71.4 | ACGGGGTACTTGGGACGTGC | 35 | 18 | 11 | 34 | 33 | 0 |
| 6404 | 1771 | 1625 | 30379 | 70.7 | ACGGGATGTGATTCCCCGTT | 35 | 27 | 2 | 28 | 12 | 0 |
| 6405 | 1772 | 1626 | 6444 | 73.2 | ACGGGGACGTCTTCCCAGGA | 35 | 34 | 19 | 28 | 25 | 0 |
| 6406 | 1773 | 1627 | 15116 | 70.3 | AGCCCTTGATACCAGCGCAA | 36 | 11 | 5 | 31 | 21 | 0 |
| 6407 | 1774 | 1628 | 15118 | 70.4 | AGCCATCGAAAGCGTTCGAA | 36 | 24 | 6 | 12 | 16 | 0 |
| 6408 | 1775 | 1629 | 15120 | 74.1 | AGCGGACGTCTAGCCACGG | 36 | 34 | 19 | 36 | 35 | 0 |
| 6409 | 1776 | 1630 | 6461 | 71.6 | TTGACGAATGCGACGGTCGT | 1 | 16 | 29 | 35 | 10 | 0 |

FIG. 29LL

| SEQ ID NO: | ZIP ID# | 4,633 ID# | HEX ID# Tm | ZIPCODE (NH2 -> CONH2) | TETRAMER NUMBERS | | | | | "UNALLOWED DIMERS" |
|---|---|---|---|---|---|---|---|---|---|---|
| 6410 | 1777 | 1631 | 30380 69.9 | ACCTTGATTGCGTGCGGTCT | 23 | 2 | 29 | 29 | 19 | 0 |
| 6411 | 1778 | 1633 | 6493 69.5 | ACCTTCTGCTTGTGCGGCTT | 23 | 8 | 11 | 29 | 17 | 0 |
| 6412 | 1779 | 1634 | 40339 73.8 | TCTGTGCGCAGCGTCTTCCC | 8 | 29 | 31 | 19 | 28 | 0 |
| 6413 | 1780 | 1635 | 6505 72.3 | TGTCCCATGTGCCCATCACG | 9 | 15 | 33 | 15 | 30 | 0 |
| 6414 | 1781 | 1636 | 30382 71.5 | TCGTTCGTATCGTGCGAGCC | 10 | 10 | 24 | 29 | 36 | 0 |
| 6415 | 1782 | 1637 | 40340 71.3 | TCGTCGTTACGGCCATACGG | 10 | 12 | 35 | 15 | 35 | 0 |
| 6416 | 1783 | 1638 | 6521 68.1 | TCGTTCCCTTAGGATGTGCG | 10 | 28 | 3 | 27 | 29 | 0 |
| 6417 | 1784 | 1639 | 40341 76.1 | TCGTCAGCACGGTGCGCTCA | 10 | 31 | 35 | 29 | 13 | 0 |
| 6418 | 1785 | 1640 | 30383 71.3 | CTTGGCTTCCTATGCGTGCG | 11 | 17 | 26 | 29 | 29 | 0 |
| 6419 | 1786 | 1642 | 6539 71.5 | CGTTCTTGCCATACGGCGAA | 12 | 11 | 15 | 35 | 16 | 0 |
| 6420 | 1787 | 1643 | 6540 68.3 | CGTTCCATAGCCCTGTGTGC | 12 | 15 | 36 | 14 | 33 | 0 |
| 6421 | 1788 | 1644 | 6549 71.7 | CCATCACGGCTTGAGTTGCG | 15 | 30 | 17 | 20 | 29 | 0 |
| 6422 | 1789 | 1645 | 6551 71.2 | CCATACGGGATGCACGCCTA | 15 | 35 | 27 | 30 | 26 | 0 |
| 6423 | 1790 | 1646 | 30384 70 | CGAACGTTAGCCCAGCGAGT | 16 | 12 | 36 | 31 | 20 | 0 |
| 6424 | 1791 | 1648 | 6558 72.1 | CGAAGGTATGCGCTCATGCG | 16 | 18 | 29 | 13 | 29 | 0 |
| 6425 | 1792 | 1649 | 6569 69.3 | ACCTGCTTCTTGTCCCCACG | 23 | 17 | 11 | 28 | 30 | 1 |
| 6426 | 1793 | 1651 | 6575 70.2 | ACCTGCTTTGCGGAGTCGAA | 23 | 17 | 29 | 20 | 16 | 0 |
| 6427 | 1794 | 1652 | 40344 74.4 | GCTTCAGCCTTGCACGTGCG | 17 | 31 | 11 | 30 | 29 | 0 |
| 6428 | 1795 | 1653 | 6589 73.5 | GCAATGATGCAATGCGTGCG | 21 | 2 | 21 | 29 | 29 | 0 |
| 6429 | 1796 | 1654 | 21067 67.7 | GCAAGAGTCTTGGTGCAGCC | 21 | 20 | 11 | 33 | 36 | 0 |
| 6430 | 1797 | 1656 | 6602 70.4 | AGTGCCATTCTGCAGCGCTT | 22 | 15 | 8 | 31 | 17 | 0 |
| 6431 | 1798 | 1657 | 6638 71.7 | TCCCAATCGATGGTGCATCG | 28 | 4 | 27 | 33 | 24 | 0 |
| 6432 | 1799 | 1658 | 40349 71.1 | TCCCAAAGTGATTGCGGTGC | 28 | 6 | 2 | 29 | 33 | 0 |
| 6433 | 1800 | 1659 | 30387 69.8 | TCCCCTGTCAGCGAGTTCGT | 28 | 14 | 31 | 20 | 10 | 0 |
| 6434 | 1801 | 1660 | 30388 70.7 | TCCCACCTCGAACACGCCTA | 28 | 23 | 16 | 30 | 26 | 0 |
| 6435 | 1802 | 1661 | 15180 71.2 | TCCCATCGTCGTCACGTCGT | 28 | 24 | 10 | 30 | 10 | 0 |
| 6436 | 1803 | 1662 | 21077 70.5 | ACCTTCCCCCTAAGCCTCCC | 23 | 28 | 26 | 36 | 28 | 1 |
| 6437 | 1804 | 1663 | 6652 73.3 | TCCCACGGCTCAGATGACGG | 28 | 35 | 13 | 27 | 35 | 0 |
| 6438 | 1805 | 1664 | 30389 70.1 | TGCGTTGATGATTGCGTCGT | 29 | 1 | 2 | 29 | 10 | 0 |
| 6439 | 1806 | 1665 | 6665 71.3 | TGCGCGAAAAAGTCGTCGTT | 29 | 16 | 6 | 10 | 12 | 0 |
| 6440 | 1807 | 1666 | 6666 72.2 | TGCGGCTTGCTTTCGTCTCA | 29 | 17 | 17 | 10 | 13 | 0 |
| 6441 | 1808 | 1667 | 6671 75.1 | TGCGACGGCAGCACCTCTCA | 29 | 35 | 31 | 23 | 13 | 0 |
| 6442 | 1809 | 1668 | 6672 73 | CACGAAAGTCCCAGCCACGG | 30 | 6 | 28 | 36 | 35 | 1 |
| 6443 | 1810 | 1669 | 15189 71 | ACCTCACGGTCTTCCCCGAA | 23 | 30 | 19 | 28 | 16 | 0 |
| 6444 | 1811 | 1670 | 6678 69.2 | CACGGAGTCTGTACGGTGCG | 30 | 20 | 14 | 35 | 29 | 0 |
| 6445 | 1812 | 1671 | 15190 73.2 | CACGTCCCCCATACGGCTCA | 30 | 28 | 15 | 35 | 13 | 0 |
| 6446 | 1813 | 1672 | 40354 69.4 | GACCCGAACTGTGGACCAGC | 32 | 16 | 14 | 34 | 31 | 0 |
| 6447 | 1814 | 1673 | 30390 69.7 | ACCTGACCCACGAAAGGCAA | 23 | 32 | 30 | 6 | 21 | 0 |
| 6448 | 1815 | 1674 | 21097 70.8 | ACCTGACCACGGTTGATGCG | 23 | 32 | 35 | 1 | 29 | 1 |
| 6449 | 1816 | 1676 | 6711 68.3 | GTGCCTCAGCAAGATGACGG | 33 | 13 | 21 | 27 | 35 | 0 |
| 6450 | 1817 | 1677 | 30391 73.1 | GTGCGAGTCGAAACGGGTGC | 33 | 20 | 16 | 35 | 33 | 0 |
| 6451 | 1818 | 1678 | 15203 71.8 | GTGCACCTCAGCGATGCAGC | 33 | 23 | 31 | 27 | 31 | 0 |
| 6452 | 1819 | 1679 | 15205 72.2 | ACCTGTGCAGGATCCCACGG | 23 | 33 | 25 | 28 | 35 | 0 |
| 6453 | 1820 | 1680 | 30392 70.4 | GTGCCCTACACGGGACATCG | 33 | 26 | 30 | 34 | 24 | 0 |
| 6454 | 1821 | 1681 | 15207 69.6 | GGACCTTGTGCGAATCGCTT | 34 | 11 | 29 | 4 | 17 | 0 |
| 6455 | 1822 | 1682 | 15212 70.5 | ACCTGGACGATGTGCGCTGT | 23 | 34 | 27 | 29 | 14 | 0 |
| 6456 | 1823 | 1683 | 15213 69.7 | GGACTCCCTCGTCAGCGATG | 34 | 28 | 10 | 31 | 27 | 0 |
| 6457 | 1824 | 1684 | 30393 72 | GGACAGCCAATCCACGAGCC | 34 | 36 | 4 | 30 | 36 | 0 |

FIG. 29MM

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 6458 | 1825 | 1685 | 6736 | 71.4 | ACGGTTGACGAAGCAATGCG | 35 | 1 | 16 | 21 29 | 1 |
| 6459 | 1826 | 1686 | 30394 | 70.4 | ACGGCGTTCGAAGCTTGGTA | 35 | 12 | 16 | 17 18 | 0 |
| 6460 | 1827 | 1687 | 6766 | 74.3 | TTGACGAAAGCCAGCCGCAA | 1 | 16 | 36 | 36 21 | 0 |
| 6461 | 1828 | 1688 | 6770 | 71 | TTGAAGGATGCGGACCATCG | 1 | 25 | 29 | 32 24 | 0 |
| 6462 | 1829 | 1689 | 30398 | 69.5 | TTGAACGGTGCGTCTGGATG | 1 | 35 | 29 | 8 27 | 0 |
| 6463 | 1830 | 1690 | 6773 | 75.7 | TGATCACGGTGCACGGCGAA | 2 | 30 | 33 | 35 16 | 0 |
| 6464 | 1831 | 1691 | 6779 | 69 | TTAGGTGCACCTTGCGCCTA | 3 | 33 | 23 | 29 26 | 0 |
| 6465 | 1832 | 1692 | 30399 | 70.4 | ATCGAATCCGTTACGGTGCG | 24 | 4 | 12 | 35 29 | 0 |
| 6466 | 1833 | 1693 | 6781 | 67.9 | AATCCTCAATCGGCAACACG | 4 | 13 | 24 | 21 30 | 0 |
| 6467 | 1834 | 1694 | 6783 | 72.3 | AATCATCGGGACAGCCACGG | 4 | 24 | 34 | 36 35 | 0 |
| 6468 | 1835 | 1695 | 40358 | 72.4 | AATCGACCTGCGTCCCATCG | 4 | 32 | 29 | 28 24 | 0 |
| 6469 | 1836 | 1696 | 6789 | 69.2 | AATCGGACCTTGATCGGTGC | 4 | 34 | 11 | 24 33 | 0 |
| 6470 | 1837 | 1697 | 6793 | 68.2 | ATCGATACGCTTTGCGCTGT | 24 | 5 | 17 | 29 14 | 0 |
| 6471 | 1838 | 1698 | 6796 | 73 | ATACCAGCCCATTGCGGCAA | 5 | 31 | 15 | 29 21 | 0 |
| 6472 | 1839 | 1699 | 6797 | 68.5 | ATACACGGTTGAACGGCGAA | 5 | 35 | 1 | 35 16 | 1 |
| 6473 | 1840 | 1701 | 40360 | 72.1 | TCTGCCATGCTTCACGACGG | 8 | 15 | 17 | 30 35 | 0 |
| 6474 | 1841 | 1702 | 6814 | 70.6 | TCTGCCTAAGCCGATGACGG | 8 | 26 | 36 | 27 35 | 0 |
| 6475 | 1842 | 1703 | 6815 | 72.7 | TCTGCAGCGGACAGTGGCAA | 8 | 31 | 34 | 22 21 | 0 |
| 6476 | 1843 | 1704 | 6820 | 70.3 | TGTCCCATTCGTGCAACACG | 9 | 15 | 10 | 21 30 | 0 |
| 6477 | 1844 | 1705 | 21109 | 76.2 | TGTCGTGCGATGACGGTGCG | 9 | 33 | 27 | 35 29 | 0 |
| 6478 | 1845 | 1706 | 6828 | 72.4 | TCGTTTGACACGGGACGCAA | 10 | 1 | 30 | 34 21 | 0 |
| 6479 | 1846 | 1707 | 6837 | 72.4 | TCGTGATGGGACGCTTTCCC | 10 | 27 | 34 | 17 28 | 0 |
| 6480 | 1847 | 1708 | 21110 | 68.3 | TCGTGTGCTTGACTGTTGCG | 10 | 33 | 1 | 14 29 | 0 |
| 6481 | 1848 | 1709 | 6841 | 71.3 | TCGTAGCCCAGCTCTGCGAA | 10 | 36 | 31 | 8 16 | 0 |
| 6482 | 1849 | 1711 | 15250 | 71.5 | ATCGCTTGCTTGCGAAGCAA | 24 | 11 | 11 | 16 21 | 0 |
| 6483 | 1850 | 1713 | 30401 | 70.5 | ATCGCTTGGGTATCGTTGCG | 24 | 11 | 18 | 10 29 | 0 |
| 6484 | 1851 | 1714 | 30402 | 67 | ATCGCTTGACCTTGTCGCTT | 24 | 11 | 23 | 9 17 | 0 |
| 6485 | 1852 | 1715 | 40364 | 65.4 | CTTGCCTATGATCAGCAGCC | 11 | 26 | 2 | 31 36 | 0 |
| 6486 | 1853 | 1716 | 15254 | 71.8 | ATCGCTTGCACGGAGTTCCC | 24 | 11 | 30 | 20 28 | 0 |
| 6487 | 1854 | 1717 | 30403 | 65.9 | CGTTTGATACGGTCTGGTGC | 12 | 2 | 35 | 8 33 | 0 |
| 6488 | 1855 | 1718 | 30404 | 66.9 | CGTTTTAGGCTTAGCCGCTT | 12 | 3 | 17 | 36 17 | 0 |
| 6489 | 1856 | 1719 | 6860 | 67.3 | ATCGCGTTAAAGCACGGTCT | 24 | 12 | 6 | 30 19 | 0 |
| 6490 | 1857 | 1720 | 6865 | 69 | ATCGCGTTCTTGGGTAAGCC | 24 | 12 | 11 | 18 36 | 0 |
| 6491 | 1858 | 1721 | 30405 | 71.5 | ATCGCGTTCGTTCAGCATCG | 24 | 12 | 12 | 31 24 | 0 |
| 6492 | 1859 | 1722 | 30406 | 72.2 | ATCGCGTTCTGTTCCCCGAA | 24 | 12 | 14 | 28 16 | 0 |
| 6493 | 1860 | 1723 | 40366 | 67.9 | ATCGCGTTGGTATGTCCAGC | 24 | 12 | 18 | 9 31 | 0 |
| 6494 | 1861 | 1725 | 6871 | 66.9 | CGTTAGTGTCTGACGGCACG | 12 | 22 | 8 | 35 30 | 0 |
| 6495 | 1862 | 1726 | 6873 | 66.7 | CGTTATCGGCTTAGTGCACG | 12 | 24 | 17 | 22 30 | 0 |
| 6496 | 1863 | 1727 | 6874 | 65.1 | CGTTGATGTACACCATTGCG | 12 | 27 | 7 | 15 29 | 0 |
| 6497 | 1864 | 1728 | 6877 | 67.3 | ATCGCGTTGGACTACAAGCC | 24 | 12 | 34 | 7 36 | 0 |
| 6498 | 1865 | 1729 | 6880 | 67.9 | CTCATGATACGGTCCCCACG | 13 | 2 | 35 | 28 30 | 1 |
| 6499 | 1866 | 1731 | 30407 | 70.1 | ATCGCTCACGTTTGCGACCT | 24 | 13 | 12 | 29 23 | 0 |
| 6500 | 1867 | 1732 | 6886 | 68.5 | CTCAGATGGCAAGACCTGCG | 13 | 27 | 21 | 32 29 | 0 |
| 6501 | 1868 | 1733 | 6894 | 70.9 | CTGTTGATTCCCAGCCTGCG | 14 | 2 | 28 | 36 29 | 0 |
| 6502 | 1869 | 1734 | 6895 | 72.1 | ATCGCTGTTGTCCACGCACG | 24 | 14 | 9 | 30 30 | 0 |
| 6503 | 1870 | 1735 | 6896 | 72.1 | CTGTCTTGCCATTGCGCAGC | 14 | 11 | 15 | 29 31 | 0 |
| 6504 | 1871 | 1736 | 15268 | 69.7 | ATCGCTGTGCAATGCGTGTC | 24 | 14 | 21 | 29 9 | 0 |
| 6505 | 1872 | 1738 | 15270 | 71.1 | ATCGCTGTTGCGCGTTTGAT | 24 | 14 | 29 | 12 2 | 0 |

FIG. 29NN

| SEQ ID NO: | ZIP ID# | 4,633 ID# | HEX ID# Tm | ZIPCODE (NH2 -> CONH2) | TETRAMER NUMBERS | | | | "UNALLOWED DIMERS" |
|---|---|---|---|---|---|---|---|---|---|
| 6506 | 1873 | 1739 | 30408 69 | ATCGCTGTCACGAATCTGCG | 24 | 14 | 30 | 4 | 29 | 0 |
| 6507 | 1874 | 1740 | 30409 71.4 | CTGTGACCGACCCTCATGCG | 14 | 32 | 32 | 13 | 29 | 0 |
| 6508 | 1875 | 1741 | 30410 68.2 | ATCGCCATTTGATGCGTGAT | 24 | 15 | 1 | 29 | 2 | 0 |
| 6509 | 1876 | 1742 | 15272 66.6 | CCATTGATCGAACTTGCGAA | 15 | 2 | 16 | 11 | 16 | 0 |
| 6510 | 1877 | 1744 | 30411 66.9 | ATCGCCATTCGTAATCCGTT | 24 | 15 | 10 | 4 | 12 | 0 |
| 6511 | 1878 | 1745 | 30412 65.2 | ATCGCCATCTTGAAAGCTTG | 24 | 15 | 11 | 6 | 11 | 0 |
| 6512 | 1879 | 1746 | 30413 68.5 | ATCGCCATCTCACTTGCAA | 24 | 15 | 13 | 11 | 16 | 0 |
| 6513 | 1880 | 1747 | 6918 68.8 | ATCGCCATGCTTCTGTGTGC | 24 | 15 | 17 | 14 | 33 | 0 |
| 6514 | 1881 | 1748 | 30414 70.6 | ATCGCCATAGGAAGCCCGTT | 24 | 15 | 25 | 36 | 12 | 0 |
| 6515 | 1882 | 1749 | 40369 68.7 | ATCGCCATCCTAAGGAACGG | 24 | 15 | 26 | 25 | 35 | 0 |
| 6516 | 1883 | 1750 | 30415 68.7 | ATCGCCATGTGCTTAGGCAA | 24 | 15 | 33 | 3 | 21 | 0 |
| 6517 | 1884 | 1751 | 6929 67.4 | CGAAATACCTCATCCCACGG | 16 | 5 | 13 | 28 | 35 | 0 |
| 6518 | 1885 | 1752 | 6932 71.5 | ATCGCGAATCTGCTCATGCG | 24 | 16 | 8 | 13 | 29 | 0 |
| 6519 | 1886 | 1753 | 21122 66.2 | CGAATCGTGGTAAATCGTGC | 16 | 10 | 18 | 4 | 33 | 0 |
| 6520 | 1887 | 1754 | 40370 69.1 | ATCGCGAACTGTCTTGCACG | 24 | 16 | 14 | 11 | 30 | 0 |
| 6521 | 1888 | 1755 | 6936 64.4 | CGAAGGTATTGAGACCAGCC | 16 | 18 | 1 | 32 | 36 | 0 |
| 6522 | 1889 | 1756 | 6937 68.1 | ATCGCGAAGTCTCGAAGCAA | 24 | 16 | 19 | 16 | 21 | 0 |
| 6523 | 1890 | 1757 | 30416 67.5 | ATCGCGAAACCTCCATGGTA | 24 | 16 | 23 | 15 | 18 | 0 |
| 6524 | 1891 | 1758 | 15285 67.1 | ATCGCGAACCTACAGCTCGT | 24 | 16 | 26 | 31 | 10 | 0 |
| 6525 | 1892 | 1759 | 6943 75 | ATCGCGAATGCGTGTCGCAA | 24 | 16 | 29 | 9 | 21 | 0 |
| 6526 | 1893 | 1760 | 30417 68.2 | CGAAGACCATACCACGACGG | 16 | 32 | 5 | 30 | 35 | 0 |
| 6527 | 1894 | 1761 | 21125 68.5 | GCTTTTAGCCATCAGCTGCG | 17 | 3 | 15 | 31 | 29 | 0 |
| 6528 | 1895 | 1762 | 6947 65.9 | GCTTTACACCATGTGCGGAC | 17 | 7 | 15 | 33 | 34 | 0 |
| 6529 | 1896 | 1763 | 40373 65.2 | GCTTTCTGTTGACAGCGACC | 17 | 8 | 1 | 31 | 32 | 0 |
| 6530 | 1897 | 1764 | 6950 68.9 | ATCGGCTTCGTTGACCACCT | 24 | 17 | 12 | 32 | 23 | 0 |
| 6531 | 1898 | 1765 | 30418 66.7 | GCTTCTGTATCGGACCCAGC | 17 | 14 | 24 | 32 | 31 | 0 |
| 6532 | 1899 | 1767 | 6958 67.9 | ATCGGCTTGTGCTTAGCAGC | 24 | 17 | 33 | 3 | 31 | 0 |
| 6533 | 1900 | 1768 | 40375 65 | GGTACGTTAGGACACGCGTT | 18 | 12 | 25 | 30 | 12 | 0 |
| 6534 | 1901 | 1769 | 15292 65.4 | GGTAGCAAGTCTCAGCGTGC | 18 | 21 | 19 | 31 | 33 | 0 |
| 6535 | 1902 | 1770 | 6968 66.8 | ATCGGGTAAGGAACCTGCAA | 24 | 18 | 25 | 23 | 21 | 0 |
| 6536 | 1903 | 1771 | 15294 67.5 | ATCGGGTATCCCAGGACCAT | 24 | 18 | 28 | 25 | 15 | 0 |
| 6537 | 1904 | 1772 | 6974 65.3 | ATCGGGTAACGGTACAGCAA | 24 | 18 | 35 | 7 | 21 | 0 |
| 6538 | 1905 | 1773 | 30421 66.5 | ATCGGGTAAGCCTGATACGG | 24 | 18 | 36 | 2 | 35 | 0 |
| 6539 | 1906 | 1774 | 15298 67.8 | ATCGGTCTCGAAAATCGCAA | 24 | 19 | 16 | 4 | 21 | 0 |
| 6540 | 1907 | 1775 | 40376 67.2 | ATCGGTCTGCTTAGCCGGTA | 24 | 19 | 17 | 36 | 18 | 0 |
| 6541 | 1908 | 1776 | 6981 69.8 | GTCTATCGCACGGGACCAGC | 19 | 24 | 30 | 34 | 31 | 0 |
| 6542 | 1909 | 1777 | 6986 69.1 | ATCGGTCTACGGCCATGGAC | 24 | 19 | 35 | 15 | 34 | 0 |
| 6543 | 1910 | 1778 | 40377 67.5 | GAGTGCAAGCTTGACCGGAC | 20 | 21 | 17 | 32 | 34 | 0 |
| 6544 | 1911 | 1779 | 6990 69.6 | GAGTATCGCTTGCAGCGCAA | 20 | 24 | 11 | 31 | 21 | 0 |
| 6545 | 1912 | 1780 | 6992 65.5 | GAGTCAGCTTAGACGGCACG | 20 | 31 | 3 | 35 | 30 | 0 |
| 6546 | 1913 | 1782 | 40378 69.8 | ATCGGCAATGATTGCGACCT | 24 | 21 | 2 | 29 | 23 | 0 |
| 6547 | 1914 | 1783 | 15303 66.4 | ATCGGCAATACAAATCGCAA | 24 | 21 | 7 | 4 | 21 | 0 |
| 6548 | 1915 | 1784 | 30422 68.3 | GCAATGTCTCCCTCTGCACG | 21 | 9 | 28 | 8 | 30 | 0 |
| 6549 | 1916 | 1785 | 40379 67.5 | GCAACTCAAAAGGGACCACG | 21 | 13 | 6 | 34 | 30 | 0 |
| 6550 | 1917 | 1786 | 40380 65.7 | GCAACCATACCTTCTGGCAA | 21 | 15 | 23 | 8 | 21 | 0 |
| 6551 | 1918 | 1787 | 40381 65.9 | GCAAGCTTTTAGATCGCGAA | 21 | 17 | 3 | 24 | 16 | 0 |
| 6552 | 1919 | 1788 | 40382 66.2 | ATCGGCAAGAGTAGCCGTCT | 24 | 21 | 20 | 36 | 19 | 0 |
| 6553 | 1920 | 1789 | 15309 66.9 | GCAAGCAATCGTAGTGGCAA | 21 | 21 | 10 | 22 | 21 | 0 |

FIG. 29OO

| SEQ ID NO: | ZIP ID# | 4,633 ID# | HEX ID# Tm | ZIPCODE (NH2 -> CONH2) | TETRAMER NUMBERS | | | | | "UNALLOWED DIMERS" |
|---|---|---|---|---|---|---|---|---|---|---|
| 6554 | 1921 | 1790 | 7008 68.2 | ATCGGCAAAGTGCTTGATCG | 24 | 21 | 22 | 11 | 24 | 0 |
| 6555 | 1922 | 1791 | 30423 69.5 | ATCGGCAAAGGAAGTGGTGC | 24 | 21 | 25 | 22 | 33 | 0 |
| 6556 | 1923 | 1792 | 7013 68.4 | ATCGGCAACAGCAGTGCTGT | 24 | 21 | 31 | 22 | 14 | 0 |
| 6557 | 1924 | 1793 | 7015 67.5 | ATCGGCAAGGACTGTCGGTA | 24 | 21 | 34 | 9 | 18 | 0 |
| 6558 | 1925 | 1795 | 7019 68.4 | AGTGCGAATGATGGACCACG | 22 | 16 | 2 | 34 | 30 | 0 |
| 6559 | 1926 | 1796 | 7022 68.7 | ATCGAGTGCCTATGCGCTCA | 24 | 22 | 26 | 29 | 13 | 0 |
| 6560 | 1927 | 1797 | 30424 69.5 | AGTGGTGCTTGAACGGAGCC | 22 | 33 | 1 | 35 | 36 | 0 |
| 6561 | 1928 | 1798 | 7026 71.4 | ACCTGGTAACGGCACGGACC | 23 | 18 | 35 | 30 | 32 | 0 |
| 6562 | 1929 | 1799 | 7027 67 | ACCTGCAATCTGAGGAACGG | 23 | 21 | 8 | 25 | 35 | 0 |
| 6563 | 1930 | 1800 | 7032 73.2 | ATCGACCTGGACCACGTGCG | 24 | 23 | 34 | 30 | 29 | 0 |
| 6564 | 1931 | 1801 | 30425 71.2 | ATCGCTGTATCGCAGCCGAA | 24 | 14 | 24 | 31 | 16 | 0 |
| 6565 | 1932 | 1802 | 30426 67.6 | ATCGGCTTAGGAGACCCGTT | 24 | 17 | 25 | 32 | 12 | 0 |
| 6566 | 1933 | 1803 | 15317 70.8 | ATCGATCGAGGAAGCCGGAC | 24 | 24 | 25 | 36 | 34 | 0 |
| 6567 | 1934 | 1804 | 30427 72.5 | ATCGGTGCCGTTTGTCAGCC | 24 | 33 | 12 | 9 | 36 | 0 |
| 6568 | 1935 | 1805 | 21139 69 | AGGAACCTGCTTAGCCCACG | 25 | 23 | 17 | 36 | 30 | 0 |
| 6569 | 1936 | 1806 | 7049 70.7 | AGGAATCGGTGCCTGTGCAA | 25 | 24 | 33 | 14 | 21 | 0 |
| 6570 | 1937 | 1807 | 7056 67.5 | ATCGCCTATGATACGGCAGC | 24 | 26 | 2 | 35 | 31 | 0 |
| 6571 | 1938 | 1808 | 15323 67.5 | CCTAAAAGCTCAAGCCACGG | 26 | 6 | 13 | 36 | 35 | 0 |
| 6572 | 1939 | 1809 | 7059 70.3 | ATCGCCTATGTCCCATTGCG | 24 | 26 | 9 | 15 | 29 | 0 |
| 6573 | 1940 | 1810 | 30428 66.8 | ATCGCCTACGTTTCGTCCAT | 24 | 26 | 12 | 10 | 15 | 0 |
| 6574 | 1941 | 1811 | 30429 68.6 | ATCGCCTAGCTTTCCCCTCA | 24 | 26 | 17 | 28 | 13 | 0 |
| 6575 | 1942 | 1812 | 30430 65.5 | CCTAAGGAATACACGGCACG | 26 | 25 | 5 | 35 | 30 | 0 |
| 6576 | 1943 | 1814 | 21141 69.2 | ATCGCCTATGCGGGTATCGT | 24 | 26 | 29 | 18 | 10 | 0 |
| 6577 | 1944 | 1815 | 15327 69.4 | ATCGCCTACACGGCTTCGTT | 24 | 26 | 30 | 17 | 12 | 0 |
| 6578 | 1945 | 1816 | 7073 68.8 | GATGTTGAGCAAAGCCTGCG | 27 | 1 | 21 | 36 | 29 | 0 |
| 6579 | 1946 | 1817 | 40389 70.2 | GATGTCGTGGACGACCAGCC | 27 | 10 | 34 | 32 | 36 | 0 |
| 6580 | 1947 | 1818 | 30432 67 | GATGCTCAACGGAATCCGTT | 27 | 13 | 35 | 4 | 12 | 0 |
| 6581 | 1948 | 1819 | 15330 67.9 | ATCGGATGCTGTCGTTACGG | 24 | 27 | 14 | 12 | 35 | 0 |
| 6582 | 1949 | 1820 | 15331 70.4 | GATGGTCTGTGCCAGCGGAC | 27 | 19 | 33 | 31 | 34 | 0 |
| 6583 | 1950 | 1821 | 40390 69.1 | ATCGGATGATCGAGGAACGG | 24 | 27 | 24 | 25 | 35 | 0 |
| 6584 | 1951 | 1822 | 30433 66.6 | GATGCCTAGTCTTCCCCACG | 27 | 26 | 19 | 28 | 30 | 0 |
| 6585 | 1952 | 1823 | 7082 70.3 | GATGTGCGCTTGTGATTGCG | 27 | 29 | 11 | 2 | 29 | 0 |
| 6586 | 1953 | 1824 | 30434 72.4 | ATCGGATGCACGCTTGGCTT | 24 | 27 | 30 | 11 | 17 | 0 |
| 6587 | 1954 | 1825 | 7083 68.5 | ATCGGATGCAGCTTAGTGCG | 24 | 27 | 31 | 3 | 29 | 0 |
| 6578 | 1955 | 1826 | 30435 68.5 | ATCGGATGGGACAGCCTGAT | 24 | 27 | 34 | 36 | 2 | 0 |
| 6589 | 1956 | 1827 | 40391 71.4 | ATCGGATGACGGCTTGTCCC | 24 | 27 | 35 | 11 | 28 | 1 |
| 6590 | 1957 | 1828 | 15335 76.6 | TCCCTGTCCGAATGCGCACG | 28 | 9 | 16 | 29 | 30 | 0 |
| 6591 | 1958 | 1829 | 30437 69.6 | TCCCAGGATCGTGCTTAGCC | 28 | 25 | 10 | 17 | 36 | 0 |
| 6592 | 1959 | 1830 | 30438 71.6 | TCCCGATGCCTACGTTTCCC | 28 | 27 | 26 | 12 | 28 | 1 |
| 6593 | 1960 | 1832 | 40393 68.9 | TGCGTTGATGTCCGTTAGCC | 29 | 1 | 9 | 12 | 36 | 0 |
| 6594 | 1961 | 1833 | 15343 71.3 | TGCGTTAGTCCCTCCCCGTT | 29 | 3 | 28 | 28 | 12 | 0 |
| 6595 | 1962 | 1834 | 7108 74.8 | ATCGTGCGCTTGCTTGCACG | 24 | 29 | 11 | 11 | 30 | 0 |
| 6596 | 1963 | 1835 | 7109 70.1 | ATCGTGCGCTCATGTCTCCC | 24 | 29 | 13 | 9 | 28 | 0 |
| 6597 | 1964 | 1836 | 30439 71.6 | TGCGCCATCCTAGCAAATCG | 29 | 15 | 26 | 21 | 24 | 0 |
| 6598 | 1965 | 1837 | 7110 70.4 | TGCGGCTTCCATAATCGACC | 29 | 17 | 15 | 4 | 32 | 0 |
| 6599 | 1966 | 1838 | 15345 71.3 | TGCGGAGTGCTTTCGTGACC | 29 | 20 | 17 | 10 | 32 | 0 |
| 6600 | 1967 | 1839 | 7116 73.2 | TGCGTCCCCAGCAAAGAGGA | 29 | 28 | 31 | 6 | 25 | 0 |
| 6601 | 1968 | 1840 | 7117 71.9 | TGCGCACGTACAAGCCACCT | 29 | 30 | 7 | 36 | 23 | 0 |

FIG. 29PP

| SEQ ID NO: | ZIP ID# | 4,633 ID# | HEX ID# Tm | ZIPCODE (NH2 -> CONH2) | TETRAMER NUMBERS | | | | | "UNALLOWED DIMERS" |
|---|---|---|---|---|---|---|---|---|---|---|
| 6602 | 1969 | 1841 | 7119 73.8 | TGCGGTGCGGTACCATTCGT | 29 | 33 | 18 | 15 | 10 | 0 |
| 6603 | 1970 | 1842 | 30440 71.6 | ATCGCACGAAAGGACCGCTT | 24 | 30 | 6 | 32 | 17 | 0 |
| 6604 | 1971 | 1843 | 30441 70.8 | CACGCTTGGTCTACGGACGG | 30 | 11 | 19 | 35 | 35 | 0 |
| 6605 | 1972 | 1844 | 7127 70.3 | ATCGCACGCGAAGAGTCGTT | 24 | 30 | 16 | 20 | 12 | 0 |
| 6606 | 1973 | 1845 | 40394 70.6 | ATCGCACGGCTTACCTCACG | 24 | 30 | 17 | 23 | 30 | 0 |
| 6607 | 1974 | 1846 | 21150 66.8 | CACGAGTGTTAGTGCGCGTT | 30 | 22 | 3 | 29 | 12 | 0 |
| 6608 | 1975 | 1847 | 40395 70.8 | ATCGCACGACCTGCAAAGGA | 24 | 30 | 23 | 21 | 25 | 0 |
| 6609 | 1976 | 1848 | 7133 72.9 | ATCGCACGTCCCCTCACGAA | 24 | 30 | 28 | 13 | 16 | 0 |
| 6610 | 1977 | 1849 | 7134 74.7 | ATCGCACGTGCGCTCAGTGC | 24 | 30 | 29 | 13 | 33 | 0 |
| 6611 | 1978 | 1850 | 7137 75 | ATCGCACGACGGCTGTGCAA | 24 | 30 | 35 | 14 | 21 | 0 |
| 6612 | 1979 | 1851 | 7138 70.3 | ATCGCACGAGCCATACGACC | 24 | 30 | 36 | 5 | 32 | 0 |
| 6613 | 1980 | 1852 | 7141 68.6 | ATCGCAGCTTAGCGAAGCAA | 24 | 31 | 3 | 16 | 21 | 0 |
| 6614 | 1981 | 1853 | 15350 66.1 | CAGCTCTGTTGAGGACTGCG | 31 | 8 | 1 | 34 | 29 | 0 |
| 6615 | 1982 | 1854 | 7146 71 | CAGCTGTCGAGTGTGCGCAA | 31 | 9 | 20 | 33 | 21 | 0 |
| 6616 | 1983 | 1855 | 30443 67.8 | CAGCTCGTCCTACAGCGGAC | 31 | 10 | 26 | 31 | 34 | 0 |
| 6617 | 1984 | 1856 | 30444 69.5 | ATCGCAGCGTCTCTTGGGAC | 24 | 31 | 19 | 11 | 34 | 0 |
| 6618 | 1985 | 1857 | 40397 68.3 | ATCGCAGCAGTGTGTCCGTT | 24 | 31 | 22 | 9 | 12 | 0 |
| 6619 | 1986 | 1858 | 7153 69 | ATCGCAGCATCGATACGTGC | 24 | 31 | 24 | 5 | 33 | 0 |
| 6620 | 1987 | 1859 | 7155 71.5 | ATCGCAGCGGACATACTGCG | 24 | 31 | 34 | 5 | 29 | 0 |
| 6621 | 1988 | 1860 | 7156 74.2 | ATCGCAGCACGGCTCACGAA | 24 | 31 | 35 | 13 | 16 | 0 |
| 6622 | 1989 | 1861 | 7159 68.5 | ATCGGACCTACAAGCCGACC | 24 | 32 | 7 | 36 | 32 | 0 |
| 6623 | 1990 | 1862 | 30446 69.4 | GACCCGTTCCATTCTGGTGC | 32 | 12 | 15 | 8 | 33 | 0 |
| 6624 | 1991 | 1863 | 7166 69 | GACCGCAAGATGTGTCGTGC | 32 | 21 | 27 | 9 | 33 | 0 |
| 6625 | 1992 | 1864 | 30447 68.8 | ATCGGACCATCGAGTGGCTT | 24 | 32 | 24 | 22 | 17 | 0 |
| 6626 | 1993 | 1865 | 7171 67.5 | ATCGGACCTGCGTGTCAATC | 24 | 32 | 29 | 9 | 4 | 0 |
| 6627 | 1994 | 1866 | 21160 68.7 | ATCGGACCGGACTTGACGTT | 24 | 32 | 34 | 1 | 12 | 0 |
| 6628 | 1995 | 1867 | 15358 71.8 | ATCGGACCACGGCCATAGGA | 24 | 32 | 35 | 15 | 25 | 0 |
| 6629 | 1996 | 1868 | 40399 66.3 | GTGCTTGATGATCAGCCGAA | 33 | 1 | 2 | 31 | 16 | 0 |
| 6630 | 1997 | 1869 | 40400 68.7 | GTGCTGTCACCTACGGGCAA | 33 | 9 | 23 | 35 | 21 | 0 |
| 6631 | 1998 | 1870 | 15361 67.5 | ATCGGTGCCTCACGAACCTA | 24 | 33 | 13 | 16 | 26 | 0 |
| 6632 | 1999 | 1871 | 7181 66.8 | ATCGGTGCGGTAGTCTGACC | 24 | 33 | 18 | 19 | 32 | 0 |
| 6633 | 2000 | 1872 | 7185 68.5 | ATCGGTGCGATGTTAGGCAA | 24 | 33 | 27 | 3 | 21 | 0 |
| 6634 | 2001 | 1873 | 30449 73.6 | GTGCCACGCTGTGGACGCTT | 33 | 30 | 14 | 34 | 17 | 0 |
| 6635 | 2002 | 1874 | 21166 74.3 | ATCGGTGCGGACAGTGCACG | 24 | 33 | 34 | 22 | 30 | 0 |
| 6636 | 2003 | 1875 | 7188 72.2 | ATCGGTGCAGCCGAGTCGTT | 24 | 33 | 36 | 20 | 12 | 0 |
| 6637 | 2004 | 1876 | 40402 68.9 | ATCGGGACAAAGACGGCTGT | 24 | 34 | 6 | 35 | 14 | 0 |
| 6638 | 2005 | 1878 | 7193 69.6 | ATCGGGACCGTTCCTATCCC | 24 | 34 | 12 | 26 | 28 | 0 |
| 6639 | 2006 | 1879 | 15366 68.5 | ATCGGGACCGAAGAGTACGG | 24 | 34 | 16 | 20 | 35 | 0 |
| 6640 | 2007 | 1880 | 7197 69.7 | ATCGGGACGCTTGATGTCGT | 24 | 34 | 17 | 27 | 10 | 0 |
| 6641 | 2008 | 1881 | 30450 64.8 | GGACGGTAGGTAAAAGCACG | 34 | 18 | 18 | 6 | 30 | 0 |
| 6642 | 2009 | 1882 | 40404 66.5 | GGACGAGTAAAGTCCCCACG | 34 | 20 | 6 | 28 | 30 | 1 |
| 6643 | 2010 | 1883 | 40405 68 | GGACACCTGGTATCCCCGTT | 34 | 23 | 18 | 28 | 12 | 0 |
| 6644 | 2011 | 1884 | 7203 66.9 | GGACTCCCTTGACTTGGCAA | 34 | 28 | 1 | 11 | 21 | 0 |
| 6645 | 2012 | 1885 | 7206 70.9 | ATCGGGACACGGAGGACGTT | 24 | 34 | 35 | 25 | 12 | 0 |
| 6646 | 2013 | 1886 | 30452 71.2 | ACGGTTGATCTGGTGCTGCG | 35 | 1 | 8 | 33 | 29 | 1 |
| 6647 | 2014 | 1887 | 7210 73.1 | ACGGATACACGGAGCCGCAA | 35 | 5 | 35 | 36 | 21 | 0 |
| 6648 | 2015 | 1888 | 7211 71.3 | ACGGTACAACGGGACCGGAC | 35 | 7 | 35 | 32 | 34 | 0 |
| 6649 | 2016 | 1890 | 40406 68.7 | ACGGCTTGTTAGCTTGCACG | 35 | 11 | 3 | 11 | 30 | 0 |

FIG. 29QQ

| SEQ ID NO: | ZIP ID# | 4,633 ID# | HEX ID# | Tm | ZIPCODE (NH2 -> CONH2) | T3TRAMER NUMBERS | | | | "UNALLOWED DIMERS" |
|---|---|---|---|---|---|---|---|---|---|---|
| 6650 | 2017 | 1891 | 15370 | 69.3 | ACGGCTGTTGATCGTTGCAA | 35 | 14 | 2 | 12 21 | 0 |
| 6651 | 2018 | 1892 | 21169 | 68.1 | ACGGCCATTACAGGTATGCG | 35 | 15 | 7 | 18 29 | 0 |
| 6652 | 2019 | 1893 | 7219 | 69.7 | ATCGACGGATCGGGTACGAA | 24 | 35 | 24 | 18 16 | 0 |
| 6653 | 2020 | 1894 | 15371 | 69.8 | ATCGACGGAGGACGAACGAA | 24 | 35 | 25 | 16 16 | 0 |
| 6654 | 2021 | 1895 | 30454 | 71.1 | ACGGGATGAGTGTCCCGGAC | 35 | 27 | 22 | 28 34 | 1 |
| 6655 | 2022 | 1896 | 21173 | 74.3 | ACGGACGGAATCCAGCCGAA | 35 | 35 | 4 | 31 16 | 0 |
| 6656 | 2023 | 1897 | 7225 | 71.5 | ACGGAGCCCCATACCTCACG | 35 | 36 | 15 | 23 30 | 0 |
| 6657 | 2024 | 1898 | 30455 | 68.4 | AGCCTGATGGTAAGCCCGTT | 36 | 2 | 18 | 36 12 | 0 |
| 6658 | 2025 | 1899 | 7227 | 69.1 | AGCCTTAGGACCGCTTCACG | 36 | 3 | 32 | 17 30 | 0 |
| 6659 | 2026 | 1900 | 15375 | 70.5 | AGCCTGTCTCCCATCGTCCC | 36 | 9 | 28 | 24 28 | 0 |
| 6660 | 2027 | 1901 | 15376 | 68.2 | AGCCCTTGATCGACCTCGTT | 36 | 11 | 24 | 23 12 | 0 |
| 6661 | 2028 | 1902 | 40407 | 69.2 | AGCCCTGTGTCTACGGCGTT | 36 | 14 | 19 | 35 12 | 0 |
| 6662 | 2029 | 1903 | 40408 | 70.1 | ATCGAGCCGGTAACCTGCAA | 24 | 36 | 18 | 23 21 | 0 |
| 6663 | 2030 | 1905 | 7236 | 71.2 | AGCCGCAATGTCCTGTCACG | 36 | 21 | 9 | 14 30 | 0 |
| 6664 | 2031 | 1906 | 21178 | 66.9 | AGCCAGGAGGTATCTGCGAA | 36 | 25 | 18 | 8 16 | 0 |
| 6665 | 2032 | 1907 | 40409 | 71.3 | AGCCTCCCCGTTTTAGTGCG | 36 | 28 | 12 | 3 29 | 0 |
| 6666 | 2033 | 1908 | 7241 | 67.8 | ATCGAGCCGACCTTAGGACC | 24 | 36 | 32 | 3 32 | 0 |
| 6667 | 2034 | 1909 | 7245 | 69.8 | TGATCGAACCATTCCCGCTT | 2 | 16 | 15 | 28 17 | 0 |
| 6668 | 2035 | 1910 | 15383 | 69.3 | AGGATTAGGCAATCCCGCAA | 25 | 3 | 21 | 28 21 | 0 |
| 6669 | 2036 | 1911 | 30457 | 69.2 | AATCGCAATCTGACGGGCTT | 4 | 21 | 8 | 35 17 | 0 |
| 6670 | 2037 | 1912 | 30458 | 69.4 | AATCGGACTCGTCAGCGCTT | 4 | 34 | 10 | 31 17 | 0 |
| 6671 | 2038 | 1913 | 7271 | 68.6 | AAAGCCATCCATGATGCACG | 6 | 15 | 15 | 27 30 | 0 |
| 6672 | 2039 | 1914 | 15390 | 69.5 | AGGAAAAGGCTTTGCGCTTG | 25 | 6 | 17 | 29 11 | 0 |
| 6673 | 2040 | 1915 | 21182 | 67.8 | AAAGTCCCTGATGTGCGTGC | 6 | 28 | 2 | 33 33 | 1 |
| 6674 | 2041 | 1916 | 30459 | 68.1 | AAAGCACGATCGAAAGGCAA | 6 | 30 | 24 | 6 21 | 0 |
| 6675 | 2042 | 1917 | 40411 | 70.1 | TCTGCGTTCTGTCGTTTGCG | 8 | 12 | 14 | 12 29 | 0 |
| 6676 | 2043 | 1918 | 21184 | 71.3 | TCTGCGAAACCTCACGACGG | 8 | 16 | 23 | 30 35 | 0 |
| 6677 | 2044 | 1920 | 15398 | 73 | TCTGAGCCACGGCCATCGTT | 8 | 36 | 35 | 15 12 | 0 |
| 6678 | 2045 | 1921 | 21188 | 75.6 | TGTCCAGCTCGTTGCGTGCG | 9 | 31 | 10 | 29 29 | 0 |
| 6679 | 2046 | 1922 | 30460 | 70.8 | TCGTCGAAAGCCCTTGCTTG | 10 | 16 | 36 | 11 11 | 0 |
| 6680 | 2047 | 1924 | 30461 | 74.5 | TCGTACGGCAGCGACCGATG | 10 | 35 | 31 | 32 27 | 0 |
| 6681 | 2048 | 1925 | 15408 | 68.1 | AGGACTTGGCTTAGCCGGAC | 25 | 11 | 17 | 36 34 | 0 |
| 6682 | 2049 | 1926 | 7309 | 67.9 | CTTGGGTATGTCGTGCCGTT | 11 | 18 | 9 | 33 12 | 0 |
| 6683 | 2050 | 1927 | 40412 | 69.6 | CTTGGCAATGATTCCCGGAC | 11 | 21 | 2 | 28 34 | 0 |
| 6684 | 2051 | 1928 | 7318 | 70.7 | CGTTATCGATCGTCCCGTGC | 12 | 24 | 24 | 28 33 | 0 |
| 6685 | 2052 | 1929 | 7321 | 71.9 | CGTTCAGCGAGTTGCGCCTA | 12 | 31 | 20 | 29 26 | 0 |
| 6686 | 2053 | 1930 | 40413 | 72.5 | CGTTGTGCATCGCGTTGACC | 12 | 33 | 24 | 12 32 | 0 |
| 6687 | 2054 | 1931 | 7324 | 74.2 | CGTTGGACGTGCTCCCTCCC | 12 | 34 | 33 | 28 28 | 0 |
| 6688 | 2055 | 1932 | 40414 | 71.3 | CCATGCAATGTCAGCCGGAC | 15 | 21 | 9 | 36 34 | 0 |
| 6689 | 2056 | 1933 | 21197 | 68.2 | CCATAGTGGCAAGGACACGG | 15 | 22 | 21 | 34 35 | 0 |
| 6690 | 2057 | 1934 | 7333 | 69.9 | CCATCAGCAAAGCCATGCAA | 15 | 31 | 6 | 15 21 | 0 |
| 6691 | 2058 | 1935 | 15417 | 75.5 | CCATGTGCTCCCACGGCGTT | 15 | 33 | 28 | 35 12 | 0 |
| 6692 | 2059 | 1936 | 7339 | 68.3 | CGAACGTTTTAGCAGCGACC | 16 | 12 | 3 | 31 32 | 0 |
| 6693 | 2060 | 1937 | 7343 | 69.1 | CGAAACCTTCTGCCATGCAA | 16 | 23 | 8 | 15 21 | 0 |
| 6694 | 2061 | 1938 | 15422 | 68.9 | CGAAACGGGTAAAAGCCAT | 16 | 35 | 18 | 6 15 | 0 |
| 6695 | 2062 | 1939 | 7352 | 70.1 | GCTTTCTGAGCCCACGATCG | 17 | 8 | 36 | 30 24 | 0 |
| 6696 | 2063 | 1941 | 15438 | 73 | GCAAGGACCGAACCATTGCG | 21 | 34 | 16 | 15 29 | 0 |
| 6697 | 2064 | 1942 | 30463 | 70.5 | GCAAACGGACCTCAGCGGTA | 21 | 35 | 23 | 31 18 | 0 |

FIG. 29RR

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6698 | 2065 | 1943 | 40415 | 70.1 | AGTGCCATCGTTTCCCATCG | 22 | 15 | 12 | 28 | 24 | 1 |
| 6699 | 2066 | 1945 | 7390 | 70.5 | AGTGCCTACACGCACGAGCC | 22 | 26 | 30 | 30 | 36 | 0 |
| 6700 | 2067 | 1946 | 7393 | 69.7 | AGTGCAGCATCGCTCAGCAA | 22 | 31 | 24 | 13 | 21 | 0 |
| 6701 | 2068 | 1947 | 7396 | 71.1 | AGTGAGCCCCTAAGCCACGG | 22 | 36 | 26 | 36 | 35 | 0 |
| 6702 | 2069 | 1948 | 15443 | 70.8 | ACCTCAGCCCATAGCCGCTT | 23 | 31 | 15 | 36 | 17 | 0 |
| 6703 | 2070 | 1949 | 7404 | 72.5 | ACCTGACCGCTTGGACGTGC | 23 | 32 | 17 | 34 | 33 | 0 |
| 6704 | 2071 | 1950 | 7408 | 68.5 | ATCGCCATCTGTGCTTCGAA | 24 | 15 | 14 | 17 | 16 | 0 |
| 6705 | 2072 | 1951 | 15446 | 73.7 | ATCGACCTTCCCGTGCGCTT | 24 | 23 | 28 | 33 | 17 | 1 |
| 6706 | 2073 | 1952 | 30465 | 72.2 | ATCGCAGCGGTAGTGCCCAT | 24 | 31 | 18 | 33 | 15 | 0 |
| 6707 | 2074 | 1953 | 40419 | 72.6 | AGGACACGATCGACGGCAGC | 25 | 30 | 24 | 35 | 31 | 0 |
| 6708 | 2075 | 1954 | 40420 | 73.4 | GATGGCAAATCGCACGCCAT | 27 | 21 | 24 | 30 | 15 | 0 |
| 6709 | 2076 | 1955 | 30466 | 72.3 | TCCCCTTGGTCTAGCCGCAA | 28 | 11 | 19 | 36 | 21 | 0 |
| 6710 | 2077 | 1956 | 15460 | 69.8 | TCCCGAGTTCGTGATGGCTT | 28 | 20 | 10 | 27 | 17 | 0 |
| 6711 | 2078 | 1957 | 7449 | 72.3 | TGCGCGTTCTTGCTGTGGAC | 29 | 12 | 11 | 14 | 34 | 0 |
| 6712 | 2079 | 1958 | 15467 | 74.2 | TGCGAGTGCGTTGCAACACG | 29 | 22 | 12 | 21 | 30 | 0 |
| 6713 | 2080 | 1959 | 7455 | 72.6 | TGCGTGCGACGGTACACGTT | 29 | 29 | 35 | 7 | 12 | 0 |
| 6714 | 2081 | 1960 | 15469 | 72.2 | TGCGGTGCTACACAGCGCTT | 29 | 33 | 7 | 31 | 17 | 0 |
| 6715 | 2082 | 1961 | 21221 | 70.5 | CACGATACGATGCAGCTGCG | 30 | 5 | 27 | 31 | 29 | 0 |
| 6716 | 2083 | 1962 | 21224 | 70.5 | CACGGGTATTGAACGGACGG | 30 | 18 | 1 | 35 | 35 | 0 |
| 6717 | 2084 | 1963 | 7463 | 68.7 | CACGACCTAGCCTCTGTGCG | 30 | 23 | 36 | 8 | 29 | 0 |
| 6718 | 2085 | 1964 | 30468 | 69.2 | CACGCCTAAAAGGGACGCTT | 30 | 26 | 6 | 34 | 17 | 0 |
| 6719 | 2086 | 1965 | 7470 | 73.5 | CACGGGACGTCTTGCGTCGT | 30 | 34 | 19 | 29 | 10 | 0 |
| 6720 | 2087 | 1966 | 7479 | 73.5 | CAGCATCGGTGCAGTGCACG | 31 | 24 | 33 | 22 | 30 | 0 |
| 6721 | 2088 | 1967 | 15479 | 72.8 | CAGCAGGATGCGGATGTCCC | 31 | 25 | 29 | 27 | 28 | 0 |
| 6722 | 2089 | 1968 | 40425 | 70.4 | CAGCCCTATGTCCAGCCGAA | 31 | 26 | 9 | 31 | 16 | 0 |
| 6723 | 2090 | 1969 | 30470 | 70.4 | CAGCCACGTTAGTCCCCGAA | 31 | 30 | 3 | 28 | 16 | 0 |
| 6724 | 2091 | 1970 | 21235 | 69.5 | GTGCATACGACCATCGGCAA | 33 | 5 | 32 | 24 | 21 | 0 |
| 6725 | 2092 | 1971 | 7498 | 74 | GTGCAAAGTGCGGTGCGACC | 33 | 6 | 29 | 33 | 32 | 0 |
| 6726 | 2093 | 1972 | 15487 | 69.1 | GTGCGTCTAAAGCAGCGTGC | 33 | 19 | 6 | 31 | 33 | 0 |
| 6727 | 2094 | 1973 | 7506 | 68.3 | GTGCCCTACAGCAGTGGTGC | 33 | 26 | 31 | 22 | 33 | 0 |
| 6728 | 2095 | 1974 | 15491 | 70.5 | GTGCGACCTCGTTGTCGGAC | 33 | 32 | 10 | 9 | 34 | 0 |
| 6729 | 2096 | 1976 | 15493 | 74.2 | GGACCTTGTCCCGCAAACGG | 34 | 11 | 28 | 21 | 35 | 1 |
| 6730 | 2097 | 1977 | 15495 | 71 | GGACCCATGGACTCCCCTCA | 34 | 15 | 34 | 28 | 13 | 0 |
| 6731 | 2098 | 1978 | 7522 | 70.1 | GGACGATGACCTCACGCGTT | 34 | 27 | 23 | 30 | 12 | 0 |
| 6732 | 2099 | 1979 | 7533 | 70.7 | ACGGATCGCCTACCATGCAA | 35 | 24 | 26 | 15 | 21 | 0 |
| 6733 | 2100 | 1980 | 15502 | 69.9 | ACGGAGGACACGCTGTGACC | 35 | 25 | 30 | 14 | 32 | 0 |
| 6734 | 2101 | 1981 | 7535 | 70.5 | ACGGGATGGTCTCAGCTCCC | 35 | 27 | 19 | 31 | 28 | 0 |
| 6735 | 2102 | 1983 | 7539 | 69.5 | AGCCAAAGGAGTTCCCCCAT | 36 | 6 | 20 | 28 | 15 | 0 |
| 6736 | 2103 | 1984 | 40427 | 69 | AGCCCTCAATACCACGCCAT | 36 | 13 | 5 | 30 | 15 | 0 |
| 6737 | 2104 | 1985 | 15506 | 72 | AGCCAGTGCAGCCCATCCAT | 36 | 22 | 31 | 15 | 15 | 0 |
| 6738 | 2105 | 1986 | 15508 | 72 | AGCCCACGGCTTTTGACAGC | 36 | 30 | 17 | 1 | 31 | 0 |
| 6739 | 2106 | 1987 | 7553 | 73.7 | AGGAAGCCCAGCCACGCTGT | 25 | 36 | 31 | 30 | 14 | 0 |
| 6740 | 2107 | 1988 | 7554 | 71.2 | AGCCGTGCTGTCCTCACACG | 36 | 33 | 9 | 13 | 30 | 0 |
| 6741 | 2108 | 1989 | 7558 | 71.7 | TTGATGCGGCAATCGTCGTT | 1 | 29 | 21 | 10 | 12 | 0 |
| 6742 | 2109 | 1990 | 15522 | 72.8 | TGTCGCAATGTCGTGCGCTT | 9 | 21 | 9 | 33 | 17 | 0 |
| 6743 | 2110 | 1991 | 7587 | 77.4 | TGTCACGGGACCGCAATGCG | 9 | 35 | 32 | 21 | 29 | 0 |
| 6744 | 2111 | 1992 | 7589 | 73.3 | TCGTTCGTTGTCTGCGCACG | 10 | 10 | 9 | 29 | 30 | 0 |
| 6745 | 2112 | 1993 | 15526 | 77.8 | TCGTCACGGTGCCAGCTGCG | 10 | 30 | 33 | 31 | 29 | 0 |

FIG. 29SS

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6746 | 2113 | 1994 | 7611 | 76.1 | CGTTGACCGACCGGACTGCG | 12 | 32 | 32 | 34 | 29 | 0 |
| 6747 | 2114 | 1995 | 15536 | 76.1 | CTGTTGCGCACGACGGGACC | 14 | 29 | 30 | 35 | 32 | 0 |
| 6748 | 2115 | 1996 | 7640 | 75.2 | GCTTGACCTCCCGTGCCACG | 17 | 32 | 28 | 33 | 30 | 0 |
| 6749 | 2116 | 1997 | 40430 | 69.7 | GCAAGCAACACGCCTACACG | 21 | 21 | 30 | 26 | 30 | 0 |
| 6750 | 2117 | 1998 | 30474 | 70 | ATCGCCATAGTGTCCCCACG | 24 | 15 | 22 | 28 | 30 | 1 |
| 6751 | 2118 | 1999 | 7700 | 72.2 | TCCCTTGAAGCCACGGCTGT | 28 | 1 | 36 | 35 | 14 | 0 |
| 6752 | 2119 | 2000 | 30475 | 75.2 | TCCCCTCAGACCACGGCGAA | 28 | 13 | 32 | 35 | 16 | 0 |
| 6753 | 2120 | 2001 | 30476 | 70.6 | TCCCCACGTGATAGCCGGTA | 28 | 30 | 2 | 36 | 18 | 0 |
| 6754 | 2121 | 2002 | 7731 | 73.6 | CACGTCGTAGCCCACGCGTT | 30 | 10 | 36 | 30 | 12 | 0 |
| 6755 | 2122 | 2003 | 7733 | 73.6 | CACGCTGTCGTTGTGCGTGC | 30 | 14 | 12 | 33 | 33 | 0 |
| 6756 | 2123 | 2004 | 7740 | 72.3 | CACGCAGCAGTGTGCGACCT | 30 | 31 | 22 | 29 | 23 | 0 |
| 6757 | 2124 | 2005 | 21261 | 72.3 | CAGCGTCTTCGTCAGCTGCG | 31 | 19 | 10 | 31 | 29 | 0 |
| 6758 | 2125 | 2006 | 7747 | 73.4 | CAGCGAGTCACGGCAAAGCC | 31 | 20 | 30 | 21 | 36 | 0 |
| 6759 | 2126 | 2008 | 30477 | 69.3 | GACCCGAACCATCCATACGG | 32 | 16 | 15 | 15 | 35 | 0 |
| 6760 | 2127 | 2009 | 21266 | 69.8 | GTGCGTCTCGTTACGGGACC | 33 | 19 | 12 | 35 | 32 | 0 |
| 6761 | 2128 | 2010 | 7780 | 69.3 | GTGCACGGTTGAGCAAATCG | 33 | 35 | 1 | 21 | 24 | 1 |
| 6762 | 2129 | 2011 | 15616 | 74.6 | GGACCACGCAGCTCGTGCAA | 34 | 30 | 31 | 10 | 21 | 0 |
| 6763 | 2130 | 2012 | 40433 | 69.5 | AGCCGAGTAGTGGTGCGACC | 36 | 20 | 22 | 33 | 32 | 0 |
| 6764 | 2131 | 2013 | 40434 | 71.8 | AGCCACCTCTTGTCCCTGCG | 36 | 23 | 11 | 28 | 29 | 1 |
| 6765 | 2132 | 2014 | 7825 | 75.1 | TTGAAGCCGTGCGTGCGGTA | 1 | 36 | 33 | 33 | 18 | 0 |
| 6766 | 2133 | 2015 | 7831 | 74.7 | AATCGTGCACGGCGTTTCCC | 4 | 33 | 35 | 12 | 28 | 1 |
| 6767 | 2134 | 2016 | 7832 | 72.2 | AATCACGGTCGTTCCCCACG | 4 | 35 | 10 | 28 | 30 | 0 |
| 6768 | 2135 | 2017 | 7834 | 72.8 | AAAGCCATCAGCGGACGTGC | 6 | 15 | 31 | 34 | 33 | 0 |
| 6769 | 2136 | 2018 | 15632 | 70.8 | AAAGCGAAAGCCCCATCGTT | 6 | 16 | 36 | 15 | 12 | 0 |
| 6770 | 2137 | 2019 | 15633 | 77.2 | AAAGCACGCAGCTGCGTGCG | 6 | 30 | 31 | 29 | 29 | 0 |
| 6771 | 2138 | 2020 | 7845 | 69.2 | GATGCTTGCGTTCCATGTGC | 27 | 11 | 12 | 15 | 33 | 0 |
| 6772 | 2139 | 2021 | 7854 | 73.1 | CGTTTGTCCGAAAGCCACGG | 12 | 9 | 16 | 36 | 35 | 0 |
| 6773 | 2140 | 2022 | 15643 | 70.3 | GATGCGTTGGACAGCCCCTA | 27 | 12 | 34 | 36 | 26 | 0 |
| 6774 | 2141 | 2023 | 7867 | 72.5 | CTCACACGCGAACACGGTGC | 13 | 30 | 16 | 30 | 33 | 0 |
| 6775 | 2142 | 2024 | 7870 | 68.5 | CTGTCGAACCTATGCGGTGC | 14 | 16 | 26 | 29 | 33 | 0 |
| 6776 | 2143 | 2025 | 7873 | 71.8 | CTGTCAGCCACGGCTTGTGC | 14 | 31 | 30 | 17 | 33 | 0 |
| 6777 | 2144 | 2026 | 7875 | 71.7 | CTGTAGCCACGGGCAACACG | 14 | 36 | 35 | 21 | 30 | 0 |
| 6778 | 2145 | 2027 | 7879 | 68.3 | CCATCGTTTCGTGCTTGGAC | 15 | 12 | 10 | 17 | 34 | 0 |
| 6779 | 2146 | 2028 | 30480 | 70.9 | GATGCCATCCATCAGCCGAA | 27 | 15 | 15 | 31 | 16 | 0 |
| 6780 | 2147 | 2030 | 7883 | 69.4 | CCATAGGAGGACCAGCCGAA | 15 | 25 | 34 | 31 | 16 | 0 |
| 6781 | 2148 | 2031 | 7884 | 69.1 | CCATCCTACGAAAGCCGACC | 15 | 26 | 16 | 36 | 32 | 0 |
| 6782 | 2149 | 2032 | 15648 | 71.3 | CCATTCCCGGTACAGCCCAT | 15 | 28 | 18 | 31 | 15 | 0 |
| 6783 | 2150 | 2033 | 7895 | 72 | CGAACTCATGCGGGACTCCC | 16 | 13 | 29 | 34 | 28 | 0 |
| 6784 | 2151 | 2034 | 30483 | 70.3 | CGAAATCGCCTACAGCGCTT | 16 | 24 | 26 | 31 | 17 | 0 |
| 6785 | 2152 | 2035 | 7908 | 70.8 | CGAAACGGGCAATGTCCTTG | 16 | 35 | 21 | 9 | 11 | 0 |
| 6786 | 2153 | 2036 | 15657 | 74 | GATGCGAAAGCCGCTTGCAA | 27 | 16 | 36 | 17 | 21 | 0 |
| 6787 | 2154 | 2037 | 7913 | 73.2 | GCTTCTTGCACGGACCGTGC | 17 | 11 | 30 | 32 | 33 | 0 |
| 6788 | 2155 | 2038 | 30484 | 69.2 | GCTTGCAAAGGATCGTGCAA | 17 | 21 | 25 | 10 | 21 | 0 |
| 6789 | 2156 | 2039 | 7923 | 71.2 | GCTTGACCGTCTCAGCTGCG | 17 | 32 | 19 | 31 | 29 | 0 |
| 6790 | 2157 | 2040 | 15665 | 71.5 | GATGGGTATGCGATCGCACG | 27 | 18 | 29 | 24 | 30 | 0 |
| 6791 | 2158 | 2041 | 7931 | 74.9 | GGTAGTGCCACGTGCGCACG | 18 | 33 | 30 | 29 | 30 | 0 |
| 6792 | 2159 | 2042 | 7933 | 70.5 | GAGTTCCCGGTAGTGCGCAA | 20 | 28 | 18 | 33 | 21 | 0 |
| 6793 | 2160 | 2043 | 7938 | 72.2 | GCAATCTGCGAATCCCAGCC | 21 | 8 | 16 | 28 | 36 | 0 |

FIG. 29TT

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6794 | 2161 | 2044 | 40438 | 67.6 | GCAACGTTATACGCAATGCG | 21 | 12 | 5 | 21 | 29 | 0 |
| 6795 | 2162 | 2045 | 30485 | 67.6 | GATGGCAAGCTTCAGCCCTA | 27 | 21 | 17 | 31 | 26 | 0 |
| 6796 | 2163 | 2046 | 30486 | 68 | GCAAACCTAAAGCAGCCGAA | 21 | 23 | 6 | 31 | 16 | 0 |
| 6797 | 2164 | 2047 | 7947 | 72.5 | GCAAGATGGACCAGCCCGAA | 21 | 27 | 32 | 36 | 16 | 0 |
| 6798 | 2165 | 2048 | 7954 | 69.4 | AGTGGCAACGTTCGTTTCCC | 22 | 21 | 12 | 12 | 28 | 1 |
| 6799 | 2166 | 2049 | 40439 | 72.7 | ACCTTGCGCGTTGCTTCGTT | 23 | 29 | 12 | 17 | 12 | 0 |
| 6800 | 2167 | 2050 | 30487 | 70.5 | ATCGCGTTCCATGCTTACGG | 24 | 12 | 15 | 17 | 35 | 0 |
| 6801 | 2168 | 2051 | 7959 | 71.5 | ATCGCCATTGTCCACGCTCA | 24 | 15 | 9 | 30 | 13 | 0 |
| 6802 | 2169 | 2052 | 40440 | 72.6 | ATCGGCTTCCATGGACTGCG | 24 | 17 | 15 | 34 | 29 | 0 |
| 6803 | 2170 | 2053 | 30488 | 74.3 | ATCGCACGGATGCGTTCACG | 24 | 30 | 27 | 12 | 30 | 0 |
| 6804 | 2171 | 2054 | 7980 | 69.4 | CCTAAGCCGGTAGTGCGGAC | 26 | 36 | 18 | 33 | 34 | 0 |
| 6805 | 2172 | 2055 | 7981 | 67.9 | GATGCTCAGACCCGTTCGAA | 27 | 13 | 32 | 12 | 16 | 0 |
| 6806 | 2173 | 2056 | 7985 | 73.4 | GATGCCTATGCGAGCCTGCG | 27 | 26 | 29 | 36 | 29 | 0 |
| 6807 | 2174 | 2057 | 15679 | 69.5 | GATGGTGCTGATCACGCGAA | 27 | 33 | 2 | 30 | 16 | 0 |
| 6808 | 2175 | 2058 | 7988 | 68.8 | GATGAGCCAATCCAGCTCCC | 27 | 36 | 4 | 31 | 28 | 0 |
| 6809 | 2176 | 2059 | 30489 | 69.5 | TCCCGCTTAATCCTTGCGTT | 28 | 17 | 4 | 11 | 12 | 0 |
| 6810 | 2177 | 2060 | 7993 | 71.7 | TCCCGTCTCGTTGACCCCAT | 28 | 19 | 12 | 32 | 15 | 0 |
| 6811 | 2178 | 2061 | 15686 | 74.5 | TCCCCAGCGCTTCACGGTCT | 28 | 31 | 17 | 30 | 19 | 0 |
| 6812 | 2179 | 2062 | 15687 | 72.8 | TCCCGACCATACTCCCGCAA | 28 | 32 | 5 | 28 | 21 | 0 |
| 6813 | 2180 | 2063 | 21306 | 70.2 | TGCGTTAGCAGCGATGATCG | 29 | 3 | 31 | 27 | 24 | 0 |
| 6814 | 2181 | 2064 | 15692 | 71.3 | TGCGGGTAATCGGCTTGATG | 29 | 18 | 24 | 17 | 27 | 0 |
| 6815 | 2182 | 2065 | 15696 | 75.2 | TGCGCACGCGAATCGTAGGA | 29 | 30 | 16 | 10 | 25 | 0 |
| 6816 | 2183 | 2066 | 30492 | 76.6 | TGCGCAGCGCAAATCGACCT | 29 | 31 | 21 | 24 | 23 | 0 |
| 6817 | 2184 | 2067 | 8021 | 74.8 | CACGTGTCGTGCAGCCGGAC | 30 | 9 | 33 | 36 | 34 | 0 |
| 6818 | 2185 | 2068 | 8024 | 71.1 | GATGCACGCCATCGTTCGTT | 27 | 30 | 15 | 12 | 12 | 0 |
| 6819 | 2186 | 2069 | 8028 | 71.3 | CACGAGTGACGGATCGGTGC | 30 | 22 | 35 | 24 | 33 | 0 |
| 6820 | 2187 | 2070 | 15699 | 73.9 | CACGTGCGGTCTGACCCAGC | 30 | 29 | 19 | 32 | 31 | 0 |
| 6821 | 2188 | 2071 | 15700 | 72.7 | GATGCACGCACGCTTGATCG | 27 | 30 | 30 | 11 | 24 | 0 |
| 6822 | 2189 | 2072 | 30494 | 73.8 | CACGAGCCGACCAATCACGG | 30 | 36 | 32 | 4 | 35 | 0 |
| 6823 | 2190 | 2073 | 8036 | 70.7 | CAGCTGATTGCGATCGGGAC | 31 | 2 | 29 | 24 | 34 | 0 |
| 6824 | 2191 | 2074 | 30495 | 71.5 | CAGCTCGTCACGTCCCATCG | 31 | 10 | 30 | 28 | 24 | 0 |
| 6825 | 2192 | 2075 | 15704 | 71.5 | GATGCAGCCTTGATCGCGAA | 27 | 31 | 11 | 24 | 16 | 0 |
| 6826 | 2193 | 2076 | 40443 | 67.9 | CAGCCTCATGATGACCGCTT | 31 | 13 | 2 | 32 | 17 | 0 |
| 6827 | 2194 | 2077 | 30496 | 67.8 | GATGCAGCGGTAGGTAACGG | 27 | 31 | 18 | 18 | 35 | 0 |
| 6828 | 2195 | 2078 | 8048 | 73 | CAGCGTGCGCTTGTCTCACG | 31 | 33 | 17 | 19 | 30 | 0 |
| 6829 | 2196 | 2079 | 15708 | 72 | GATGCAGCAGCCCTCATCCC | 27 | 31 | 36 | 13 | 28 | 0 |
| 6830 | 2197 | 2080 | 40444 | 70.3 | GACCCGTTGGACAAAGCGAA | 32 | 12 | 34 | 6 | 16 | 0 |
| 6831 | 2198 | 2082 | 15712 | 72 | GATGGACCCACGACGGGGTA | 27 | 32 | 30 | 35 | 18 | 0 |
| 6832 | 2199 | 2084 | 8088 | 73.4 | ACGGTTGAGCTTTGCGGCAA | 35 | 1 | 17 | 29 | 21 | 1 |
| 6833 | 2200 | 2085 | 30499 | 71.3 | ACGGGGTAGACCCGAAGCAA | 35 | 18 | 32 | 16 | 21 | 0 |
| 6834 | 2201 | 2086 | 40447 | 72.1 | AGCCCTCACTCAAGCCTGCG | 36 | 13 | 13 | 36 | 29 | 0 |
| 6835 | 2202 | 2087 | 21328 | 70.2 | GATGAGCCGTCTACGGCAGC | 27 | 36 | 19 | 35 | 31 | 0 |
| 6836 | 2203 | 2088 | 15729 | 71.5 | AGCCATCGTCGTCCATGCAA | 36 | 24 | 10 | 15 | 21 | 0 |
| 6837 | 2204 | 2089 | 8108 | 70.2 | AGCCCAGCATACGCAACGTT | 36 | 31 | 5 | 21 | 12 | 0 |
| 6838 | 2205 | 2090 | 8112 | 70.2 | TTGAAATCTGCGAGCCCGTT | 1 | 4 | 29 | 36 | 12 | 0 |
| 6839 | 2206 | 2091 | 21331 | 68.8 | TCCCTTGAAGGAAGCCCTTG | 28 | 1 | 25 | 36 | 11 | 0 |
| 6840 | 2207 | 2092 | 30500 | 66.9 | TTGATGCGTTAGGGTATGCG | 1 | 29 | 3 | 18 | 29 | 0 |
| 6841 | 2208 | 2093 | 8118 | 67.6 | TTGACAGCAAAGATCGCACG | 1 | 31 | 6 | 24 | 30 | 0 |

FIG. 29UU

| SEQ ID NO: | ZIP ID# | 4,633 ID# | HEX ID# Tm | ZIPCODE (NH2 -> CONH2) | TETRAMER NUMBERS | | | | "UNALLOWED DIMERS" |
|---|---|---|---|---|---|---|---|---|---|
| 6842 | 2209 | 2094 | 15734 71.8 | TTGAGGACCACGGATGCACG | 1 | 34 | 30 | 27 30 | 0 |
| 6843 | 2210 | 2095 | 8122 70.1 | TGATTCTGGGACCAGCAGCC | 2 | 8 | 34 | 31 36 | 0 |
| 6844 | 2211 | 2096 | 21332 67.3 | TGATTCGTAATCACGGCACG | 2 | 10 | 4 | 35 30 | 0 |
| 6845 | 2212 | 2097 | 40453 68.1 | TGATCGAATTGAAGCCAGCC | 2 | 16 | 1 | 36 36 | 0 |
| 6846 | 2213 | 2099 | 15737 67.5 | TCCCTGATTGCGAGGACCTA | 28 | 2 | 29 | 25 26 | 0 |
| 6847 | 2214 | 2100 | 8131 69 | TGATGACCTGTCACGGACGG | 2 | 32 | 9 | 35 35 | 0 |
| 6848 | 2215 | 2101 | 8136 67.8 | TTAGCTGTATCGTGCGCGAA | 3 | 14 | 24 | 29 16 | 0 |
| 6849 | 2216 | 2102 | 30501 68.3 | TCCCTTAGGCAAGCTTGCAA | 28 | 3 | 21 | 17 21 | 0 |
| 6850 | 2217 | 2103 | 8140 66.3 | TTAGAGGAAATCTGCGTGCG | 3 | 25 | 4 | 29 29 | 0 |
| 6851 | 2218 | 2104 | 8143 68 | TCCCTTAGCACGCTTGAGGA | 28 | 3 | 30 | 11 25 | 0 |
| 6852 | 2219 | 2106 | 30502 68.7 | TCCCAATCCTGTGGACTCCC | 28 | 4 | 14 | 34 28 | 0 |
| 6853 | 2220 | 2107 | 30503 66.4 | TCCCAATCGCTTCCTAGACC | 28 | 4 | 17 | 26 32 | 0 |
| 6854 | 2221 | 2108 | 8155 64.2 | TCCCAATCGAGTACCTGACC | 28 | 4 | 20 | 23 32 | 0 |
| 6855 | 2222 | 2109 | 8157 69.6 | TCCCAATCAGTGGACCGACC | 28 | 4 | 22 | 32 32 | 0 |
| 6856 | 2223 | 2110 | 30504 66.8 | TCCCAATCACCTCTTGAGCC | 28 | 4 | 23 | 11 36 | 0 |
| 6857 | 2224 | 2111 | 15748 70.9 | TCCCAATCTCCCAGTGTGCG | 28 | 4 | 28 | 22 29 | 0 |
| 6858 | 2225 | 2112 | 8162 71 | TCCCAATCGACCTCTGCACG | 28 | 4 | 32 | 8 30 | 0 |
| 6859 | 2226 | 2113 | 8164 73 | TCCCAATCAGCCGATGCGTT | 28 | 4 | 36 | 27 12 | 0 |
| 6860 | 2227 | 2114 | 8166 70.8 | TCCCATACCTTGGTGCACGG | 28 | 5 | 11 | 33 35 | 0 |
| 6861 | 2228 | 2115 | 30506 70 | TCCCATACCCATCAGCCAGC | 28 | 5 | 15 | 31 31 | 0 |
| 6862 | 2229 | 2116 | 30507 65.6 | TCCCATACCGAAATACGTGC | 28 | 5 | 16 | 5 33 | 0 |
| 6863 | 2230 | 2117 | 15753 69.1 | TCCCATACGTGCCGAACTCA | 28 | 5 | 33 | 16 13 | 0 |
| 6864 | 2231 | 2118 | 30510 70.2 | TCCCAAAGCGTTTCGTCGTT | 28 | 6 | 12 | 10 12 | 0 |
| 6865 | 2232 | 2119 | 40458 66.4 | TCCCAAAGGGTACCATCGTT | 28 | 6 | 18 | 15 12 | 0 |
| 6866 | 2233 | 2120 | 40459 67.8 | TCCCAAAGGTCTCGTTCACG | 28 | 6 | 19 | 12 30 | 0 |
| 6867 | 2234 | 2121 | 30511 67.7 | TCCCAAAGACCTCACGATCG | 28 | 6 | 23 | 30 24 | 0 |
| 6868 | 2235 | 2122 | 8183 65.4 | AAAGATCGCGAATTAGCGAA | 6 | 24 | 16 | 3 16 | 0 |
| 6869 | 2236 | 2123 | 8184 64.5 | AAAGGATGACCTCTTGCGAA | 6 | 27 | 23 | 11 16 | 0 |
| 6870 | 2237 | 2124 | 8186 68 | TCCCAAAGTGCGTGATCCAT | 28 | 6 | 29 | 2 15 | 0 |
| 6871 | 2238 | 2125 | 8188 65.9 | AAAGCAGCAATCTGTCGTGC | 6 | 31 | 4 | 9 33 | 0 |
| 6872 | 2239 | 2126 | 8189 68.9 | TCCCAAAGGACCTCGTTCGT | 28 | 6 | 32 | 10 10 | 0 |
| 6873 | 2240 | 2127 | 30512 71.8 | TCCCAAAGAGCCCTTGACGG | 28 | 6 | 36 | 11 35 | 0 |
| 6874 | 2241 | 2129 | 15757 71.4 | TCCCTCTGCGTTTCCCTCGT | 28 | 8 | 12 | 28 10 | 1 |
| 6875 | 2242 | 2130 | 40460 67.9 | TCTGCTCACCTAACGGCGTT | 8 | 13 | 26 | 35 12 | 0 |
| 6876 | 2243 | 2131 | 15759 69.5 | TCCCTCTGGTCTGACCCGAA | 28 | 8 | 19 | 32 16 | 0 |
| 6877 | 2244 | 2132 | 30515 74.3 | TCCCTCTGATCGCAGCGCAA | 28 | 8 | 24 | 31 21 | 0 |
| 6878 | 2245 | 2133 | 8206 66.4 | TCTGAGGACGTTCTGTTGCG | 8 | 25 | 12 | 14 29 | 0 |
| 6879 | 2246 | 2135 | 8208 66.5 | TCTGTCCCTTGATGTCGCAA | 8 | 28 | 1 | 9 21 | 0 |
| 6880 | 2247 | 2136 | 40461 68.9 | TCCCTCTGGGACTGTCGACC | 28 | 8 | 34 | 9 32 | 0 |
| 6881 | 2248 | 2137 | 8213 68.9 | TGTCCTTGCGTTTCTGACGG | 9 | 11 | 12 | 8 35 | 0 |
| 6882 | 2249 | 2138 | 40462 69.4 | TGTCATCGAATCGTGCGGAC | 9 | 24 | 4 | 33 34 | 0 |
| 6883 | 2250 | 2139 | 15761 69.4 | TGTCAGGATGTCGACCTGCG | 9 | 25 | 9 | 32 29 | 0 |
| 6884 | 2251 | 2140 | 40463 67.1 | TGTCGGACTACATCCCCGTT | 9 | 34 | 7 | 28 12 | 0 |
| 6885 | 2252 | 2141 | 15766 68.7 | TCGTTGTCACCTCAGCAGCC | 10 | 9 | 23 | 31 36 | 0 |
| 6886 | 2253 | 2142 | 30518 70.1 | TCGTCTCAGACCCAGCGCTT | 10 | 13 | 32 | 31 17 | 0 |
| 6887 | 2254 | 2143 | 40464 67.5 | TCGTGGTATACATGCGCAGC | 10 | 18 | 7 | 29 31 | 0 |
| 6888 | 2255 | 2144 | 8234 67.6 | TCCCTCGTGTCTTGTCAGCC | 28 | 10 | 19 | 9 36 | 0 |
| 6889 | 2256 | 2145 | 40465 71.1 | TCCCTCGTGCAAAGTGGTGC | 28 | 10 | 21 | 22 33 | 0 |

FIG. 29VV

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 6890 | 2257 | 2146 | 40466 | 66 | TCGTACCTCCTAGTGCTGCG | 10 | 23 | 26 | 33 29 | 0 |
| 6891 | 2258 | 2147 | 8237 | 71.9 | TCCCTCGTGATGCACGATCG | 28 | 10 | 27 | 30 24 | 0 |
| 6892 | 2259 | 2148 | 8238 | 73.1 | TCCCTCGTTGCGCCATAGGA | 28 | 10 | 29 | 15 25 | 0 |
| 6893 | 2260 | 2149 | 8240 | 71.5 | TCCCTCGTGACCTCGTGCAA | 28 | 10 | 32 | 10 21 | 0 |
| 6894 | 2261 | 2150 | 15769 | 67.6 | TCCCTCGTGTGCTTAGCCAT | 28 | 10 | 33 | 3 15 | 0 |
| 6895 | 2262 | 2151 | 21356 | 69.7 | TCGTGGACGCTTAGTGCGAA | 10 | 34 | 17 | 22 16 | 0 |
| 6896 | 2263 | 2152 | 30519 | 71.1 | TCCCCTTGTGATTCGTTGCG | 28 | 11 | 2 | 10 29 | 0 |
| 6897 | 2264 | 2153 | 21357 | 65.1 | TCCCCTTGAAAGGGTAACCT | 28 | 11 | 6 | 18 23 | 0 |
| 6898 | 2265 | 2154 | 30520 | 66.1 | TCCCCTTGTCTGACCTAGCC | 28 | 11 | 8 | 23 36 | 0 |
| 6899 | 2266 | 2155 | 40469 | 66.9 | TCCCCTTGCTCAGGACTCTG | 28 | 11 | 13 | 34 8 | 0 |
| 6900 | 2267 | 2156 | 30521 | 70.2 | TCCCCTTGGGTAAGTGTGCG | 28 | 11 | 18 | 22 29 | 0 |
| 6901 | 2268 | 2157 | 40470 | 68.9 | TCCCCTTGATCGTCTGTCCC | 28 | 11 | 24 | 8 28 | 0 |
| 6902 | 2269 | 2159 | 15779 | 69.7 | TCCCCTTGAGCCAGGATTGA | 28 | 11 | 36 | 25 1 | 0 |
| 6903 | 2270 | 2160 | 30522 | 64.8 | TCCCCGTTTGATATCGTGAT | 28 | 12 | 2 | 24 2 | 0 |
| 6904 | 2271 | 2161 | 8266 | 68.9 | TCCCCGTTATACGTGCGATG | 28 | 12 | 5 | 33 27 | 0 |
| 6905 | 2272 | 2162 | 40473 | 66.2 | TCCCCGTTTACATTGACACG | 28 | 12 | 7 | 1 30 | 0 |
| 6906 | 2273 | 2163 | 40474 | 69.9 | TCCCCGTTTGTCTGTCGACC | 28 | 12 | 9 | 9 32 | 0 |
| 6907 | 2274 | 2164 | 8267 | 73.4 | TCCCCGTTTCGTCAGCATCG | 28 | 12 | 10 | 31 24 | 0 |
| 6908 | 2275 | 2165 | 8268 | 67.3 | TCCCCGTTCTTGGAGTGGTA | 28 | 12 | 11 | 20 18 | 0 |
| 6909 | 2276 | 2166 | 8270 | 67.7 | TCCCCGTTCTCAGGTACACG | 28 | 12 | 13 | 18 30 | 0 |
| 6910 | 2277 | 2167 | 8272 | 72.9 | TCCCCGTTCCATCACGGATG | 28 | 12 | 15 | 30 27 | 0 |
| 6911 | 2278 | 2168 | 8274 | 73.3 | TCCCCGTTGCTTTCCCTGT | 28 | 12 | 17 | 28 14 | 0 |
| 6912 | 2279 | 2169 | 8276 | 69.6 | TCCCCGTTGCAATCTGACCT | 28 | 12 | 21 | 8 23 | 0 |
| 6913 | 2280 | 2170 | 30523 | 67.1 | TCCCCGTTACCTTGATACGG | 28 | 12 | 23 | 2 35 | 0 |
| 6914 | 2281 | 2171 | 8277 | 70.8 | TCCCCGTTATCGCCTATCCC | 28 | 12 | 24 | 26 28 | 0 |
| 6915 | 2282 | 2172 | 8281 | 73.1 | TCCCCGTTTGCGTCGTAGGA | 28 | 12 | 29 | 10 25 | 0 |
| 6916 | 2283 | 2173 | 8283 | 73.8 | TCCCCGTTGTGCAGTGCGTT | 28 | 12 | 33 | 22 12 | 0 |
| 6917 | 2284 | 2175 | 15780 | 73.2 | TCCCCTCATGATTGCGACGG | 28 | 13 | 2 | 29 35 | 0 |
| 6918 | 2285 | 2176 | 8287 | 68.3 | TCCCCTCATTAGCTTGTGCG | 28 | 13 | 3 | 11 29 | 0 |
| 6919 | 2286 | 2178 | 8290 | 64.2 | TCCCCTCATCTGGCTTTTAG | 28 | 13 | 8 | 17 3 | 0 |
| 6920 | 2287 | 2180 | 8295 | 68.4 | TCCCCTCACCATCCTAAGCC | 28 | 13 | 15 | 26 36 | 0 |
| 6921 | 2288 | 2181 | 30525 | 66.9 | TCCCCTCAGCTTAGGACGAA | 28 | 13 | 17 | 25 16 | 0 |
| 6922 | 2289 | 2182 | 8298 | 66.8 | TCCCCTCAACCTCCTACACG | 28 | 13 | 23 | 26 30 | 0 |
| 6923 | 2290 | 2184 | 8302 | 70.3 | TCCCCTCACACGATCGTCGT | 28 | 13 | 30 | 24 10 | 0 |
| 6924 | 2291 | 2185 | 8303 | 71.4 | TCCCCTCACAGCCTGTTCCC | 28 | 13 | 31 | 14 28 | 0 |
| 6925 | 2292 | 2186 | 30527 | 67.5 | TCCCCTGTTGATGCTTGACC | 28 | 14 | 2 | 17 32 | 0 |
| 6926 | 2293 | 2187 | 8308 | 68.3 | TCCCCTGTTCTGCCATGATG | 28 | 14 | 8 | 15 27 | 0 |
| 6927 | 2294 | 2188 | 40477 | 70.1 | TCCCCTGTTGTCGCAAGACC | 28 | 14 | 9 | 21 32 | 0 |
| 6928 | 2295 | 2189 | 30528 | 64.7 | TCCCCTGTTCGTACCTATCG | 28 | 14 | 10 | 23 24 | 0 |
| 6929 | 2296 | 2190 | 15784 | 69.3 | TCCCCTGTCGAAAAAGCGTT | 28 | 14 | 16 | 6 12 | 0 |
| 6930 | 2297 | 2191 | 8315 | 69.9 | TCCCCTGTGCAAAGTGGACC | 28 | 14 | 21 | 22 32 | 0 |
| 6931 | 2298 | 2192 | 30529 | 72 | TCCCCTGTAGGATCCCGCAA | 28 | 14 | 25 | 28 21 | 0 |
| 6932 | 2299 | 2193 | 40479 | 72 | TCCCCTGTCCTAAGCCTGCG | 28 | 14 | 26 | 36 29 | 0 |
| 6933 | 2300 | 2194 | 30530 | 72.8 | TCCCCTGTGATGGGACACGG | 28 | 14 | 27 | 34 35 | 0 |
| 6934 | 2301 | 2195 | 8320 | 71.1 | TCCCCTGTTGCGCTTGTGTC | 28 | 14 | 29 | 11 9 | 0 |
| 6935 | 2302 | 2196 | 8325 | 65.2 | TCCCCATTTGATCGTAGTG | 28 | 15 | 1 | 10 22 | 0 |
| 6936 | 2303 | 2198 | 8330 | 73.1 | TCCCCATCTTGTGCGGATG | 28 | 15 | 11 | 29 27 | 0 |
| 6937 | 2304 | 2199 | 8331 | 70.4 | TCCCCATCGTTGTCTCGAA | 28 | 15 | 12 | 19 16 | 0 |

*FIG. 29WW*

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 6938 | 2305 | 2200 | 30532 | 69.7 | TCCCCCATCTCAGACCATCG | 28 15 13 32 24 | | | | 0 |
| 6939 | 2306 | 2201 | 30533 | 73.1 | TCCCCCATGCTTCTTGCGAA | 28 15 17 11 16 | | | | 0 |
| 6940 | 2307 | 2202 | 40481 | 64.6 | TCCCCCATGGTATTGAAAAG | 28 15 18 1 6 | | | | 0 |
| 6941 | 2308 | 2203 | 8335 | 67.3 | TCCCCCATAGTGAGTGCGTT | 28 15 22 22 12 | | | | 0 |
| 6942 | 2309 | 2204 | 8336 | 74.6 | TCCCCCATTGCGAATCAGCC | 28 15 29 4 36 | | | | 0 |
| 6943 | 2310 | 2205 | 15792 | 70.3 | TCCCCCATGTGCCAGCTTAG | 28 15 33 31 3 | | | | 0 |
| 6944 | 2311 | 2206 | 21375 | 63.9 | TCCCCCATGGACACCTATAC | 28 15 34 23 5 | | | | 0 |
| 6945 | 2312 | 2208 | 40485 | 66.1 | TCCCCGAAATACAATCTCCC | 28 16 5 4 28 | | | | 0 |
| 6946 | 2313 | 2209 | 8346 | 69.4 | TCCCCGAAAAAGGCAAGGTA | 28 16 6 21 18 | | | | 0 |
| 6947 | 2314 | 2210 | 8347 | 68.1 | TCCCCGAATACAAGTGCAGC | 28 16 7 22 31 | | | | 0 |
| 6948 | 2315 | 2211 | 8350 | 72.5 | TCCCCGAACTTGGATGCAGC | 28 16 11 27 31 | | | | 0 |
| 6949 | 2316 | 2212 | 40486 | 69.1 | TCCCCGAAGCTTTTGACCAT | 28 16 17 1 15 | | | | 0 |
| 6950 | 2317 | 2213 | 40487 | 67 | TCCCCGAAGTCTGGTAGTGC | 28 16 19 18 33 | | | | 0 |
| 6951 | 2318 | 2214 | 15795 | 73.6 | TCCCCGAAAGTGGGACGGAC | 28 16 22 34 34 | | | | 0 |
| 6952 | 2319 | 2215 | 8359 | 70.4 | TCCCCGAATGCGATCGTTAG | 28 16 29 24 3 | | | | 0 |
| 6953 | 2320 | 2217 | 40490 | 71 | TCCCGCTTTTAGGACCGGAC | 28 17 3 32 34 | | | | 0 |
| 6954 | 2321 | 2218 | 21380 | 65.9 | TCCCGCTTTACACTGTACGG | 28 17 7 14 35 | | | | 0 |
| 6955 | 2322 | 2219 | 8367 | 70.6 | TCCCGCTTCGAAATCGTCTG | 28 17 16 24 8 | | | | 0 |
| 6956 | 2323 | 2220 | 8368 | 74.2 | TCCCGCTTGCTTGTGCGGTA | 28 17 17 33 18 | | | | 0 |
| 6957 | 2324 | 2221 | 30536 | 64.9 | TCCCGCTTGTCTAGGACTTG | 28 17 19 25 11 | | | | 0 |
| 6958 | 2325 | 2222 | 40494 | 69.7 | TCCCGCTTAGTGCTTGGACC | 28 17 22 11 32 | | | | 0 |
| 6959 | 2326 | 2223 | 8372 | 70.3 | TCCCGCTTATCGAGCCTTGA | 28 17 24 36 1 | | | | 0 |
| 6960 | 2327 | 2224 | 8375 | 73.3 | TCCCGCTTCACGATCGCCTA | 28 17 30 24 26 | | | | 0 |
| 6961 | 2328 | 2225 | 8376 | 70.5 | TCCCGCTTCAGCCTCAGATG | 28 17 31 13 27 | | | | 0 |
| 6962 | 2329 | 2226 | 15801 | 71.1 | TCCCGCTTAGCCTCTGGCTT | 28 17 36 8 17 | | | | 0 |
| 6963 | 2330 | 2227 | 15802 | 65.2 | TCCCGGTATGATCGAAGATG | 28 18 2 16 27 | | | | 0 |
| 6964 | 2331 | 2228 | 30537 | 69.6 | TCCCGGTAAATCCACGGGTA | 28 18 4 30 18 | | | | 0 |
| 6965 | 2332 | 2229 | 40498 | 68.9 | TCCCGGTATGTCCTTGGCTT | 28 18 9 11 17 | | | | 0 |
| 6966 | 2333 | 2230 | 40499 | 68.1 | TCCCGGTACTCAAATCTGCG | 28 18 13 4 29 | | | | 0 |
| 6967 | 2334 | 2231 | 30539 | 67.1 | TCCCGGTACTGTAGGAACGG | 28 18 14 25 35 | | | | 0 |
| 6968 | 2335 | 2232 | 40500 | 64 | TCCCGGTAGGTACCTAGTGC | 28 18 18 26 33 | | | | 0 |
| 6969 | 2336 | 2233 | 8391 | 68.5 | TCCCGGTAAGGAGCTTCGTT | 28 18 25 17 12 | | | | 0 |
| 6970 | 2337 | 2234 | 40503 | 64.5 | TCCCGGTACCTATTAGCAGC | 28 18 26 3 31 | | | | 0 |
| 6971 | 2338 | 2235 | 30541 | 65.3 | TCCCGGTAGATGTCGTTCTG | 28 18 27 10 8 | | | | 0 |
| 6972 | 2339 | 2236 | 8393 | 72 | TCCCGGTATGCGGGTAAGGA | 28 18 29 18 25 | | | | 0 |
| 6973 | 2340 | 2238 | 8398 | 71.1 | TCCCGGTAAGCCCCATCTGT | 28 18 36 15 14 | | | | 0 |
| 6974 | 2341 | 2239 | 15810 | 67.1 | TCCCGTCTTTGAGCTTGACC | 28 19 1 17 32 | | | | 0 |
| 6975 | 2342 | 2240 | 30542 | 74.3 | TCCCGTCTTGTCACGGTGCG | 28 19 9 35 29 | | | | 0 |
| 6976 | 2343 | 2241 | 40504 | 65.8 | TCCCGTCTTCGTAGTGCTTG | 28 19 10 22 11 | | | | 0 |
| 6977 | 2344 | 2242 | 40505 | 70.4 | TCCCGTCTCTCAACCTTGCG | 28 19 13 23 29 | | | | 0 |
| 6978 | 2345 | 2244 | 8406 | 69.2 | TCCCGTCTAGTGTCCCAGCC | 28 19 22 28 36 | | | | 1 |
| 6979 | 2346 | 2245 | 8407 | 67.3 | TCCCGTCTACCTCCTATGCG | 28 19 23 26 29 | | | | 0 |
| 6980 | 2347 | 2246 | 30544 | 71.4 | TCCCGTCTATCGCTCATGCG | 28 19 24 13 29 | | | | 0 |
| 6981 | 2348 | 2247 | 15812 | 65.2 | TCCCGTCTCCTAAGGAGACC | 28 19 26 25 32 | | | | 0 |
| 6982 | 2349 | 2248 | 8409 | 73 | TCCCGTCTTGCGCCATGAGT | 28 19 29 15 20 | | | | 0 |
| 6983 | 2350 | 2249 | 40506 | 67.4 | TCCCGTCTCACGACCTTGTC | 28 19 30 23 9 | | | | 0 |
| 6984 | 2351 | 2250 | 40507 | 68.9 | TCCCGTCTGGACTCTGGCTT | 28 19 34 8 17 | | | | 0 |
| 6985 | 2352 | 2251 | 15814 | 67.2 | TCCCGTCTACGGCTTGAATC | 28 19 35 11 4 | | | | 0 |

FIG. 29XX

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 6986 | 2353 | 2252 | 30545 | 69.4 | TCCCGTCTAGCCGAGTGACC | 28 | 19 | 36 | 20 | 32 | 0 |
| 6987 | 2354 | 2253 | 8412 | 65.1 | TCCCGAGTTGATCCATCTTG | 28 | 20 | 2 | 15 | 11 | 0 |
| 6988 | 2355 | 2255 | 30546 | 69.1 | TCCCGAGTCTTGATCGGCTT | 28 | 20 | 11 | 24 | 17 | 0 |
| 6989 | 2356 | 2256 | 15816 | 69.7 | TCCCGAGTCGAAGACCCTCA | 28 | 20 | 16 | 32 | 13 | 0 |
| 6990 | 2357 | 2257 | 40510 | 65.3 | TCCCGAGTATCGTCTGATCG | 28 | 20 | 24 | 8 | 24 | 0 |
| 6991 | 2358 | 2258 | 8420 | 72 | TCCCGAGTCAGCGACCACCT | 28 | 20 | 31 | 32 | 23 | 0 |
| 6992 | 2359 | 2259 | 30548 | 74.2 | TCCCGAGTGACCACGGGCTT | 28 | 20 | 32 | 35 | 17 | 0 |
| 6993 | 2360 | 2260 | 40511 | 69.4 | TCCCGAGTGTGCTGTCGATG | 28 | 20 | 33 | 9 | 27 | 0 |
| 6994 | 2361 | 2261 | 8424 | 72.2 | TCCCGAGTACGGGCAAAGGA | 28 | 20 | 35 | 21 | 25 | 0 |
| 6995 | 2362 | 2262 | 40512 | 66.1 | TCCCGCAATTGACGTTAAAG | 28 | 21 | 1 | 12 | 6 | 0 |
| 6996 | 2363 | 2263 | 40513 | 67.9 | TCCCGCAATTAGCCATCCTA | 28 | 21 | 3 | 15 | 26 | 0 |
| 6997 | 2364 | 2264 | 40514 | 70.2 | TCCCGCAAAATCGGACAATC | 28 | 21 | 4 | 34 | 4 | 0 |
| 6998 | 2365 | 2265 | 8429 | 66.4 | TCCCGCAATACAATCGAGTG | 28 | 21 | 7 | 24 | 22 | 0 |
| 6999 | 2366 | 2266 | 8431 | 68.2 | TCCCGCAACTTGAAAGATCG | 28 | 21 | 11 | 6 | 24 | 0 |
| 7000 | 2367 | 2267 | 8436 | 70.8 | TCCCGCAACGAAGTGCTGAT | 28 | 21 | 16 | 33 | 2 | 0 |
| 7001 | 2368 | 2268 | 8437 | 72.9 | TCCCGCAAGCTTTCTGGTGC | 28 | 21 | 17 | 8 | 33 | 0 |
| 7002 | 2369 | 2269 | 30549 | 71.6 | TCCCGCAAGAGTCCATGCAA | 28 | 21 | 20 | 15 | 21 | 0 |
| 7003 | 2370 | 2270 | 40515 | 68.6 | TCCCGCAAAGTGAGTGGATG | 28 | 21 | 22 | 22 | 27 | 0 |
| 7004 | 2371 | 2272 | 8442 | 76.2 | TCCCGCAACAGCGGACAGGA | 28 | 21 | 31 | 34 | 25 | 0 |
| 7005 | 2372 | 2273 | 8444 | 69.5 | TCCCGCAAGGACCCTACTTG | 28 | 21 | 34 | 26 | 11 | 0 |
| 7006 | 2373 | 2274 | 8445 | 72.6 | TCCCGCAAAGCCGGACATAC | 28 | 21 | 36 | 34 | 5 | 0 |
| 7007 | 2374 | 2275 | 8447 | 71.7 | TCCCAGTGCTCAGTGCCGAA | 28 | 22 | 13 | 33 | 16 | 0 |
| 7008 | 2375 | 2276 | 8448 | 69.7 | TCCCAGTGCTGTATCGCACG | 28 | 22 | 14 | 24 | 30 | 0 |
| 7009 | 2376 | 2277 | 8449 | 71.8 | TCCCAGTGCCATTCCCGAGT | 28 | 22 | 15 | 28 | 20 | 0 |
| 7010 | 2377 | 2278 | 40518 | 71.5 | TCCCAGTGGCAATCGTCGAA | 28 | 22 | 21 | 10 | 16 | 0 |
| 7011 | 2378 | 2279 | 8454 | 66.5 | TCCCAGTGCCTAGGACGTCT | 28 | 22 | 26 | 34 | 19 | 0 |
| 7012 | 2379 | 2280 | 40519 | 69 | TCCCAGTGTCCCCTAGTGC | 28 | 22 | 28 | 26 | 33 | 1 |
| 7013 | 2380 | 2281 | 8457 | 70.9 | TCCCAGTGCAGCGTCTCGTT | 28 | 22 | 31 | 19 | 12 | 0 |
| 7014 | 2381 | 2282 | 15826 | 69.5 | TCCCAGTGGGACAGTGGCTT | 28 | 22 | 34 | 22 | 17 | 0 |
| 7015 | 2382 | 2283 | 8459 | 72.1 | TCCCAGTGAGCCCGTTTCGT | 28 | 22 | 36 | 12 | 10 | 0 |
| 7016 | 2383 | 2284 | 21397 | 66.3 | ACCTTCTGAATCTCCCTGCG | 23 | 8 | 4 | 28 | 29 | 0 |
| 7017 | 2384 | 2285 | 8463 | 70.7 | TCCCACCTTGTCATCGGTGC | 28 | 23 | 9 | 24 | 33 | 0 |
| 7018 | 2385 | 2287 | 8470 | 69.1 | TCCCACCTGCAACACGTGTC | 28 | 23 | 21 | 30 | 9 | 0 |
| 7019 | 2386 | 2288 | 8471 | 64.8 | ACCTAGGACAGCTCTGCACG | 23 | 25 | 31 | 8 | 30 | 0 |
| 7020 | 2387 | 2289 | 15831 | 68.9 | ACCTGATGCTTGTCGTTGCG | 23 | 27 | 11 | 10 | 29 | 0 |
| 7021 | 2388 | 2290 | 8474 | 75 | TCCCACCTTCCCACGCTCA | 28 | 23 | 28 | 30 | 13 | 1 |
| 7022 | 2389 | 2291 | 21400 | 68.7 | TCCCACCTCAGCCTTGGAGT | 28 | 23 | 31 | 11 | 20 | 0 |
| 7023 | 2390 | 2292 | 8476 | 70.5 | TCCCACCTACGGTCGTCGAA | 28 | 23 | 35 | 10 | 16 | 0 |
| 7024 | 2391 | 2294 | 40523 | 68.6 | TCCCATCGCGTTGCTTAAAG | 28 | 24 | 12 | 17 | 6 | 0 |
| 7025 | 2392 | 2295 | 8483 | 73.8 | TCCCATCGCCATCAGCCTCA | 28 | 24 | 15 | 31 | 13 | 0 |
| 7026 | 2393 | 2296 | 30553 | 64.9 | ATCGGATGTTAGACCTTGCG | 24 | 27 | 3 | 23 | 29 | 0 |
| 7027 | 2394 | 2297 | 8489 | 70.6 | TCCCATCGTGCGAGGAGGTA | 28 | 24 | 29 | 25 | 18 | 0 |
| 7028 | 2395 | 2298 | 8490 | 75.4 | TCCCATCGCACGTGCGTTCCC | 28 | 24 | 30 | 10 | 28 | 0 |
| 7029 | 2396 | 2299 | 8491 | 73.5 | TCCCATCGCAGCCAGCAATC | 28 | 24 | 31 | 31 | 4 | 0 |
| 7030 | 2397 | 2300 | 15834 | 69.9 | TCCCATCGGACCTTGACAGC | 28 | 24 | 32 | 1 | 31 | 0 |
| 7031 | 2398 | 2301 | 8493 | 72.2 | TCCCATCGGGACCTCAATCG | 28 | 24 | 34 | 13 | 24 | 0 |
| 7032 | 2399 | 2302 | 30554 | 75 | TCCCATCGAGCCATCGCCAT | 28 | 24 | 36 | 24 | 15 | 0 |
| 7033 | 2400 | 2303 | 40528 | 73.3 | TCCCAGGACTTGGTGCGTGC | 28 | 25 | 11 | 33 | 33 | 0 |

FIG. 29YY

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7034 | 2401 | 2305 | 15836 | 71.1 | TCCCAGGAGCTTACGGAGCC | 28 | 25 | 17 | 35 36 | 0 |
| 7035 | 2402 | 2306 | 40529 | 65.2 | AGGAGGTATTAGTGCGTGCG | 25 | 18 | 3 | 29 29 | 0 |
| 7036 | 2403 | 2307 | 8506 | 67.9 | TCCCAGGAGAGTGGACTCCC | 28 | 25 | 20 | 34 28 | 0 |
| 7037 | 2404 | 2308 | 15837 | 69.9 | TCCCAGGAACCTCGAAGCAA | 28 | 25 | 23 | 16 21 | 0 |
| 7038 | 2405 | 2309 | 40531 | 74.3 | TCCCAGGAGATGTGCGTGCG | 28 | 25 | 27 | 29 29 | 0 |
| 7039 | 2406 | 2310 | 8510 | 70.1 | TCCCAGGATCCCCCTAAGGA | 28 | 25 | 28 | 26 25 | 0 |
| 7040 | 2407 | 2311 | 8511 | 73.9 | TCCCAGGATGCGAATCGCAA | 28 | 25 | 29 | 4 21 | 0 |
| 7041 | 2408 | 2312 | 30559 | 68.6 | TCCCCCTATGATCGAAAGCC | 28 | 26 | 2 | 16 36 | 0 |
| 7042 | 2409 | 2313 | 30560 | 66.5 | TCCCCCTACGTTCCTAATCG | 28 | 26 | 12 | 26 24 | 0 |
| 7043 | 2410 | 2314 | 40535 | 70.1 | TCCCCCTACTCAGTGCACGG | 28 | 26 | 13 | 33 35 | 0 |
| 7044 | 2411 | 2315 | 30561 | 69.1 | TCCCCCTAGCTTCACGGGTA | 28 | 26 | 17 | 30 18 | 0 |
| 7045 | 2412 | 2316 | 30562 | 66.6 | TCCCCCTAGGTAGAGTTGCG | 28 | 26 | 18 | 20 29 | 0 |
| 7046 | 2413 | 2317 | 8528 | 75.5 | TCCCCCTATGCGGATGTGCG | 28 | 26 | 29 | 27 29 | 0 |
| 7047 | 2414 | 2318 | 8531 | 66.8 | TCCCCCTAGACCATACACGG | 28 | 26 | 32 | 5 35 | 0 |
| 7048 | 2415 | 2319 | 40538 | 66.3 | TCCCCCTAGGACAATCCTCA | 28 | 26 | 34 | 4 13 | 0 |
| 7049 | 2416 | 2320 | 8532 | 71.5 | TCCCCCTAACGGCTGTGGAC | 28 | 26 | 35 | 14 34 | 0 |
| 7050 | 2417 | 2321 | 30563 | 69.4 | TCCCGATGTTGATCCCCCTA | 28 | 27 | 1 | 28 26 | 0 |
| 7051 | 2418 | 2322 | 21415 | 65 | TCCCGATGTTAGCTGTAGCC | 28 | 27 | 3 | 14 36 | 0 |
| 7052 | 2419 | 2323 | 15848 | 68.8 | TCCCGATGTGTCACGGTGTC | 28 | 27 | 9 | 35 9 | 0 |
| 7053 | 2420 | 2324 | 8539 | 67 | TCCCGATGCTGTAAAGGGAC | 28 | 27 | 14 | 6 34 | 0 |
| 7054 | 2421 | 2325 | 8541 | 68.9 | TCCCGATGGGTAAGTGTCCC | 28 | 27 | 18 | 22 28 | 1 |
| 7055 | 2422 | 2326 | 15849 | 67.5 | TCCCGATGGAGTTGTCCTTG | 28 | 27 | 20 | 9 11 | 0 |
| 7056 | 2423 | 2327 | 30564 | 70.6 | TCCCGATGGCAAGCAAAAAG | 28 | 27 | 21 | 21 6 | 0 |
| 7057 | 2424 | 2328 | 8545 | 70.6 | TCCCGATGATCGGGACAGTG | 28 | 27 | 24 | 34 22 | 0 |
| 7058 | 2425 | 2329 | 8548 | 70.3 | TCCCGATGTGCGATACCCAT | 28 | 27 | 29 | 5 15 | 0 |
| 7059 | 2426 | 2330 | 8549 | 75.4 | TCCCGATGCACGGGACCTTG | 28 | 27 | 30 | 34 11 | 0 |
| 7060 | 2427 | 2331 | 15852 | 75 | TCCCGATGGACCGCAACGTT | 28 | 27 | 32 | 21 12 | 0 |
| 7061 | 2428 | 2332 | 8552 | 71.4 | TCCCGATGGGACCCTACAGC | 28 | 27 | 34 | 26 31 | 0 |
| 7062 | 2429 | 2333 | 8553 | 71 | TCCCGATGACGGCTCACTTG | 28 | 27 | 35 | 13 11 | 0 |
| 7063 | 2430 | 2334 | 15853 | 70.6 | TCCCGATGAGCCTGCGTTAG | 28 | 27 | 36 | 29 3 | 0 |
| 7064 | 2431 | 2335 | 40540 | 67.9 | TCCCTGATACCTCAGCGTGC | 28 | 2 | 23 | 31 33 | 0 |
| 7065 | 2432 | 2336 | 30565 | 71.4 | TCCCTACAGTGCGCAAACGG | 28 | 7 | 33 | 21 35 | 0 |
| 7066 | 2433 | 2337 | 8558 | 68.8 | TCCCTCCCTGTCCCTACGAA | 28 | 28 | 9 | 26 16 | 0 |
| 7067 | 2434 | 2338 | 40541 | 67.8 | TCCCCTTGTTAGGGACCCAT | 28 | 11 | 3 | 34 15 | 0 |
| 7068 | 2435 | 2339 | 8560 | 70.8 | TCCCTCCCCTCACGTTCCAT | 28 | 28 | 13 | 12 15 | 0 |
| 7069 | 2436 | 2340 | 8561 | 71.9 | TCCCTCCCCTGTGTGCGAGT | 28 | 28 | 14 | 33 20 | 0 |
| 7070 | 2437 | 2341 | 30566 | 70.7 | TCCCCGAATTAGCTGTTGCG | 28 | 16 | 3 | 14 29 | 0 |
| 7071 | 2438 | 2342 | 8566 | 71.7 | TCCCTCCCATCGCCTAATCG | 28 | 28 | 24 | 26 24 | 0 |
| 7072 | 2439 | 2343 | 30567 | 71.4 | TCCCTCCCAGGATTGAACGG | 28 | 28 | 25 | 1 35 | 0 |
| 7073 | 2440 | 2344 | 8568 | 67.9 | TCCCTCCCGATGAAAGACCT | 28 | 28 | 27 | 6 23 | 0 |
| 7074 | 2441 | 2345 | 21423 | 71.7 | TCCCTCCCACGGAATCAGGA | 28 | 28 | 35 | 4 25 | 0 |
| 7075 | 2442 | 2346 | 40543 | 69.3 | TCCCTGCGTGATAGTGGCAA | 28 | 29 | 2 | 22 21 | 0 |
| 7076 | 2443 | 2347 | 30568 | 71.4 | TGCGATACGTGCAATCGCAA | 29 | 5 | 33 | 4 21 | 0 |
| 7077 | 2444 | 2348 | 30569 | 71.1 | TCCCTGCGAAAGAGTGCGAA | 28 | 29 | 6 | 22 16 | 0 |
| 7078 | 2445 | 2349 | 40544 | 68.2 | TGCGTACACCATATCGTGCG | 29 | 7 | 15 | 24 29 | 0 |
| 7079 | 2446 | 2350 | 40545 | 70.6 | TGCGTGTCAGTGCTTGGTGC | 29 | 9 | 22 | 11 33 | 0 |
| 7080 | 2447 | 2351 | 8575 | 68 | TGCGCTTGAGGAATACCGTT | 29 | 11 | 25 | 5 12 | 0 |
| 7081 | 2448 | 2352 | 8578 | 74 | TGCGCGAACACGTGATCACG | 29 | 16 | 30 | 2 30 | 0 |

FIG. 29ZZ

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7082 | 2449 | 2353 | 8579 | 70.8 | TGCGGCTTTTGAAGTGAGCC | 29 | 17 | 1 | 22 36 | 0 |
| 7083 | 2450 | 2354 | 8581 | 73.1 | TCCCTGCGGCAACGTTGTCT | 28 | 29 | 21 | 12 19 | 0 |
| 7084 | 2451 | 2355 | 8582 | 73.6 | TCCCTGCGACCTGCAAATCG | 28 | 29 | 23 | 21 24 | 0 |
| 7085 | 2452 | 2356 | 40547 | 71.2 | TGCGAGGAGAGTGTGCGGAC | 29 | 25 | 20 | 33 34 | 0 |
| 7086 | 2453 | 2357 | 15859 | 76.2 | TCCCTGCGTCCCGAGTGCAA | 28 | 29 | 28 | 20 21 | 0 |
| 7087 | 2454 | 2358 | 8585 | 75.2 | TCCCTGCGCACGGGTACGTT | 28 | 29 | 30 | 18 12 | 0 |
| 7088 | 2455 | 2359 | 8586 | 73.3 | TCCCTGCGCAGCCTGTAGGA | 28 | 29 | 31 | 14 25 | 0 |
| 7089 | 2456 | 2360 | 8587 | 74.8 | TCCCTGCGGACCCTGTCAGC | 28 | 29 | 32 | 14 31 | 0 |
| 7090 | 2457 | 2361 | 8588 | 79.4 | TCCCTGCGGTGCGCTTGCAA | 28 | 29 | 33 | 17 21 | 0 |
| 7091 | 2458 | 2362 | 30570 | 72.3 | TCCCCACGTTGACAGCTCCC | 28 | 30 | 1 | 31 28 | 0 |
| 7092 | 2459 | 2363 | 30571 | 65.4 | TCCCCACGTTAGTCGTCTTG | 28 | 30 | 3 | 10 11 | 0 |
| 7093 | 2460 | 2366 | 8593 | 75.3 | TCCCCACGTCTGGGACACGG | 28 | 30 | 8 | 34 35 | 0 |
| 7094 | 2461 | 2367 | 8594 | 69.2 | TCCCCACGTCGTGTGCATAC | 28 | 30 | 10 | 33 5 | 0 |
| 7095 | 2462 | 2368 | 8596 | 72.6 | TCCCCACGCTGTTCTGAGCC | 28 | 30 | 14 | 8 36 | 0 |
| 7096 | 2463 | 2370 | 21430 | 72.9 | TCCCCACGGGTATCCCCTGT | 28 | 30 | 18 | 28 14 | 0 |
| 7097 | 2464 | 2371 | 8598 | 73.3 | TCCCCACGGTCTCAGCATCG | 28 | 30 | 19 | 31 24 | 0 |
| 7098 | 2465 | 2372 | 8599 | 75.5 | TCCCCACGGCAAAATCGTGC | 28 | 30 | 21 | 4 33 | 0 |
| 7099 | 2466 | 2373 | 8600 | 67.6 | TCCCCACGACCTAATCGATG | 28 | 30 | 23 | 4 27 | 0 |
| 7100 | 2467 | 2374 | 8601 | 72.7 | TCCCCACGATCGCGAATGAT | 28 | 30 | 24 | 16 2 | 0 |
| 7101 | 2468 | 2375 | 8602 | 74.9 | TCCCCACGCCTAGTGCAGCC | 28 | 30 | 26 | 33 36 | 0 |
| 7102 | 2469 | 2376 | 8604 | 73.6 | TCCCCACGTGCGTGATTCGT | 28 | 30 | 29 | 2 10 | 0 |
| 7103 | 2470 | 2377 | 8605 | 75.8 | TCCCCACGCAGCCGTTCTTG | 28 | 30 | 31 | 12 11 | 0 |
| 7104 | 2471 | 2378 | 8606 | 72.7 | TCCCCACGGACCAGCCTACA | 28 | 30 | 32 | 36 7 | 0 |
| 7105 | 2472 | 2379 | 8607 | 76.6 | TCCCCACGGTGCTGTCTGCG | 28 | 30 | 33 | 9 29 | 0 |
| 7106 | 2473 | 2380 | 8608 | 75.9 | TCCCCACGGGACCCATCGTT | 28 | 30 | 34 | 15 12 | 0 |
| 7107 | 2474 | 2381 | 30572 | 68.6 | TCCCCAGCTTGAAAAGGACC | 28 | 31 | 1 | 6 32 | 0 |
| 7108 | 2475 | 2382 | 8611 | 72.8 | TCCCCAGCAATCGGACGGTA | 28 | 31 | 4 | 34 18 | 0 |
| 7109 | 2476 | 2383 | 30573 | 65.4 | TCCCCAGCTACAGCAAAAAG | 28 | 31 | 7 | 21 6 | 0 |
| 7110 | 2477 | 2384 | 8615 | 68.8 | TCCCCAGCTCTGATCGGTCT | 28 | 31 | 8 | 24 19 | 0 |
| 7111 | 2478 | 2385 | 8616 | 68.4 | TCCCCAGCTCGTCTGTGATG | 28 | 31 | 10 | 14 27 | 0 |
| 7112 | 2479 | 2386 | 8617 | 70.4 | TCCCCAGCCTTGCTGTATCG | 28 | 31 | 11 | 14 24 | 0 |
| 7113 | 2480 | 2387 | 8619 | 75.3 | TCCCCAGCCGAAGTGCCTCA | 28 | 31 | 16 | 33 13 | 0 |
| 7114 | 2481 | 2388 | 8621 | 71.8 | TCCCCAGCGGGTAAGGACAGC | 28 | 31 | 18 | 25 31 | 0 |
| 7115 | 2482 | 2389 | 15863 | 70.1 | TCCCCAGCACCTAATCACGG | 28 | 31 | 23 | 4 35 | 0 |
| 7116 | 2483 | 2390 | 8623 | 73.4 | TCCCCAGCATCGGATGCTTG | 28 | 31 | 24 | 27 11 | 0 |
| 7117 | 2484 | 2391 | 30574 | 68.7 | TCCCCAGCAGGAGAGTAGCC | 28 | 31 | 25 | 20 36 | 0 |
| 7118 | 2485 | 2392 | 8627 | 70.1 | TCCCCAGCCAGCTCTGTGTC | 28 | 31 | 31 | 8 9 | 0 |
| 7119 | 2486 | 2393 | 21442 | 74.5 | TCCCCAGCGGACCGAATGTC | 28 | 31 | 34 | 16 9 | 0 |
| 7120 | 2487 | 2394 | 8629 | 73.8 | TCCCCAGCAGCCGGTAGCTT | 28 | 31 | 36 | 18 17 | 0 |
| 7121 | 2488 | 2395 | 8631 | 64.8 | TCCCGACCTGATTGATTGTC | 28 | 32 | 2 | 2 9 | 0 |
| 7122 | 2489 | 2396 | 15865 | 67.2 | TCCCGACCTTAGAATCGTGC | 28 | 32 | 3 | 4 33 | 0 |
| 7123 | 2490 | 2397 | 40549 | 66.6 | TCCCGACCAATCTTGAGACC | 28 | 32 | 4 | 1 32 | 0 |
| 7124 | 2491 | 2398 | 8634 | 67.7 | TCCCGACCTACATTGAACGG | 28 | 32 | 7 | 1 35 | 0 |
| 7125 | 2492 | 2399 | 8635 | 71 | TCCCGACCTGTCTCCCGAGT | 28 | 32 | 9 | 28 20 | 0 |
| 7126 | 2493 | 2400 | 40550 | 71.5 | TCCCGACCCGTTTTAGCGTT | 28 | 32 | 12 | 3 12 | 0 |
| 7127 | 2494 | 2401 | 21445 | 69.8 | TCCCGACCCTCAGGTAGCAA | 28 | 32 | 13 | 18 21 | 0 |
| 7128 | 2495 | 2402 | 15866 | 66.8 | TCCCGACCCTGTAGGACTTG | 28 | 32 | 14 | 25 11 | 0 |
| 7129 | 2496 | 2404 | 40551 | 68.5 | TCCCGACCGTCTAAAGGACC | 28 | 32 | 19 | 6 32 | 0 |

FIG. 29AAA

| SEQ ID NO: | ZIP ID# | 4,633 ID# | HEX ID# | Tm | ZIPCOD3 (NH2 -> CONH2) | TETRAMER NUMBERS | | | | "UNALLOWED DIMERS" |
|---|---|---|---|---|---|---|---|---|---|---|
| 7130 | 2497 | 2405 | 8641 | 73.5 | TCCCGACCGAGTGTCTTGCG | 28 | 32 | 20 | 19 | 29 | 0 |
| 7131 | 2498 | 2406 | 8642 | 72.6 | TCCCGACCGCAAAGGAGATG | 28 | 32 | 21 | 25 | 27 | 0 |
| 7132 | 2499 | 2407 | 8646 | 67 | TCCCGACCCCTAATACGATG | 28 | 32 | 26 | 5 | 27 | 0 |
| 7133 | 2500 | 2408 | 15867 | 79.8 | TCCCGACCCACGGTGCAGCC | 28 | 32 | 30 | 33 | 36 | 0 |
| 7134 | 2501 | 2409 | 8648 | 66.1 | TCCCGTGCTTGATCTGAGTG | 28 | 33 | 1 | 8 | 22 | 0 |
| 7135 | 2502 | 2410 | 40555 | 65 | TCCCGTGCTTAGTGATAGCC | 28 | 33 | 3 | 2 | 36 | 0 |
| 7136 | 2503 | 2411 | 30576 | 72.7 | TCCCGTGCTGTCCCATCGTT | 28 | 33 | 9 | 15 | 12 | 0 |
| 7137 | 2504 | 2412 | 8651 | 73.4 | TCCCGTGCCTCAAATCGTGC | 28 | 33 | 13 | 4 | 33 | 0 |
| 7138 | 2505 | 2413 | 8652 | 73.9 | TCCCGTGCCGAACGAACTCA | 28 | 33 | 16 | 16 | 13 | 0 |
| 7139 | 2506 | 2414 | 40558 | 71.2 | TCCCGTGCGTCTCTGTACGG | 28 | 33 | 19 | 14 | 35 | 0 |
| 7140 | 2507 | 2415 | 8655 | 69.2 | TCCCGTGCACCTGTCTGATG | 28 | 33 | 23 | 19 | 27 | 0 |
| 7141 | 2508 | 2416 | 8659 | 78 | TCCCGTGCTCCCGCTTGTGC | 28 | 33 | 28 | 17 | 33 | 0 |
| 7142 | 2509 | 2417 | 8661 | 71.1 | TCCCGTGCGACCTTGAAGTG | 28 | 33 | 32 | 1 | 22 | 0 |
| 7143 | 2510 | 2418 | 15868 | 73.7 | TCCCGTGCGTGCTTAGGTGC | 28 | 33 | 33 | 3 | 33 | 0 |
| 7144 | 2511 | 2419 | 8663 | 73.2 | TCCCGTGCACGGAAAGCCTA | 28 | 33 | 35 | 6 | 26 | 0 |
| 7145 | 2512 | 2420 | 8664 | 70.4 | TCCCGTGCAGCCAGGATTAG | 28 | 33 | 36 | 25 | 3 | 0 |
| 7146 | 2513 | 2423 | 8667 | 70.3 | TCCCGGACAATCATCGAGGA | 28 | 34 | 4 | 24 | 25 | 0 |
| 7147 | 2514 | 2424 | 30577 | 67.4 | TCCCGGACATACTGTCGGAC | 28 | 34 | 5 | 9 | 34 | 0 |
| 7148 | 2515 | 2425 | 21453 | 66.3 | TCCCGGACAAAGTCCCTTAG | 28 | 34 | 6 | 28 | 3 | 1 |
| 7149 | 2516 | 2426 | 8669 | 67.7 | TCCCGGACTACACTTGACGG | 28 | 34 | 7 | 11 | 35 | 0 |
| 7150 | 2517 | 2427 | 40559 | 71.5 | TCCCGGACTCGTCGAAGACC | 28 | 34 | 10 | 16 | 32 | 0 |
| 7151 | 2518 | 2428 | 8672 | 72.8 | TCCCGGACCTTGCCATCTCA | 28 | 34 | 11 | 15 | 13 | 0 |
| 7152 | 2519 | 2429 | 8673 | 76.1 | TCCCGGACCGTTCACGCTCA | 28 | 34 | 12 | 30 | 13 | 0 |
| 7153 | 2520 | 2430 | 40561 | 66 | TCCCGGACGTCTATACTCCC | 28 | 34 | 19 | 5 | 28 | 0 |
| 7154 | 2521 | 2431 | 8678 | 70.3 | TCCCGGACATCGGAGTCTCA | 28 | 34 | 24 | 20 | 13 | 0 |
| 7155 | 2522 | 2432 | 30578 | 73.2 | TCCCGGACGATGCCATATCG | 28 | 34 | 27 | 15 | 24 | 0 |
| 7156 | 2523 | 2433 | 8682 | 72.1 | TCCCGGACTGCGAATCCCTA | 28 | 34 | 29 | 4 | 26 | 0 |
| 7157 | 2524 | 2434 | 8683 | 73.6 | TCCCGGACCACGTTGACGAA | 28 | 34 | 30 | 1 | 16 | 0 |
| 7158 | 2525 | 2435 | 8684 | 74.6 | TCCCGGACGACCGGACAAAG | 28 | 34 | 32 | 34 | 6 | 0 |
| 7159 | 2526 | 2436 | 8685 | 71.1 | TCCCGGACGTGCAAAGTCTG | 28 | 34 | 33 | 6 | 8 | 0 |
| 7160 | 2527 | 2437 | 8686 | 77.3 | TCCCGGACGGACGCAAAGGA | 28 | 34 | 34 | 21 | 25 | 0 |
| 7161 | 2528 | 2438 | 8687 | 73.9 | TCCCGGACAGCCACCTAGCC | 28 | 34 | 36 | 23 | 36 | 0 |
| 7162 | 2529 | 2439 | 15871 | 65.4 | TCCCACGGTTGACTGTAGGA | 28 | 35 | 1 | 14 | 25 | 1 |
| 7163 | 2530 | 2441 | 8696 | 74.5 | TCCCACGGGCTTTCTGCGTT | 28 | 35 | 17 | 8 | 12 | 0 |
| 7164 | 2531 | 2442 | 8697 | 68.9 | TCCCACGGGTCTGGTAGCTT | 28 | 35 | 19 | 18 | 17 | 0 |
| 7165 | 2532 | 2443 | 40565 | 69.1 | TCCCACGGCCTATCCCATAC | 28 | 35 | 26 | 28 | 5 | 0 |
| 7166 | 2533 | 2445 | 8704 | 71.2 | ACGGTGCGCCTAATACGCAA | 35 | 29 | 26 | 5 | 21 | 0 |
| 7167 | 2534 | 2446 | 21461 | 70.1 | ACGGGACCATACCTGTTGCG | 35 | 32 | 5 | 14 | 29 | 0 |
| 7168 | 2535 | 2447 | 8708 | 71 | TCCCACGGGTGCATCGTTAG | 28 | 35 | 33 | 24 | 3 | 0 |
| 7169 | 2536 | 2448 | 40566 | 67.8 | TCCCAGCCTTGATCTGATCG | 28 | 36 | 1 | 8 | 24 | 0 |
| 7170 | 2537 | 2449 | 30579 | 71.9 | TCCCAGCCTGATGATGTGCG | 28 | 36 | 2 | 27 | 29 | 0 |
| 7171 | 2538 | 2450 | 8709 | 65.1 | TCCCAGCCTTAGAGTGCTTG | 28 | 36 | 3 | 22 | 11 | 0 |
| 7172 | 2539 | 2451 | 40567 | 68.5 | TCCCAGCCATACAATCACGG | 28 | 36 | 5 | 4 | 35 | 0 |
| 7173 | 2540 | 2453 | 30580 | 67.8 | TCCCAGCCTCTGTTGAGTGC | 28 | 36 | 8 | 1 | 33 | 0 |
| 7174 | 2541 | 2454 | 8711 | 70.3 | TCCCAGCCTCGTGTCTACGG | 28 | 36 | 10 | 19 | 35 | 0 |
| 7175 | 2542 | 2455 | 15874 | 68.4 | TCCCAGCCCTCATTAGTCCC | 28 | 36 | 13 | 3 | 28 | 0 |
| 7176 | 2543 | 2456 | 8716 | 70.8 | TCCCAGCCGCTTCCTAACCT | 28 | 36 | 17 | 26 | 23 | 0 |
| 7177 | 2544 | 2457 | 30581 | 68.6 | TCCCAGCCGGTATTAGGACC | 28 | 36 | 18 | 3 | 32 | 0 |

FIG. 29BBB

| SEQ ID NO: | ZIP ID# | 4,633 ID# | HEX ID# | Tm | ZIPCODE (NH2 -> CONH2) | T3TRAMER NUMBERS | | | | "UNALLOWED DIMERS" |
|---|---|---|---|---|---|---|---|---|---|---|
| 7178 | 2545 | 2458 | 30583 | 65.4 | TCCCAGCCAGTGTTAGCCTA | 28 | 36 | 22 | 3 26 | 0 |
| 7179 | 2546 | 2459 | 8718 | 68.1 | TCCCAGCCACCTATACTGCG | 28 | 36 | 23 | 5 29 | 0 |
| 7180 | 2547 | 2460 | 8719 | 72.8 | TCCCAGCCATCGGTGCTGAT | 28 | 36 | 24 | 33 2 | 0 |
| 7181 | 2548 | 2462 | 8721 | 71 | TCCCAGCCTCCCACCTTGAT | 28 | 36 | 28 | 23 2 | 0 |
| 7182 | 2549 | 2463 | 8722 | 75.9 | TCCCAGCCCACGGGTAAGCC | 28 | 36 | 30 | 18 36 | 0 |
| 7183 | 2550 | 2464 | 8723 | 74.7 | TCCCAGCCCAGCCTTGGATG | 28 | 36 | 31 | 11 27 | 0 |
| 7184 | 2551 | 2465 | 8724 | 73.2 | TCCCAGCCGTGCAAAGAGGA | 28 | 36 | 33 | 6 25 | 0 |
| 7185 | 2552 | 2466 | 21468 | 64 | TGCGTTGATTGAGAGTACGG | 29 | 1 | 1 | 20 35 | 0 |
| 7186 | 2553 | 2467 | 40569 | 70.1 | TGCGTTGAAAAGATCGTGCG | 29 | 1 | 6 | 24 29 | 0 |
| 7187 | 2554 | 2469 | 8729 | 64.4 | TGCGTTGACGTTCTGTCCTA | 29 | 1 | 12 | 14 26 | 0 |
| 7188 | 2555 | 2470 | 40571 | 67.3 | TGCGTTGACCATTCGTATCG | 29 | 1 | 15 | 10 24 | 0 |
| 7189 | 2556 | 2472 | 15879 | 71.3 | TGCGTTGACACGCGTTTTGA | 29 | 1 | 30 | 12 1 | 1 |
| 7190 | 2557 | 2473 | 15881 | 70.9 | TGCGTTGAGGACGATGTCCC | 29 | 1 | 34 | 27 28 | 0 |
| 7191 | 2558 | 2474 | 8740 | 72.9 | TGCGTTGAAGCCAGTGCGAA | 29 | 1 | 36 | 22 16 | 0 |
| 7192 | 2559 | 2475 | 15882 | 69.7 | TGCGTGATTGTCCAGCCTTG | 29 | 2 | 9 | 31 11 | 0 |
| 7193 | 2560 | 2476 | 15883 | 69.9 | TGCGTGATCTTGGGACTCCC | 29 | 2 | 11 | 34 28 | 0 |
| 7194 | 2561 | 2478 | 30585 | 70.7 | TGCGTGATGCTTTCCCACCT | 29 | 2 | 17 | 28 23 | 0 |
| 7195 | 2562 | 2480 | 8750 | 69.7 | TGCGTGATGAGTCAGCCAGC | 29 | 2 | 20 | 31 31 | 0 |
| 7196 | 2563 | 2481 | 40575 | 68 | TGATGCAACTGTCCATTGCG | 2 | 21 | 14 | 15 29 | 0 |
| 7197 | 2564 | 2483 | 30586 | 68.6 | TGCGTGATTCCCACCTCTTG | 29 | 2 | 28 | 23 11 | 0 |
| 7198 | 2565 | 2484 | 40576 | 69.3 | TGCGTGATGGACCCATATCG | 29 | 2 | 34 | 15 24 | 0 |
| 7199 | 2566 | 2485 | 40577 | 69.6 | TGATAGCCCAGCAATCGCAA | 2 | 36 | 31 | 4 21 | 0 |
| 7200 | 2567 | 2486 | 21481 | 65.7 | TGCGTTAGTTGAGACCGCTT | 29 | 3 | 1 | 32 17 | 0 |
| 7201 | 2568 | 2487 | 8756 | 68.2 | TGCGTTAGAAAGGACCCACG | 29 | 3 | 6 | 32 30 | 0 |
| 7202 | 2569 | 2488 | 8758 | 69.1 | TGCGTTAGCGAATGTCGGAC | 29 | 3 | 16 | 9 34 | 0 |
| 7203 | 2570 | 2489 | 40578 | 68.4 | TGCGTTAGGCTTTCCCAGTG | 29 | 3 | 17 | 28 22 | 0 |
| 7204 | 2571 | 2490 | 30588 | 67.5 | TTAGTGCGCGAAATACTGCG | 3 | 29 | 16 | 5 29 | 0 |
| 7205 | 2572 | 2491 | 8765 | 67.5 | TGCGTTAGGTGCTTGAGCAA | 29 | 3 | 33 | 1 21 | 0 |
| 7206 | 2573 | 2492 | 30589 | 72.2 | TGCGTTAGACGGGATGTGCG | 29 | 3 | 35 | 27 29 | 0 |
| 7207 | 2574 | 2493 | 8768 | 69.5 | TGCGTTAGAGCCGCTTGATG | 29 | 3 | 36 | 17 27 | 0 |
| 7208 | 2575 | 2494 | 30590 | 67.9 | TGCGAATCAAAGATCGTCCC | 29 | 4 | 6 | 24 28 | 0 |
| 7209 | 2576 | 2495 | 30591 | 69.9 | TGCGAATCTCGTTCGTCACG | 29 | 4 | 10 | 10 30 | 0 |
| 7210 | 2577 | 2496 | 40581 | 70.7 | TGCGAATCCTCAGACCCGAA | 29 | 4 | 13 | 32 16 | 0 |
| 7211 | 2578 | 2498 | 30592 | 71.9 | TGCGAATCCCATTCCCGTCT | 29 | 4 | 15 | 28 19 | 0 |
| 7212 | 2579 | 2499 | 40582 | 71.6 | TGCGAATCGAGTAGCCGTGC | 29 | 4 | 20 | 36 33 | 0 |
| 7213 | 2580 | 2500 | 8780 | 73.5 | TGCGAATCAGTGCAGCTGCG | 29 | 4 | 22 | 31 29 | 0 |
| 7214 | 2581 | 2501 | 8782 | 72.7 | TGCGAATCCACGCGAACTCA | 29 | 4 | 30 | 16 13 | 0 |
| 7215 | 2582 | 2502 | 40583 | 63.5 | TGCGATACGGTATGATAGCC | 29 | 5 | 18 | 2 36 | 0 |
| 7216 | 2583 | 2504 | 30593 | 69 | TGCGATACGCAACTGTGCAA | 29 | 5 | 21 | 14 21 | 0 |
| 7217 | 2584 | 2505 | 40584 | 66.1 | TGCGATACCCTAGCTTGTGC | 29 | 5 | 26 | 17 33 | 0 |
| 7218 | 2585 | 2506 | 8794 | 70.4 | TGCGATACGATGGCTTTCCC | 29 | 5 | 27 | 17 28 | 0 |
| 7219 | 2586 | 2508 | 30594 | 69.6 | TGCGAAAGAAAGTCCCGCTT | 29 | 6 | 6 | 28 17 | 1 |
| 7220 | 2587 | 2509 | 40586 | 70.1 | TGCGAAAGTCGTCTTGTGCG | 29 | 6 | 10 | 11 29 | 0 |
| 7221 | 2588 | 2510 | 15896 | 72.3 | TGCGAAAGCGTTGGACATCG | 29 | 6 | 12 | 34 24 | 0 |
| 7222 | 2589 | 2511 | 40587 | 69 | TGCGAAAGGGTATCGTCACG | 29 | 6 | 18 | 10 30 | 0 |
| 7223 | 2590 | 2512 | 30595 | 69.9 | TGCGAAAGGAGTGATGCACG | 29 | 6 | 20 | 27 30 | 0 |
| 7224 | 2591 | 2513 | 40588 | 65.4 | TGCGAAAGACCTTTAGACGG | 29 | 6 | 23 | 3 35 | 0 |
| 7225 | 2592 | 2514 | 8806 | 69.9 | TGCGAAAGTCCCCGTTGAGT | 29 | 6 | 28 | 12 20 | 1 |

FIG. 29CCC

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7226 | 2593 | 2516 | 8809 | 68.1 | TGCGTACAAAAGTGCGCTTG | 29 | 7 | 6 | 29 11 | 0 |
| 7227 | 2594 | 2518 | 8811 | 67.9 | TGCGTACAACCTACGGTCCC | 29 | 7 | 23 | 35 28 | 1 |
| 7228 | 2595 | 2519 | 8816 | 71.9 | TGCGTACAGACCACGGACGG | 29 | 7 | 32 | 35 35 | 0 |
| 7229 | 2596 | 2521 | 8819 | 68.1 | TGCGTCTGTTGATCCCGAGT | 29 | 8 | 1 | 28 20 | 0 |
| 7230 | 2597 | 2522 | 8820 | 71.3 | TGCGTCTGTGATGTGCACGG | 29 | 8 | 2 | 33 35 | 0 |
| 7231 | 2598 | 2523 | 8824 | 70.7 | TGCGTCTGTGTCTGCGATCG | 29 | 8 | 9 | 29 24 | 0 |
| 7232 | 2599 | 2524 | 40589 | 67.2 | TGCGTCTGTCGTCCTACACG | 29 | 8 | 10 | 26 30 | 0 |
| 7233 | 2600 | 2525 | 40590 | 69.2 | TGCGTCTGCTTGAAAGGTGC | 29 | 8 | 11 | 6 33 | 0 |
| 7234 | 2601 | 2526 | 30597 | 72.4 | TGCGTCTGCTCAAGGATGCG | 29 | 8 | 13 | 25 29 | 0 |
| 7235 | 2602 | 2527 | 8828 | 66.5 | TGCGTCTGGCTTCACGATAC | 29 | 8 | 17 | 30 5 | 0 |
| 7236 | 2603 | 2528 | 40591 | 66.3 | TGCGTCTGGTCTAGTGACGG | 29 | 8 | 19 | 22 35 | 0 |
| 7237 | 2604 | 2529 | 8831 | 70.3 | TGCGTCTGGCAAATCGTTGA | 29 | 8 | 21 | 24 1 | 0 |
| 7238 | 2605 | 2530 | 8832 | 72.2 | TGCGTCTGAGTGTCCCTGCG | 29 | 8 | 22 | 28 29 | 1 |
| 7239 | 2606 | 2531 | 40594 | 69.3 | TGCGTCTGATCGAAAGCAGC | 29 | 8 | 24 | 6 31 | 0 |
| 7240 | 2607 | 2532 | 40595 | 67.4 | TGCGTCTGCCTATTGACACG | 29 | 8 | 26 | 1 30 | 0 |
| 7241 | 2608 | 2533 | 8837 | 69.3 | TGCGTCTGCAGCTTAGCGTT | 29 | 8 | 31 | 3 12 | 0 |
| 7242 | 2609 | 2534 | 8841 | 71.9 | TGCGTGTCTGATTGCGTCCC | 29 | 9 | 2 | 29 28 | 0 |
| 7243 | 2610 | 2535 | 8843 | 73.1 | TGCGTGTCTCTGCACGGTGC | 29 | 9 | 8 | 30 33 | 0 |
| 7244 | 2611 | 2536 | 8844 | 72.9 | TGCGTGTCTGTCGTGCGGAC | 29 | 9 | 9 | 33 34 | 0 |
| 7245 | 2612 | 2537 | 40596 | 66.9 | TGCGTGTCGCTTATACAGCC | 29 | 9 | 17 | 5 36 | 0 |
| 7246 | 2613 | 2538 | 40597 | 73.5 | TGCGTGTCGAGTTCCCAGCC | 29 | 9 | 20 | 28 36 | 0 |
| 7247 | 2614 | 2539 | 8852 | 67.1 | TGCGTGTCACCTATCGATCG | 29 | 9 | 23 | 24 24 | 0 |
| 7248 | 2615 | 2540 | 30599 | 67.5 | TGCGTGTCAGGAGGTATCCC | 29 | 9 | 25 | 18 28 | 0 |
| 7249 | 2616 | 2541 | 8853 | 71.2 | TGCGTGTCGATGGACCCTGT | 29 | 9 | 27 | 32 14 | 0 |
| 7250 | 2617 | 2542 | 40599 | 72.9 | TGCGTGTCTCCCCGAATCGT | 29 | 9 | 28 | 16 10 | 0 |
| 7251 | 2618 | 2543 | 8856 | 71.6 | TGCGTGTCGACCTCGTCGTT | 29 | 9 | 32 | 10 12 | 0 |
| 7252 | 2619 | 2544 | 8862 | 68.4 | TGCGTCGTCTCAACCTTCGT | 29 | 10 | 13 | 23 10 | 0 |
| 7253 | 2620 | 2545 | 15908 | 63.5 | TCGTCTGTTTAGGTCTTGCG | 10 | 14 | 3 | 19 29 | 0 |
| 7254 | 2621 | 2547 | 40601 | 66.4 | TGCGTCGTGTCTAGTGAGCC | 29 | 10 | 19 | 22 36 | 0 |
| 7255 | 2622 | 2548 | 30602 | 71.8 | TGCGTCGTCCTATGCGAGGA | 29 | 10 | 26 | 29 25 | 0 |
| 7256 | 2623 | 2549 | 8866 | 70.1 | TGCGTCGTGATGCGTTCTGT | 29 | 10 | 27 | 12 14 | 0 |
| 7257 | 2624 | 2550 | 8867 | 67.5 | TGCGTCGTTCCCCCTATTAG | 29 | 10 | 28 | 26 3 | 0 |
| 7258 | 2625 | 2551 | 8868 | 76.3 | TGCGTCGTTGCGGGACTCGT | 29 | 10 | 29 | 34 10 | 0 |
| 7259 | 2626 | 2552 | 8869 | 76 | TGCGTCGTCACGCACGCTGT | 29 | 10 | 30 | 30 14 | 0 |
| 7260 | 2627 | 2553 | 8870 | 70.1 | TGCGTCGTGACCCCTAGACC | 29 | 10 | 32 | 26 32 | 0 |
| 7261 | 2628 | 2554 | 8872 | 72.9 | TGCGTCGTGGACTCGTCACG | 29 | 10 | 34 | 10 30 | 0 |
| 7262 | 2629 | 2555 | 8873 | 66.8 | TGCGCTTGTTAGAGCCTTGA | 29 | 11 | 3 | 36 1 | 0 |
| 7263 | 2630 | 2557 | 8874 | 64.5 | TGCGCTTGTACAATACCAGC | 29 | 11 | 7 | 5 31 | 0 |
| 7264 | 2631 | 2558 | 8875 | 72.1 | TGCGCTTGTCTGCGAACGTT | 29 | 11 | 8 | 16 12 | 0 |
| 7265 | 2632 | 2559 | 8877 | 72.1 | TGCGCTTGCGTTTCGTTGAT | 29 | 11 | 12 | 10 2 | 0 |
| 7266 | 2633 | 2560 | 8878 | 69.9 | TGCGCTTGCTCAATACCGAA | 29 | 11 | 13 | 5 16 | 0 |
| 7267 | 2634 | 2561 | 15909 | 71.9 | TGCGCTTGCTGTCGAACCAT | 29 | 11 | 14 | 16 15 | 0 |
| 7268 | 2635 | 2562 | 30604 | 65.9 | TGCGCTTGGAGTATCGAATC | 29 | 11 | 20 | 24 4 | 0 |
| 7269 | 2636 | 2563 | 40604 | 66.7 | TGCGCTTGAGTGAATCCTTG | 29 | 11 | 22 | 4 11 | 0 |
| 7270 | 2637 | 2564 | 8885 | 69.9 | TGCGCTTGATCGATCGAGTG | 29 | 11 | 24 | 24 22 | 0 |
| 7271 | 2638 | 2565 | 8887 | 73 | TGCGCTTGGATGACGGGAGT | 29 | 11 | 27 | 35 20 | 0 |
| 7272 | 2639 | 2566 | 8888 | 76.6 | TGCGCTTGCAGCCACGGAGT | 29 | 11 | 31 | 30 20 | 0 |
| 7273 | 2640 | 2567 | 40605 | 74.1 | TGCGCTTGGTGCACCTCGTT | 29 | 11 | 33 | 23 12 | 0 |

FIG. 29DDD

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7273 | 2641 | 2568 | 8890 | 75.5 | TGCGCTTGAGCCGACCACCT | 29 | 11 | 36 | 32 23 | 0 |
| 7274 | 2642 | 2569 | 21509 | 67.9 | TGCGCGTTAATCCCTACCAT | 29 | 12 | 4 | 26 15 | 0 |
| 7275 | 2643 | 2570 | 40607 | 66.3 | TGCGCGTTATACTCTGAGCC | 29 | 12 | 5 | 8 36 | 0 |
| 7276 | 2644 | 2571 | 30606 | 70.1 | TGCGCGTTAAAGAATCGCAA | 29 | 12 | 6 | 4 21 | 0 |
| 7277 | 2645 | 2572 | 8893 | 72.6 | TGCGCGTTTCTGCTTGATCG | 29 | 12 | 8 | 11 24 | 0 |
| 7278 | 2646 | 2573 | 8894 | 75.2 | TGCGCGTTTCGTCGAACGAA | 29 | 12 | 10 | 16 16 | 0 |
| 7279 | 2647 | 2574 | 8895 | 70.4 | TGCGCGTTCGTTAGTGCTTG | 29 | 12 | 12 | 22 11 | 0 |
| 7280 | 2648 | 2575 | 30607 | 67 | TGCGCGTTGGTACCATTTAG | 29 | 12 | 18 | 15 3 | 0 |
| 7281 | 2649 | 2576 | 8899 | 68.9 | TGCGCGTTGTCTGGTAGACC | 29 | 12 | 19 | 18 32 | 0 |
| 7282 | 2650 | 2577 | 21511 | 68.1 | TGCGCGTTATCGTTGATTGA | 29 | 12 | 24 | 1 1 | 0 |
| 7283 | 2651 | 2579 | 8902 | 72.5 | TGCGCGTTGATGTCCCTTGA | 29 | 12 | 27 | 28 1 | 0 |
| 7284 | 2652 | 2580 | 8903 | 74.7 | TGCGCGTTTCCCGCTTACCT | 29 | 12 | 28 | 17 23 | 1 |
| 7286 | 2653 | 2581 | 8904 | 75.5 | TGCGCGTTCACGGAGTCACG | 29 | 12 | 30 | 20 30 | 0 |
| 7287 | 2654 | 2582 | 40609 | 71.2 | TGCGCGTTCAGCTTAGAGCC | 29 | 12 | 31 | 3 36 | 0 |
| 7288 | 2655 | 2583 | 8906 | 71.1 | TGCGCGTTGACCTCCCATAC | 29 | 12 | 32 | 28 5 | 0 |
| 7289 | 2656 | 2584 | 8908 | 71.4 | TGCGCGTTACGGGGTAGATG | 29 | 12 | 35 | 18 27 | 0 |
| 7290 | 2657 | 2585 | 40611 | 66.6 | TGCGCTCATGATAATCAGCC | 29 | 13 | 2 | 4 36 | 0 |
| 7291 | 2658 | 2586 | 40612 | 73.5 | TGCGCTCATTAGCACGCACG | 29 | 13 | 3 | 30 30 | 0 |
| 7292 | 2659 | 2588 | 40614 | 69.6 | TGCGCTCAAAAGCTCAATCG | 29 | 13 | 6 | 13 24 | 0 |
| 7293 | 2660 | 2589 | 8910 | 70.4 | TGCGCTCATACATGCGGGTA | 29 | 13 | 7 | 29 18 | 0 |
| 7294 | 2661 | 2590 | 8911 | 67 | TGCGCTCATCTGATCGTGTC | 29 | 13 | 8 | 24 9 | 0 |
| 7295 | 2662 | 2591 | 40615 | 70.3 | TGCGCTCACGTTATCGCTTG | 29 | 13 | 12 | 24 11 | 0 |
| 7296 | 2663 | 2593 | 8915 | 70.9 | TGCGCTCACTGTTCCCGTCT | 29 | 13 | 14 | 28 19 | 0 |
| 7297 | 2664 | 2596 | 8918 | 70.8 | TGCGCTCAGCAAAGTGCTCA | 29 | 13 | 21 | 22 13 | 0 |
| 7298 | 2665 | 2597 | 30610 | 66.4 | TGCGCTCACCTACGAAAAAG | 29 | 13 | 26 | 16 6 | 0 |
| 7299 | 2666 | 2598 | 8921 | 71.8 | TGCGCTCAGATGGTGCGAGT | 29 | 13 | 27 | 33 20 | 0 |
| 7300 | 2667 | 2601 | 40617 | 68 | TGCGCTGTTGATAAAGTGCG | 29 | 14 | 2 | 6 29 | 0 |
| 7301 | 2668 | 2602 | 8925 | 66.6 | TGCGCTGTAATCGCTTGTCT | 29 | 14 | 4 | 17 19 | 0 |
| 7302 | 2669 | 2603 | 8926 | 69.9 | TGCGCTGTATACGACCACGG | 29 | 14 | 5 | 32 35 | 0 |
| 7303 | 2670 | 2604 | 8928 | 66.9 | TGCGCTGTTACACCTAACGG | 29 | 14 | 7 | 26 35 | 0 |
| 7304 | 2671 | 2605 | 40618 | 66.7 | TGCGCTGTTCTGTGATAGCC | 29 | 14 | 8 | 2 36 | 0 |
| 7305 | 2672 | 2606 | 8929 | 71.4 | TGCGCTGTTGTCAATCGCAA | 29 | 14 | 9 | 4 21 | 0 |
| 7306 | 2673 | 2607 | 8931 | 69.7 | TGCGCTGTCTTGGACCAGTG | 29 | 14 | 11 | 32 22 | 0 |
| 7307 | 2674 | 2609 | 40619 | 67.2 | TGCGCTGTCTCACCATTCTG | 29 | 14 | 13 | 15 8 | 0 |
| 7308 | 2675 | 2610 | 40620 | 70.6 | TGCGCTGTCTGTTCTGCGAA | 29 | 14 | 14 | 8 16 | 0 |
| 7309 | 2676 | 2611 | 30611 | 66.1 | TGCGCTGTCCATCCTAAAAG | 29 | 14 | 15 | 26 6 | 0 |
| 7310 | 2677 | 2612 | 8933 | 70.8 | TGCGCTGTCGAAAATCCCAT | 29 | 14 | 16 | 4 15 | 0 |
| 7311 | 2678 | 2613 | 30612 | 68 | TGCGCTGTGGTAGAGTTCCC | 29 | 14 | 18 | 20 28 | 0 |
| 7312 | 2679 | 2615 | 15915 | 70.8 | TGCGCTGTAGTGGGACCGTT | 29 | 14 | 22 | 34 12 | 0 |
| 7313 | 2680 | 2616 | 30614 | 67.7 | TGCGCTGTCAGCTTAGCTCA | 29 | 14 | 31 | 3 13 | 0 |
| 7314 | 2681 | 2617 | 8938 | 75.9 | TGCGCTGTGACCGGACCCAT | 29 | 14 | 32 | 34 15 | 0 |
| 7315 | 2682 | 2618 | 8940 | 72.4 | TGCGCTGTACGGGTGCTCTG | 29 | 14 | 35 | 33 8 | 0 |
| 7316 | 2683 | 2619 | 8941 | 69.5 | TGCGCTGTAGCCGAGTCTTG | 29 | 14 | 36 | 20 11 | 0 |
| 7317 | 2684 | 2620 | 40621 | 69.1 | TGCGCCATTTGAACCTATCG | 29 | 15 | 1 | 23 24 | 0 |
| 7318 | 2685 | 2621 | 8943 | 68 | TGCGCCATTTAGGAGTCGTT | 29 | 15 | 3 | 20 12 | 0 |
| 7319 | 2686 | 2622 | 40622 | 70.1 | TGCGCCATAATCTCTGTGCC | 29 | 15 | 4 | 8 29 | 0 |
| 7320 | 2687 | 2625 | 8946 | 69.6 | TGCGCCATCGAAGTCTTTGA | 29 | 15 | 16 | 19 1 | 0 |
| 7321 | 2688 | 2626 | 8947 | 71.7 | TGCGCCATGTCTGATGGACC | 29 | 15 | 19 | 27 32 | 0 |

FIG. 29EEE

| SEQ ID NO: | ZIP ID# | 4,633 HEX ID# | ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7322 | 2689 | 2627 | 30616 | 71.4 | TGCGCCATATCGGTCTCAGC | 29 | 15 | 24 | 19 | 31 | 0 |
| 7323 | 2690 | 2628 | 8951 | 71.7 | TGCGCCATTCCCTCGTTACA | 29 | 15 | 28 | 10 | 7 | 0 |
| 7324 | 2691 | 2629 | 8952 | 69.6 | TGCGCCATGACCTGATCTTG | 29 | 15 | 32 | 2 | 11 | 0 |
| 7325 | 2692 | 2630 | 8954 | 76.8 | TGCGCCATGGACCCATCGAA | 29 | 15 | 34 | 15 | 16 | 0 |
| 7326 | 2693 | 2631 | 8955 | 72.7 | TGCGCCATACGGCTGTCTCA | 29 | 15 | 35 | 14 | 13 | 0 |
| 7327 | 2694 | 2632 | 40624 | 70 | TGCGCGAATGATCGTTCTTG | 29 | 16 | 2 | 12 | 11 | 0 |
| 7328 | 2695 | 2633 | 8956 | 71.9 | TGCGCGAAAATCAAAGCAGC | 29 | 16 | 4 | 6 | 31 | 0 |
| 7329 | 2696 | 2634 | 21535 | 71.8 | TGCGCGAACTCAGACCAGGA | 29 | 16 | 13 | 32 | 25 | 0 |
| 7330 | 2697 | 2635 | 8959 | 69.7 | TGCGCGAACCATCTGTTGTC | 29 | 16 | 15 | 14 | 9 | 0 |
| 7331 | 2698 | 2636 | 8960 | 74.1 | TGCGCGAACGAAAGCCAAAG | 29 | 16 | 16 | 36 | 6 | 0 |
| 7332 | 2699 | 2637 | 8962 | 71.9 | TGCGCGAAGCAACTCACCAT | 29 | 16 | 21 | 13 | 15 | 0 |
| 7333 | 2700 | 2638 | 8963 | 71.6 | TGCGCGAAATCGTGATCCAT | 29 | 16 | 24 | 2 | 15 | 0 |
| 7334 | 2701 | 2639 | 30619 | 73.7 | TGCGCGAAAGGAGATGGTGC | 29 | 16 | 25 | 27 | 33 | 0 |
| 7335 | 2702 | 2640 | 15917 | 74.9 | TGCGCGAATCCCCCTACAGC | 29 | 16 | 28 | 26 | 31 | 0 |
| 7336 | 2703 | 2644 | 40625 | 66.1 | TGCGGCTTATACAATCGCTT | 29 | 17 | 5 | 4 | 17 | 0 |
| 7337 | 2704 | 2645 | 30620 | 73.7 | TGCGGCTTTCTGCAGCTCGT | 29 | 17 | 8 | 31 | 10 | 0 |
| 7338 | 2705 | 2646 | 8975 | 71.4 | TGCGGCTTCTTGCTGTGACC | 29 | 17 | 11 | 14 | 32 | 0 |
| 7339 | 2706 | 2647 | 8976 | 66.6 | TGCGGCTTCTCAAGTGAGTG | 29 | 17 | 13 | 22 | 22 | 0 |
| 7340 | 2707 | 2648 | 8978 | 69.1 | TGCGGCTTCGAATTGATCTG | 29 | 17 | 16 | 1 | 8 | 0 |
| 7341 | 2708 | 2649 | 8980 | 69.4 | TGCGGCTTGCAATCTGAAAG | 29 | 17 | 21 | 8 | 6 | 0 |
| 7342 | 2709 | 2650 | 8984 | 76.6 | TGCGGCTTTCCCCAGCCCTA | 29 | 17 | 28 | 31 | 26 | 0 |
| 7343 | 2710 | 2651 | 30622 | 78.3 | TGCGGCTTCACGGGACCGAA | 29 | 17 | 30 | 34 | 16 | 0 |
| 7344 | 2711 | 2652 | 8988 | 77.6 | TGCGGCTTAGCCGACCCGAA | 29 | 17 | 36 | 32 | 16 | 0 |
| 7345 | 2712 | 2653 | 30623 | 66.5 | TGCGGGTAAAAGAGGAGGAC | 29 | 18 | 6 | 25 | 34 | 0 |
| 7346 | 2713 | 2654 | 8990 | 66.4 | TGCGGGTATACACCATACGG | 29 | 18 | 7 | 15 | 35 | 0 |
| 7347 | 2714 | 2656 | 30624 | 68.8 | TGCGGGTATGTCCACGAAAG | 29 | 18 | 9 | 30 | 6 | 0 |
| 7348 | 2715 | 2657 | 30625 | 71.4 | TGCGGGTACGTTCAGCCTTG | 29 | 18 | 12 | 31 | 11 | 0 |
| 7349 | 2716 | 2658 | 21547 | 68.6 | TGCGGGTACTCAGCAACGTT | 29 | 18 | 13 | 21 | 12 | 0 |
| 7350 | 2717 | 2659 | 8994 | 67.4 | TGCGGGTACTGTGCAACTTG | 29 | 18 | 14 | 21 | 11 | 0 |
| 7351 | 2718 | 2660 | 30626 | 69.7 | TGCGGGTAGCTTAGCCGAGT | 29 | 18 | 17 | 36 | 20 | 0 |
| 7352 | 2719 | 2661 | 8998 | 67.9 | TGCGGGTAGAGTGGACCTTG | 29 | 18 | 20 | 34 | 11 | 0 |
| 7353 | 2720 | 2662 | 9003 | 69.5 | TGCGGGTACCTAGACCCAGC | 29 | 18 | 26 | 32 | 31 | 0 |
| 7354 | 2721 | 2664 | 9005 | 72.7 | TGCGGGTACACGTGTCACGG | 29 | 18 | 30 | 9 | 35 | 0 |
| 7355 | 2722 | 2665 | 9008 | 66.2 | TGCGGGTAGTGCTGTCTGTC | 29 | 18 | 33 | 9 | 9 | 0 |
| 7356 | 2723 | 2666 | 9009 | 65.9 | TGCGGGTAGGACCCTAGAGT | 29 | 18 | 34 | 26 | 20 | 0 |
| 7357 | 2724 | 2667 | 9010 | 74.2 | TGCGGGTAAGCCGTCTGCAA | 29 | 18 | 36 | 19 | 21 | 0 |
| 7358 | 2725 | 2668 | 30627 | 68.3 | TGCGGTCTTGATCGAATCGT | 29 | 19 | 2 | 16 | 10 | 0 |
| 7359 | 2726 | 2669 | 21553 | 65.7 | TGCGGTCTTTAGCTGTTCGT | 29 | 19 | 3 | 14 | 10 | 0 |
| 7360 | 2727 | 2670 | 40630 | 68.4 | TGCGGTCTAAAGGATGCAGC | 29 | 19 | 6 | 27 | 31 | 0 |
| 7361 | 2728 | 2671 | 40631 | 64.9 | TGCGGTCTTCTGTCCCTTAG | 29 | 19 | 8 | 28 | 3 | 0 |
| 7362 | 2729 | 2672 | 9014 | 73.1 | TGCGGTCTTGTCCAGCCGTT | 29 | 19 | 9 | 31 | 12 | 0 |
| 7363 | 2730 | 2673 | 40632 | 69.2 | TGCGGTCTCTTGGGTATCCC | 29 | 19 | 11 | 18 | 28 | 0 |
| 7364 | 2731 | 2674 | 9017 | 66.5 | TGCGGTCTCTGTTTGAATCG | 29 | 19 | 14 | 1 | 24 | 0 |
| 7365 | 2732 | 2675 | 40634 | 71.1 | TGCGGTCTCGAAAGGAGCAA | 29 | 19 | 16 | 25 | 21 | 0 |
| 7366 | 2733 | 2676 | 21556 | 72.3 | TGCGGTCTGGTATCCCGACC | 29 | 19 | 18 | 28 | 32 | 0 |
| 7367 | 2734 | 2677 | 40635 | 67.4 | TGCGGTCTGAGTAGTGTGCG | 29 | 19 | 20 | 22 | 29 | 0 |
| 7368 | 2735 | 2678 | 30629 | 66.2 | TGCGGTCTACCTGCAAAAAG | 29 | 19 | 23 | 21 | 6 | 0 |
| 7369 | 2736 | 2679 | 30630 | 71.1 | TGCGGTCTATCGGACCGATG | 29 | 19 | 24 | 32 | 27 | 0 |

FIG. 29FFF

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7370 | 2737 | 2680 | 30631 | 66.5 | TGCGGTCTAGGAAAAGGACC | 29 | 19 | 25 | 6 | 32 | 0 |
| 7371 | 2738 | 2681 | 30632 | 66.7 | TGCGGTCTGATGAAAGCTTG | 29 | 19 | 27 | 6 | 11 | 0 |
| 7372 | 2739 | 2682 | 9025 | 71.5 | TGCGGTCTCAGCCGAACTTG | 29 | 19 | 31 | 16 | 11 | 0 |
| 7373 | 2740 | 2683 | 30633 | 63.1 | TGCGGAGTTGATAGCCTTAG | 29 | 20 | 2 | 36 | 3 | 0 |
| 7374 | 2741 | 2684 | 21559 | 67.3 | TGCGGAGTATACGTGCGGTA | 29 | 20 | 5 | 33 | 18 | 0 |
| 7375 | 2742 | 2685 | 21560 | 67.2 | TGCGGAGTTCTGATACGCAA | 29 | 20 | 8 | 5 | 21 | 0 |
| 7376 | 2743 | 2686 | 40636 | 70.2 | TGCGGAGTTCGTTCTGGACC | 29 | 20 | 10 | 8 | 32 | 0 |
| 7377 | 2744 | 2688 | 9036 | 74.1 | TGCGGAGTGCAAGACCCGAA | 29 | 20 | 21 | 32 | 16 | 0 |
| 7378 | 2745 | 2689 | 9039 | 71 | TGCGGAGTTCCCTGTCGATG | 29 | 20 | 28 | 9 | 27 | 0 |
| 7379 | 2746 | 2692 | 9041 | 74.9 | TGCGGAGTGTGCGTGCACCT | 29 | 20 | 33 | 33 | 23 | 0 |
| 7380 | 2747 | 2693 | 40638 | 70.5 | TGCGGAGTGGACCGTTGAGT | 29 | 20 | 34 | 12 | 20 | 0 |
| 7381 | 2748 | 2694 | 9042 | 71.9 | TGCGGCAATTGAGATGCGTT | 29 | 21 | 1 | 27 | 12 | 0 |
| 7382 | 2749 | 2695 | 15926 | 68.3 | TGCGGCAATTAGCGTTACCT | 29 | 21 | 3 | 12 | 23 | 0 |
| 7383 | 2750 | 2696 | 30635 | 68.9 | TGCGGCAAAATCTTAGCAGC | 29 | 21 | 4 | 3 | 31 | 0 |
| 7384 | 2751 | 2697 | 30636 | 67.7 | TGCGGCAAAAAGTTAGGGAC | 29 | 21 | 6 | 3 | 34 | 0 |
| 7385 | 2752 | 2698 | 9045 | 66.6 | TGCGGCAATCTGATACCTTG | 29 | 21 | 8 | 5 | 11 | 0 |
| 7386 | 2753 | 2699 | 9046 | 73.4 | TGCGGCAACGAATGATTCCC | 29 | 21 | 16 | 2 | 28 | 0 |
| 7387 | 2754 | 2700 | 9047 | 67.6 | TGCGGCAAGCTTAAAGGAGT | 29 | 21 | 17 | 6 | 20 | 0 |
| 7388 | 2755 | 2701 | 21570 | 74.4 | TGCGGCAAGTCTGACCCACG | 29 | 21 | 19 | 32 | 30 | 0 |
| 7389 | 2756 | 2702 | 9048 | 69.2 | TGCGGCAAGAGTATCGATCG | 29 | 21 | 20 | 24 | 24 | 0 |
| 7390 | 2757 | 2703 | 40641 | 68.4 | TGCGGCAAGATGAGGAAAAG | 29 | 21 | 27 | 25 | 6 | 0 |
| 7391 | 2758 | 2704 | 9049 | 70.7 | TGCGGCAATCCCGCTTATAC | 29 | 21 | 28 | 17 | 5 | 0 |
| 7392 | 2759 | 2705 | 9050 | 71.1 | TGCGGCAACAGCAAAGACCT | 29 | 21 | 31 | 6 | 23 | 0 |
| 7393 | 2760 | 2706 | 9051 | 71.5 | TGCGGCAAGACCCCTAACCT | 29 | 21 | 32 | 26 | 23 | 0 |
| 7394 | 2761 | 2707 | 15927 | 75.3 | TGCGGCAAGTGCAAAGCGAA | 29 | 21 | 33 | 6 | 16 | 0 |
| 7395 | 2762 | 2709 | 9056 | 71.4 | TGCGAGTGTCTGAGCCCAGC | 29 | 22 | 8 | 36 | 31 | 0 |
| 7396 | 2763 | 2710 | 40642 | 72.7 | TGCGAGTGTCGTTGCGAGGA | 29 | 22 | 10 | 29 | 25 | 0 |
| 7397 | 2764 | 2711 | 9058 | 67.8 | TGCGAGTGCTTGCAGCATAC | 29 | 22 | 11 | 31 | 5 | 0 |
| 7398 | 2765 | 2712 | 15928 | 68.3 | TGCGAGTGGCTTCCATTGAT | 29 | 22 | 17 | 15 | 2 | 0 |
| 7399 | 2766 | 2713 | 30637 | 67.7 | TGCGAGTGGGTACTTGTCCC | 29 | 22 | 18 | 11 | 28 | 1 |
| 7400 | 2767 | 2714 | 40643 | 70.1 | TGCGAGTGACCTCGAATCCC | 29 | 22 | 23 | 16 | 28 | 0 |
| 7401 | 2768 | 2715 | 9063 | 68.5 | TGCGAGTGAGGAGATGCGTT | 29 | 22 | 25 | 27 | 12 | 0 |
| 7402 | 2769 | 2716 | 9066 | 75.5 | TGCGAGTGTGCGGTGCCTTG | 29 | 22 | 29 | 33 | 11 | 0 |
| 7403 | 2770 | 2717 | 9067 | 67.6 | TGCGAGTGCAGCACCTAGTG | 29 | 22 | 31 | 23 | 22 | 0 |
| 7404 | 2771 | 2718 | 30638 | 72.3 | TGCGACCTTGATCAGCGTGC | 29 | 23 | 2 | 31 | 33 | 0 |
| 7405 | 2772 | 2719 | 30639 | 71.7 | TGCGACCTAAAGGTGCTGCG | 29 | 23 | 6 | 33 | 29 | 0 |
| 7406 | 2773 | 2720 | 9069 | 65.8 | TGCGACCTTACAGGACAGGA | 29 | 23 | 7 | 34 | 25 | 0 |
| 7407 | 2774 | 2722 | 40645 | 68.5 | TGCGACCTTCGTGTCTGACC | 29 | 23 | 10 | 19 | 32 | 0 |
| 7408 | 2775 | 2723 | 40646 | 72.8 | TGCGACCTCTTGCGTTTCCC | 29 | 23 | 11 | 12 | 28 | 1 |
| 7409 | 2776 | 2724 | 9071 | 64.5 | TGCGACCTCTCATTAGGACC | 29 | 23 | 13 | 3 | 32 | 0 |
| 7410 | 2777 | 2725 | 21582 | 70.6 | TGCGACCTCTGTCAGCCCAT | 29 | 23 | 14 | 31 | 15 | 0 |
| 7411 | 2778 | 2726 | 9072 | 69.7 | TGCGACCTCCATGCAACTTG | 29 | 23 | 15 | 21 | 11 | 0 |
| 7412 | 2779 | 2727 | 30640 | 65.7 | TGCGACCTCGAAGCTTAAAG | 29 | 23 | 16 | 17 | 6 | 0 |
| 7413 | 2780 | 2728 | 9074 | 66.2 | TGCGACCTGGTAAAAGCTTG | 29 | 23 | 18 | 6 | 11 | 0 |
| 7414 | 2781 | 2729 | 9077 | 69.1 | TGCGACCTAGTGACCTTGCG | 29 | 23 | 22 | 23 | 29 | 0 |
| 7415 | 2782 | 2730 | 9078 | 67.4 | TGCGACCTACCTCCTAACGG | 29 | 23 | 23 | 26 | 35 | 0 |
| 7416 | 2783 | 2731 | 9079 | 66.8 | TGCGACCTATCGCAGCATAC | 29 | 23 | 24 | 31 | 5 | 0 |
| 7417 | 2784 | 2732 | 9081 | 75.6 | TGCGACCTTCCCCGAACACG | 29 | 23 | 28 | 16 | 30 | 1 |

FIG. 29GGG

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7418 | 2785 | 2733 | 9082 | 77.2 | TGCGACCTTGCGGTGCAGGA | 29 23 | 29 | 33 | 25 | 0 |
| 7419 | 2786 | 2734 | 30642 | 70.4 | TGCGACCTCACGTTGACACG | 29 23 | 30 | 1 | 30 | 0 |
| 7420 | 2787 | 2735 | 9085 | 73.9 | TGCGACCTGGACCGTTCGAA | 29 23 | 34 | 12 | 16 | 0 |
| 7421 | 2788 | 2736 | 30643 | 73.3 | TGCGATCGTTGATCCCCAGC | 29 24 | 1 | 28 | 31 | 0 |
| 7422 | 2789 | 2737 | 9087 | 64.7 | TGCGATCGTGATAATCGATG | 29 24 | 2 | 4 | 27 | 0 |
| 7423 | 2790 | 2738 | 9091 | 73.2 | TGCGATCGTGTCGCTTCACG | 29 24 | 9 | 17 | 30 | 0 |
| 7424 | 2791 | 2739 | 21588 | 72.1 | TGCGATCGCTTGTCGTGGAC | 29 24 | 11 | 10 | 34 | 0 |
| 7425 | 2792 | 2740 | 9094 | 72.8 | TGCGATCGCCATGGTACACG | 29 24 | 15 | 18 | 30 | 0 |
| 7426 | 2793 | 2742 | 9097 | 68.1 | TGCGATCGGGTAAATCCTTG | 29 24 | 18 | 4 | 11 | 0 |
| 7427 | 2794 | 2743 | 9099 | 71.5 | TGCGATCGAGTGGCAACCAT | 29 24 | 22 | 21 | 15 | 0 |
| 7428 | 2795 | 2744 | 40650 | 69.6 | TGCGATCGATCGTGTCCTTG | 29 24 | 24 | 9 | 11 | 0 |
| 7429 | 2796 | 2745 | 9100 | 68.9 | TGCGATCGCCTACCTACGAA | 29 24 | 26 | 26 | 16 | 0 |
| 7430 | 2797 | 2746 | 9101 | 72.8 | TGCGATCGTCCCGTCTCCAT | 29 24 | 28 | 19 | 15 | 0 |
| 7431 | 2798 | 2747 | 9103 | 70 | TGCGATCGCAGCAAAGTGTC | 29 24 | 31 | 6 | 9 | 0 |
| 7432 | 2799 | 2749 | 9105 | 74.9 | TGCGATCGACGGACCTGCAA | 29 24 | 35 | 23 | 21 | 0 |
| 7433 | 2800 | 2750 | 9106 | 71.4 | TGCGATCGAGCCATACAGCC | 29 24 | 36 | 5 | 36 | 0 |
| 7434 | 2801 | 2751 | 9107 | 69.2 | TGCGAGGATTAGCACGATCG | 29 25 | 3 | 30 | 24 | 0 |
| 7435 | 2802 | 2752 | 15931 | 71.5 | TGCGAGGATGTCTCCCTCCC | 29 25 | 9 | 28 | 28 | 0 |
| 7436 | 2803 | 2753 | 9111 | 67.8 | TGCGAGGACTTGCACGTACA | 29 25 | 11 | 30 | 7 | 0 |
| 7437 | 2804 | 2754 | 40652 | 69.8 | TGCGAGGACTGTAGCCCCAT | 29 25 | 14 | 36 | 15 | 0 |
| 7438 | 2805 | 2756 | 15933 | 69.8 | TGCGAGGAGCAAAAAGGACC | 29 25 | 21 | 6 | 32 | 0 |
| 7439 | 2806 | 2757 | 40654 | 67.6 | TGCGAGGAAGTGAGTGGGAC | 29 25 | 22 | 22 | 34 | 0 |
| 7440 | 2807 | 2758 | 9119 | 68.4 | TGCGAGGAAGGATGCGTTAG | 29 25 | 25 | 29 | 3 | 0 |
| 7441 | 2808 | 2759 | 9122 | 73.8 | TGCGAGGACAGCCGTTCAGC | 29 25 | 31 | 12 | 31 | 0 |
| 7442 | 2809 | 2760 | 9125 | 73.5 | TGCGAGGAACGGGAGTCACG | 29 25 | 35 | 20 | 30 | 0 |
| 7443 | 2810 | 2761 | 40656 | 66.6 | TGCGCCTATTGACGAATGTC | 29 26 | 1 | 16 | 9 | 0 |
| 7444 | 2811 | 2764 | 30646 | 70.7 | TGCGCCTATACAAGCCGGAC | 29 26 | 7 | 36 | 34 | 0 |
| 7445 | 2812 | 2765 | 15936 | 70.6 | TGCGCCTATGTCAGGAAGCC | 29 26 | 9 | 25 | 36 | 0 |
| 7446 | 2813 | 2766 | 9133 | 70.6 | TGCGCCTACTTGTGCGTTGA | 29 26 | 11 | 29 | 1 | 0 |
| 7447 | 2814 | 2767 | 9136 | 68.6 | TGCGCCTACGAAATACCAGC | 29 26 | 16 | 5 | 31 | 0 |
| 7448 | 2815 | 2768 | 40661 | 67.4 | TGCGCCTAGGTAAATCCGTT | 29 26 | 18 | 4 | 12 | 0 |
| 7449 | 2816 | 2769 | 9137 | 71.8 | TGCGCCTAGTCTCACGCAGC | 29 26 | 19 | 30 | 31 | 0 |
| 7450 | 2817 | 2771 | 9141 | 73.5 | TGCGCCTATCCCGCAATGTC | 29 26 | 28 | 21 | 9 | 0 |
| 7451 | 2818 | 2772 | 9142 | 72.2 | TGCGCCTATGCGAGTGCCTA | 29 26 | 29 | 22 | 26 | 0 |
| 7452 | 2819 | 2773 | 9143 | 69.1 | TGCGCCTACACGGATGAAAG | 29 26 | 30 | 27 | 6 | 0 |
| 7453 | 2820 | 2774 | 15937 | 73.8 | TGCGCCTAGGACACCTTGCG | 29 26 | 34 | 23 | 29 | 0 |
| 7454 | 2821 | 2775 | 9146 | 71.8 | TGCGCCTAACGGCCTAACCT | 29 26 | 35 | 26 | 23 | 0 |
| 7455 | 2822 | 2776 | 9147 | 72.6 | TGCGCCTAAGCCCTCAAGGA | 29 26 | 36 | 13 | 25 | 0 |
| 7456 | 2823 | 2777 | 40663 | 71.9 | TGCGGATGTTGAGTGCGCTT | 29 27 | 1 | 33 | 17 | 0 |
| 7457 | 2824 | 2778 | 30647 | 68.9 | TGCGGATGTGATGCTTCCAT | 29 27 | 2 | 17 | 15 | 0 |
| 7458 | 2825 | 2779 | 40666 | 66.6 | TGCGGATGTGTCCGTTAAAG | 29 27 | 9 | 12 | 6 | 0 |
| 7459 | 2826 | 2780 | 9150 | 75.4 | TGCGGATGCGTTGATGCAGC | 29 27 | 12 | 27 | 31 | 0 |
| 7460 | 2827 | 2781 | 9151 | 66.1 | TGCGGATGCTCAATACGTCT | 29 27 | 13 | 5 | 19 | 0 |
| 7461 | 2828 | 2782 | 9152 | 73.4 | TGCGGATGCTGTGATGGCAA | 29 27 | 14 | 27 | 21 | 0 |
| 7462 | 2829 | 2783 | 30648 | 71.6 | TGCGGATGGCAAAGTGAGGA | 29 27 | 21 | 22 | 25 | 0 |
| 7463 | 2830 | 2785 | 40667 | 70.9 | TGCGGATGCCTATCGTCGTT | 29 27 | 26 | 10 | 12 | 0 |
| 7464 | 2831 | 2786 | 9158 | 77.5 | TGCGGATGCACGCGTTGGAC | 29 27 | 30 | 12 | 34 | 0 |
| 7465 | 2832 | 2787 | 9160 | 74.3 | TGCGGATGGTGCCGAACTTG | 29 27 | 33 | 16 | 11 | 0 |

FIG. 29HHH

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7466 | 2833 | 2788 | 40668 | 71 | TGCGGATGGGACTTGACAGC | 29 | 27 | 34 | 1 | 31 | 0 |
| 7467 | 2834 | 2789 | 15940 | 69.2 | TGCGGATGACGGTGTCAATC | 29 | 27 | 35 | 9 | 4 | 0 |
| 7468 | 2835 | 2790 | 9165 | 67.2 | TGCGTCCCAATCTCTGACCT | 29 | 28 | 4 | 8 | 23 | 0 |
| 7469 | 2836 | 2792 | 9167 | 74.2 | TGCGTCCCAAAGCTTGGCAA | 29 | 28 | 6 | 11 | 21 | 0 |
| 7470 | 2837 | 2794 | 9169 | 66.9 | TGCGTCCCTCGTAAAGGTCT | 29 | 28 | 10 | 6 | 19 | 0 |
| 7471 | 2838 | 2795 | 9170 | 70.4 | TGCGTCCCCTTGCTTGAATC | 29 | 28 | 11 | 11 | 4 | 0 |
| 7472 | 2839 | 2796 | 30650 | 75.1 | TGCGTCCCCGTTGATGGCTT | 29 | 28 | 12 | 27 | 17 | 0 |
| 7473 | 2840 | 2797 | 9171 | 67.6 | TGCGTCCCCATAATCAATC | 29 | 28 | 15 | 4 | 4 | 0 |
| 7474 | 2841 | 2798 | 9172 | 71.9 | TGCGTCCCCGAACCATACCT | 29 | 28 | 16 | 15 | 23 | 0 |
| 7475 | 2842 | 2799 | 21616 | 68.4 | TGCGTCCCGGTAATACAGGA | 29 | 28 | 18 | 5 | 25 | 0 |
| 7476 | 2843 | 2800 | 9173 | 68.5 | TGCGTCCCGTCTGAGTTGTC | 29 | 28 | 19 | 20 | 9 | 0 |
| 7477 | 2844 | 2801 | 40670 | 70.7 | TGCGTCCCACCTATCGCTGT | 29 | 28 | 23 | 24 | 14 | 0 |
| 7478 | 2845 | 2803 | 40671 | 74.6 | TGCGTCCCTCCCTCCCAGTG | 29 | 28 | 28 | 28 | 22 | 0 |
| 7479 | 2846 | 2804 | 9178 | 73.4 | TGCGTCCCGGACCTCAAGTG | 29 | 28 | 34 | 13 | 22 | 0 |
| 7480 | 2847 | 2805 | 9179 | 72.4 | TGCGTCCCACGGAGGAAATC | 29 | 28 | 35 | 25 | 4 | 0 |
| 7481 | 2848 | 2806 | 9181 | 69.8 | TGCGTGCGATACCTTGCCTA | 29 | 29 | 5 | 11 | 26 | 0 |
| 7482 | 2849 | 2807 | 40672 | 69.7 | TGCGTGCGTCTGATACGGAC | 29 | 29 | 8 | 5 | 34 | 0 |
| 7483 | 2850 | 2808 | 9183 | 73.1 | TGCGTGCGTGTCCTCACAGC | 29 | 29 | 9 | 13 | 31 | 0 |
| 7484 | 2851 | 2809 | 9184 | 73.3 | TGCGTGCGTCGTCAGCTGTC | 29 | 29 | 10 | 31 | 9 | 0 |
| 7485 | 2852 | 2810 | 30651 | 75.2 | TGCGTGCGGCTTAGTGGCAA | 29 | 29 | 17 | 22 | 21 | 0 |
| 7486 | 2853 | 2811 | 9186 | 71 | TGCGTGCGGAGTCCTACGTT | 29 | 29 | 20 | 26 | 12 | 0 |
| 7487 | 2854 | 2812 | 9187 | 75.5 | TGCGTGCGATCGCGTTTGTC | 29 | 29 | 24 | 12 | 9 | 0 |
| 7488 | 2855 | 2813 | 9188 | 72.3 | TGCGTGCGCCTACCATCTTG | 29 | 29 | 26 | 15 | 11 | 0 |
| 7489 | 2856 | 2814 | 9189 | 76.8 | TGCGTGCGTCCCGCTTTGTC | 29 | 29 | 28 | 17 | 9 | 0 |
| 7490 | 2857 | 2815 | 21629 | 69.7 | TGCGCACGTTGAAAAGAGGA | 29 | 30 | 1 | 6 | 25 | 0 |
| 7491 | 2858 | 2816 | 9191 | 72.6 | TGCGCACGTTAGCGTTACGG | 29 | 30 | 3 | 12 | 35 | 0 |
| 7492 | 2859 | 2817 | 40673 | 70.8 | TGCGCACGAAAGACCTAGCC | 29 | 30 | 6 | 23 | 36 | 0 |
| 7493 | 2860 | 2818 | 9193 | 77.5 | TGCGCACGTCGTCACGGACC | 29 | 30 | 10 | 30 | 32 | 0 |
| 7494 | 2861 | 2819 | 40674 | 76.3 | TGCGCACGCTGTCCATCACG | 29 | 30 | 14 | 15 | 30 | 0 |
| 7495 | 2862 | 2820 | 9198 | 72.3 | TGCGCACGGTCTAATCGTGC | 29 | 30 | 19 | 4 | 33 | 0 |
| 7496 | 2863 | 2822 | 21632 | 68.2 | TGCGCACGCCTATTAGGAGT | 29 | 30 | 26 | 3 | 20 | 0 |
| 7497 | 2864 | 2823 | 9201 | 73.2 | TGCGCACGGATGCTGTTCTG | 29 | 30 | 27 | 14 | 8 | 0 |
| 7498 | 2865 | 2824 | 9202 | 76.1 | TGCGCACGTCCCACCTTCGT | 29 | 30 | 28 | 23 | 10 | 0 |
| 7499 | 2866 | 2825 | 9203 | 74.8 | TGCGCACGGACCAGTGTCGT | 29 | 30 | 32 | 22 | 10 | 0 |
| 7500 | 2867 | 2826 | 9204 | 74.8 | TGCGCACGGGACTCGTGGTA | 29 | 30 | 34 | 10 | 18 | 0 |
| 7501 | 2868 | 2827 | 9205 | 74.4 | TGCGCACGAGCCGTCTAGGA | 29 | 30 | 36 | 19 | 25 | 0 |
| 7502 | 2869 | 2828 | 40675 | 73.1 | TGCGCAGCTTGACAGCAGGA | 29 | 31 | 1 | 31 | 25 | 0 |
| 7503 | 2870 | 2829 | 40676 | 70.2 | TGCGCAGCTGATTTAGCGAA | 29 | 31 | 2 | 3 | 16 | 0 |
| 7504 | 2871 | 2830 | 40677 | 66 | TGCGCAGCTTAGGCTTAATC | 29 | 31 | 3 | 17 | 4 | 0 |
| 7505 | 2872 | 2831 | 30652 | 70.4 | TGCGCAGCATACTCTGCAGC | 29 | 31 | 5 | 8 | 31 | 0 |
| 7506 | 2873 | 2832 | 9210 | 72.6 | TGCGCAGCTCGTGTCTCAGC | 29 | 31 | 10 | 19 | 31 | 0 |
| 7507 | 2874 | 2833 | 9211 | 72.7 | TGCGCAGCCCATTTAGGCTT | 29 | 31 | 15 | 3 | 17 | 0 |
| 7508 | 2875 | 2834 | 9212 | 74.7 | TGCGCAGCGGTACTCAACGG | 29 | 31 | 18 | 13 | 35 | 0 |
| 7509 | 2876 | 2835 | 30653 | 70.3 | TGCGCAGCGAGTGCAAATAC | 29 | 31 | 20 | 21 | 5 | 0 |
| 7510 | 2877 | 2836 | 9214 | 69.8 | TGCGCAGCATCGTTAGGGTA | 29 | 31 | 24 | 3 | 18 | 0 |
| 7511 | 2878 | 2837 | 9215 | 71 | TGCGCAGCCCTAGATGTCGT | 29 | 31 | 26 | 27 | 10 | 0 |
| 7512 | 2879 | 2838 | 9216 | 73.2 | TGCGCAGCGATGATACCACG | 29 | 31 | 27 | 5 | 30 | 0 |
| 7513 | 2880 | 2839 | 9217 | 78.7 | TGCGCAGCCAGCCAGCCCTA | 29 | 31 | 31 | 31 | 26 | 0 |

FIG. 29III

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7514 | 2881 | 2840 | 15942 | 71.8 | TGCGCAGCGACCAAAGAAAG | 29 | 31 | 32 | 6 6 | 0 |
| 7515 | 2882 | 2841 | 9219 | 75 | TGCGCAGCAGCCTCGTTCTG | 29 | 31 | 36 | 10 8 | 0 |
| 7516 | 2883 | 2842 | 15943 | 68.5 | TGCGGACCTGATCGAATGTC | 29 | 32 | 2 | 16 9 | 0 |
| 7517 | 2884 | 2844 | 9223 | 69.9 | TGCGGACCAATCAGGAGACC | 29 | 32 | 4 | 25 32 | 0 |
| 7518 | 2885 | 2845 | 9224 | 69.7 | TGCGGACCATACAATCTGCG | 29 | 32 | 5 | 4 29 | 0 |
| 7519 | 2886 | 2846 | 21640 | 67.7 | TGCGGACCTACACTGTTCCC | 29 | 32 | 7 | 14 28 | 0 |
| 7520 | 2887 | 2847 | 40680 | 68.6 | TGCGGACCTGTCTGATACGG | 29 | 32 | 9 | 2 35 | 0 |
| 7521 | 2888 | 2848 | 9226 | 71.4 | TGCGGACCCGTTGCAATTAG | 29 | 32 | 12 | 21 3 | 0 |
| 7522 | 2889 | 2849 | 9229 | 70.9 | TGCGGACCCCATCTGTTCTG | 29 | 32 | 15 | 14 8 | 0 |
| 7523 | 2890 | 2850 | 9230 | 73.4 | TGCGGACCCGAACTTGATCG | 29 | 32 | 16 | 11 24 | 0 |
| 7524 | 2891 | 2851 | 9231 | 74.2 | TGCGGACCGAGTCCATGTGC | 29 | 32 | 20 | 15 33 | 0 |
| 7525 | 2892 | 2852 | 9232 | 69 | TGCGGACCAGGAAAAGGTCT | 29 | 32 | 25 | 6 19 | 0 |
| 7526 | 2893 | 2853 | 9234 | 70.1 | TGCGGACCGATGTGTCAGTG | 29 | 32 | 27 | 9 22 | 0 |
| 7527 | 2894 | 2854 | 9235 | 73.7 | TGCGGACCCAGCTCGTCTTG | 29 | 32 | 31 | 10 11 | 0 |
| 7528 | 2895 | 2855 | 9236 | 76.1 | TGCGGACCGACCGGTAGCAA | 29 | 32 | 32 | 18 21 | 0 |
| 7529 | 2896 | 2856 | 9237 | 75.1 | TGCGGACCACGGAAAGCCAT | 29 | 32 | 35 | 6 15 | 0 |
| 7530 | 2897 | 2857 | 30654 | 74.9 | TGCGGTGCAATCACGGCCTA | 29 | 33 | 4 | 35 26 | 0 |
| 7531 | 2898 | 2858 | 9240 | 75.6 | TGCGGTGCAAAGCGTTCACG | 29 | 33 | 6 | 12 30 | 0 |
| 7532 | 2899 | 2859 | 40685 | 72.4 | TGCGGTGCTGTCCCTATCCC | 29 | 33 | 9 | 26 28 | 0 |
| 7533 | 2900 | 2860 | 21649 | 71.5 | TGCGGTGCCGTTATCGAAAG | 29 | 33 | 12 | 24 6 | 0 |
| 7534 | 2901 | 2862 | 9248 | 73.5 | TGCGGTGCACCTCCATCCAT | 29 | 33 | 23 | 15 15 | 0 |
| 7535 | 2902 | 2863 | 9251 | 75.6 | TGCGGTGCTCCCTGTACGG | 29 | 33 | 28 | 14 35 | 0 |
| 7536 | 2903 | 2864 | 9252 | 75.2 | TGCGGTGCAGCCCCTACCAT | 29 | 33 | 36 | 26 15 | 0 |
| 7537 | 2904 | 2865 | 9253 | 68.7 | TGCGGGACTTGAGTCTGTGC | 29 | 34 | 1 | 19 33 | 0 |
| 7538 | 2905 | 2866 | 9254 | 68.8 | TGCGGGACTGATTTGACAGC | 29 | 34 | 2 | 1 31 | 0 |
| 7539 | 2906 | 2867 | 40686 | 70.7 | TGCGGGACATACGCTTAGCC | 29 | 34 | 5 | 17 36 | 0 |
| 7540 | 2907 | 2868 | 30655 | 68.1 | TGCGGGACAAAGTTAGCGTT | 29 | 34 | 6 | 3 12 | 0 |
| 7541 | 2908 | 2869 | 30656 | 70.3 | TGCGGGACTGTCTCTGAGCC | 29 | 34 | 9 | 8 36 | 0 |
| 7542 | 2909 | 2870 | 30657 | 66.7 | TGCGGGACCTTGTTAGGAGT | 29 | 34 | 11 | 3 20 | 0 |
| 7543 | 2910 | 2871 | 9259 | 74.4 | TGCGGGACCGTTGGTATCCC | 29 | 34 | 12 | 18 28 | 0 |
| 7544 | 2911 | 2872 | 40688 | 71.9 | TGCGGGACCCTCAGACCACCT | 29 | 34 | 13 | 32 23 | 0 |
| 7545 | 2912 | 2873 | 30658 | 69.8 | TGCGGGACCTGTAATCCGTT | 29 | 34 | 14 | 4 12 | 0 |
| 7546 | 2913 | 2874 | 9262 | 73.9 | TGCGGGACCGAACGTTCTCA | 29 | 34 | 16 | 12 13 | 0 |
| 7547 | 2914 | 2875 | 9263 | 68.6 | TGCGGGACGCTTGCTTATAC | 29 | 34 | 17 | 17 5 | 0 |
| 7548 | 2915 | 2877 | 9265 | 70.1 | TGCGGGACGTCTACCTGCTT | 29 | 34 | 19 | 23 17 | 0 |
| 7549 | 2916 | 2878 | 9266 | 72.8 | TGCGGGACAGTGACGGACCT | 29 | 34 | 22 | 35 23 | 0 |
| 7550 | 2917 | 2879 | 9267 | 73.9 | TGCGGGACATCGCTCATCGT | 29 | 34 | 24 | 13 10 | 0 |
| 7551 | 2918 | 2880 | 15946 | 68.6 | TGCGGGACCCTATACAGCAA | 29 | 34 | 26 | 7 21 | 0 |
| 7552 | 2919 | 2881 | 9270 | 77.3 | TGCGGGACGATGGTGCGATG | 29 | 34 | 27 | 33 27 | 0 |
| 7553 | 2920 | 2882 | 9271 | 75.9 | TGCGGGACTGCGTGTCCCAT | 29 | 34 | 29 | 9 15 | 0 |
| 7554 | 2921 | 2883 | 15947 | 74.9 | TGCGGGACAGCCATACGCAA | 29 | 34 | 36 | 5 21 | 0 |
| 7555 | 2922 | 2884 | 30659 | 68.6 | TGCGACGGTTAGGCTTTCTG | 29 | 35 | 3 | 17 8 | 0 |
| 7556 | 2923 | 2885 | 30660 | 69.6 | TGCGACGGAATCAATCATCG | 29 | 35 | 4 | 4 24 | 0 |
| 7557 | 2924 | 2887 | 40691 | 69.3 | TGCGACGGTCTGCGAATTAG | 29 | 35 | 8 | 16 3 | 0 |
| 7558 | 2925 | 2888 | 9277 | 69.9 | TGCGACGGCTCATTGAAGTG | 29 | 35 | 13 | 1 22 | 0 |
| 7559 | 2926 | 2889 | 9278 | 70.7 | TGCGACGGCTGTCCATACCT | 29 | 35 | 14 | 15 23 | 0 |
| 7560 | 2927 | 2890 | 9279 | 69.8 | TGCGACGGGTCTCTTGGAGT | 29 | 35 | 19 | 11 20 | 0 |
| 7561 | 2928 | 2891 | 30661 | 68.4 | TGCGACGGGAGTCGTTAAAG | 29 | 35 | 20 | 12 6 | 0 |

FIG. 29JJJ

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7562 | 2929 | 2892 | 40692 | 72 | TGCGACGGAGTGACCTCACG | 29 | 35 | 22 | 23 | 30 | 0 |
| 7563 | 2930 | 2893 | 40693 | 73.3 | TGCGACGGAGGATGTCGGAC | 29 | 35 | 25 | 9 | 34 | 0 |
| 7564 | 2931 | 2894 | 9282 | 74.2 | TGCGACGGGATGGTGCTGTC | 29 | 35 | 27 | 33 | 9 | 0 |
| 7565 | 2932 | 2895 | 9284 | 76.1 | TGCGACGGGTGCGGTAAGGA | 29 | 35 | 33 | 18 | 25 | 0 |
| 7566 | 2933 | 2896 | 9285 | 77.1 | TGCGACGGGGACGCTTAGCC | 29 | 35 | 34 | 17 | 36 | 0 |
| 7567 | 2934 | 2897 | 9286 | 66.5 | TGCGAGCCTTGATGTCTCTG | 29 | 36 | 1 | 9 | 8 | 0 |
| 7568 | 2935 | 2898 | 40694 | 71.9 | TGCGAGCCTGATTCTGGCAA | 29 | 36 | 2 | 8 | 21 | 0 |
| 7569 | 2936 | 2899 | 9288 | 68.6 | TGCGAGCCTTAGGCAATCTG | 29 | 36 | 3 | 21 | 8 | 0 |
| 7570 | 2937 | 2900 | 9289 | 68.1 | TGCGAGCCAAAGGGACATAC | 29 | 36 | 6 | 34 | 5 | 0 |
| 7571 | 2938 | 2901 | 40696 | 68.5 | TGCGAGCCTACAAAAGGTGC | 29 | 36 | 7 | 6 | 33 | 0 |
| 7572 | 2939 | 2902 | 9290 | 69.4 | TGCGAGCCTGTCGACCTACA | 29 | 36 | 9 | 32 | 7 | 0 |
| 7573 | 2940 | 2903 | 40697 | 69.5 | TGCGAGCCCTCAGGTAGGAC | 29 | 36 | 13 | 18 | 34 | 0 |
| 7574 | 2941 | 2905 | 9293 | 74.8 | TGCGAGCCCCATGGTAAGCC | 29 | 36 | 15 | 18 | 36 | 0 |
| 7575 | 2942 | 2906 | 21669 | 73.6 | TGCGAGCCGGTATGTCAGCC | 29 | 36 | 18 | 9 | 36 | 0 |
| 7576 | 2943 | 2907 | 40701 | 74.3 | TGCGAGCCAGGAGATGCGAA | 29 | 36 | 25 | 27 | 16 | 0 |
| 7577 | 2944 | 2908 | 9296 | 72 | TGCGAGCCCCTATCTGAGCC | 29 | 36 | 26 | 8 | 36 | 0 |
| 7578 | 2945 | 2909 | 9297 | 76 | TGCGAGCCTCCCGCTTGATG | 29 | 36 | 28 | 17 | 27 | 0 |
| 7579 | 2946 | 2910 | 9298 | 76.4 | TGCGAGCCCACGTGTCGCTT | 29 | 36 | 30 | 9 | 17 | 0 |
| 7580 | 2947 | 2911 | 15948 | 77.9 | TGCGAGCCCAGCCAGCGTCT | 29 | 36 | 31 | 31 | 19 | 0 |
| 7581 | 2948 | 2912 | 9300 | 75.7 | TGCGAGCCGGACTCGTGCTT | 29 | 36 | 34 | 10 | 17 | 0 |
| 7582 | 2949 | 2913 | 9301 | 76.5 | TGCGAGCCACGGCAGCTGAT | 29 | 36 | 35 | 31 | 2 | 0 |
| 7583 | 2950 | 2914 | 9302 | 76.2 | TGCGAGCCAGCCGATGGGTA | 29 | 36 | 36 | 27 | 18 | 0 |
| 7584 | 2951 | 2915 | 9304 | 71.9 | CACGTTGACCATTGCGCCAT | 30 | 1 | 15 | 29 | 15 | 0 |
| 7585 | 2952 | 2916 | 9305 | 69.4 | TTGAGCAAACGGAAAGTGCG | 1 | 21 | 35 | 6 | 29 | 0 |
| 7586 | 2953 | 2917 | 9307 | 71.5 | TTGAATCGCACGGACCCTCA | 1 | 24 | 30 | 32 | 13 | 0 |
| 7587 | 2954 | 2918 | 9311 | 70.1 | TGATTCGTGTGCCGTTCGAA | 2 | 10 | 33 | 12 | 16 | 0 |
| 7588 | 2955 | 2919 | 30662 | 69.5 | CACGTGATTCCCAATCGCAA | 30 | 2 | 28 | 4 | 21 | 0 |
| 7589 | 2956 | 2920 | 9314 | 73.4 | TGATGTGCCCATTCCCCGAA | 2 | 33 | 15 | 28 | 16 | 0 |
| 7590 | 2957 | 2921 | 15953 | 68.3 | TTAGCACGGCAAAGTGGCTT | 3 | 30 | 21 | 22 | 17 | 0 |
| 7591 | 2958 | 2922 | 9332 | 73.5 | CACGAATCCACGGACCACGG | 30 | 4 | 30 | 32 | 35 | 0 |
| 7592 | 2959 | 2923 | 30663 | 68.1 | ATACGCAAAAAGACGGGCAA | 5 | 21 | 6 | 35 | 21 | 0 |
| 7593 | 2960 | 2924 | 40704 | 68.7 | ATACTGCGTCTGACGGCGAA | 5 | 29 | 8 | 35 | 16 | 0 |
| 7594 | 2961 | 2925 | 15961 | 68.5 | CACGATACACGGACGGAGGA | 30 | 5 | 35 | 35 | 25 | 0 |
| 7595 | 2962 | 2926 | 9345 | 68.9 | CACGAAAGCTGTGGACCGAA | 30 | 6 | 14 | 34 | 16 | 0 |
| 7596 | 2963 | 2927 | 15965 | 67.7 | AAAGGGTAATCGCTTGTGCG | 6 | 18 | 24 | 11 | 29 | 0 |
| 7597 | 2964 | 2928 | 30664 | 68 | AAAGCCTAAGTGCACGCAGC | 6 | 26 | 22 | 30 | 31 | 0 |
| 7598 | 2965 | 2929 | 9354 | 66 | AAAGTGCGATACACCTTGCG | 6 | 29 | 5 | 23 | 29 | 0 |
| 7599 | 2966 | 2930 | 9355 | 67.9 | CACGAAAGGTGCAAAGAGCC | 30 | 6 | 33 | 6 | 36 | 0 |
| 7600 | 2967 | 2931 | 30665 | 70.4 | AAAGGGACACCTGTGCTGCG | 6 | 34 | 23 | 33 | 29 | 0 |
| 7601 | 2968 | 2932 | 30666 | 66 | TCTGCGTTATACTGCGGCTT | 8 | 12 | 5 | 29 | 17 | 0 |
| 7602 | 2969 | 2933 | 15972 | 69.5 | TCTGTGCGTGATACGGGTGC | 8 | 29 | 2 | 35 | 33 | 0 |
| 7603 | 2970 | 2934 | 9366 | 69.6 | TCTGCACGGCTTAAAGCACG | 8 | 30 | 17 | 6 | 30 | 0 |
| 7604 | 2971 | 2935 | 9367 | 68.8 | CACGTCTGCAGCATCGACCT | 30 | 8 | 31 | 24 | 23 | 0 |
| 7605 | 2972 | 2936 | 40705 | 72.5 | TCTGGACCCTTGGACCTGCG | 8 | 32 | 11 | 32 | 29 | 0 |
| 7606 | 2973 | 2937 | 30667 | 67 | TGTCCGTTAGGAGCAATCCC | 9 | 12 | 25 | 21 | 28 | 0 |
| 7607 | 2974 | 2938 | 9376 | 73 | TGTCGACCGATGGACCGGAC | 9 | 32 | 27 | 32 | 34 | 0 |
| 7608 | 2975 | 2939 | 9379 | 72.9 | CACGTGTCAGCCGATGGCAA | 30 | 9 | 36 | 27 | 21 | 0 |
| 7609 | 2976 | 2940 | 9382 | 71.4 | TCGTTCTGCGTTACGGACGG | 10 | 8 | 12 | 35 | 35 | 0 |

FIG. 29KKK

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7610 | 2977 | 2941 | 15975 | 69.5 | CACGTCGTTCGTCCATCGAA | 30 | 10 | 10 | 15 16 | 0 |
| 7611 | 2978 | 2942 | 40706 | 68.1 | TCGTCCATAAAGAGCCCACG | 10 | 15 | 6 | 36 30 | 0 |
| 7612 | 2979 | 2943 | 9387 | 68.2 | TCGTACCTGTCTTGCGAGCC | 10 | 23 | 19 | 29 36 | 0 |
| 7613 | 2980 | 2944 | 9394 | 73 | TCGTGGACGCAAGATGCACG | 10 | 34 | 21 | 27 30 | 0 |
| 7614 | 2981 | 2945 | 9397 | 72 | CACGCTTGTGTCGGACCGAA | 30 | 11 | 9 | 34 16 | 0 |
| 7615 | 2982 | 2946 | 9404 | 66.6 | CACGCTTGAGTGAGTGGTGC | 30 | 11 | 22 | 22 33 | 0 |
| 7616 | 2983 | 2947 | 30668 | 67.9 | CACGCTTGACCTCGTTAGCC | 30 | 11 | 23 | 12 36 | 0 |
| 7617 | 2984 | 2948 | 21698 | 67.8 | CACGCTTGTCCCTCGTTGAT | 30 | 11 | 28 | 10 2 | 1 |
| 7618 | 2985 | 2949 | 9409 | 67.3 | CACGCTTGAGCCTCTGACCT | 30 | 11 | 36 | 8 23 | 0 |
| 7619 | 2986 | 2950 | 30669 | 67.1 | CACGCGTTTACAAGGACACG | 30 | 12 | 7 | 25 30 | 0 |
| 7620 | 2987 | 2951 | 9414 | 66.7 | CACGCGTTTGTCGCTTAATC | 30 | 12 | 9 | 17 4 | 0 |
| 7621 | 2988 | 2952 | 15981 | 73.2 | CACGCGTTTCGTGATGCGAA | 30 | 12 | 10 | 27 16 | 0 |
| 7622 | 2989 | 2953 | 9416 | 71.6 | CACGCGTTCTTGCGTTCGTT | 30 | 12 | 11 | 12 12 | 0 |
| 7623 | 2990 | 2954 | 9418 | 71.6 | CACGCGTTCGAAGTGCGTCT | 30 | 12 | 16 | 33 19 | 0 |
| 7624 | 2991 | 2955 | 9420 | 67.5 | CACGCGTTGTCTTTAGTGCG | 30 | 12 | 19 | 3 29 | 0 |
| 7625 | 2992 | 2956 | 9421 | 70.4 | CACGCGTTGCAAGCAATGTC | 30 | 12 | 21 | 21 9 | 0 |
| 7626 | 2993 | 2957 | 40710 | 65.8 | CACGCGTTCCTATGATGACC | 30 | 12 | 26 | 2 32 | 0 |
| 7627 | 2994 | 2958 | 9425 | 69.9 | CACGCGTTGATGCTCAAGGA | 30 | 12 | 27 | 13 25 | 0 |
| 7628 | 2995 | 2959 | 15985 | 70.1 | CACGCGTTTCCCTGATAGCC | 30 | 12 | 28 | 2 36 | 1 |
| 7629 | 2996 | 2960 | 30670 | 75.2 | CACGCGTTAGCCCACGTCCC | 30 | 12 | 36 | 30 28 | 0 |
| 7630 | 2997 | 2961 | 21702 | 71.7 | CACGCTCAAATCAGCCCACG | 30 | 13 | 4 | 36 30 | 0 |
| 7631 | 2998 | 2962 | 40712 | 68.4 | CACGCTCACGAAAAAGCCAT | 30 | 13 | 16 | 6 15 | 0 |
| 7632 | 2999 | 2963 | 9436 | 66.2 | CACGCTCAGGTAATCGATCG | 30 | 13 | 18 | 24 24 | 0 |
| 7633 | 3000 | 2964 | 9439 | 72 | CACGCTCATCCCCCATCCAT | 30 | 13 | 28 | 15 15 | 0 |
| 7634 | 3001 | 2965 | 40714 | 66 | CACGCTGTATCGACCTCAGC | 30 | 14 | 24 | 23 31 | 0 |
| 7635 | 3002 | 2966 | 9454 | 72.5 | CACGCTGTTGCGCTCAAGGA | 30 | 14 | 29 | 13 25 | 0 |
| 7636 | 3003 | 2967 | 30672 | 66.3 | CCATTACAACCTCAGCTGCG | 15 | 7 | 23 | 31 29 | 0 |
| 7637 | 3004 | 2968 | 30673 | 71.7 | CACGCCATTCTGCTTGGTGC | 30 | 15 | 8 | 11 33 | 0 |
| 7638 | 3005 | 2969 | 9462 | 70.5 | CACGCCATTCGTTCTGGGAC | 30 | 15 | 10 | 8 34 | 0 |
| 7639 | 3006 | 2970 | 15993 | 69.1 | CACGCCATCTTGAATCCACG | 30 | 15 | 11 | 4 30 | 0 |
| 7640 | 3007 | 2971 | 15994 | 69.4 | CACGCCATCCATCGTTGGTA | 30 | 15 | 15 | 12 18 | 0 |
| 7641 | 3008 | 2972 | 30674 | 70.7 | CACGCCATGGTAAGGAACGG | 30 | 15 | 18 | 25 35 | 0 |
| 7642 | 3009 | 2973 | 15996 | 67.2 | CCATGTCTCAGCTGTCGCAA | 15 | 19 | 31 | 9 21 | 0 |
| 7643 | 3010 | 2974 | 9468 | 72.2 | CACGCCATGAGTGTGCGCTT | 30 | 15 | 20 | 33 17 | 0 |
| 7644 | 3011 | 2975 | 9469 | 65.5 | CACGCCATAGTGTGTCTCCC | 30 | 15 | 22 | 9 28 | 0 |
| 7645 | 3012 | 2976 | 15997 | 68.6 | CACGCCATAGGACGTTACGG | 30 | 15 | 25 | 12 35 | 0 |
| 7646 | 3013 | 2977 | 9473 | 76.4 | CACGCCATTGCGGCTTCAGC | 30 | 15 | 29 | 17 31 | 0 |
| 7647 | 3014 | 2978 | 15999 | 71.5 | CACGCCATCACGCTCAGGAC | 30 | 15 | 30 | 13 34 | 0 |
| 7648 | 3015 | 2979 | 30675 | 70 | CACGCCATGACCTACATGCG | 30 | 15 | 32 | 7 29 | 0 |
| 7649 | 3016 | 2980 | 9477 | 70.7 | CACGCCATACGGAGTGAGCC | 30 | 15 | 35 | 22 36 | 0 |
| 7650 | 3017 | 2981 | 40717 | 69.2 | CACGCGAATTGACGTTGCTT | 30 | 16 | 1 | 12 17 | 0 |
| 7651 | 3018 | 2982 | 16001 | 69.5 | CACGCGAAAATCGAGTCACG | 30 | 16 | 4 | 20 30 | 0 |
| 7652 | 3019 | 2983 | 40720 | 66.1 | CACGCGAATCTGAATCCTTG | 30 | 16 | 8 | 4 11 | 0 |
| 7653 | 3020 | 2984 | 40722 | 65.9 | CACGCGAACTTGTTGAGGAC | 30 | 16 | 11 | 1 34 | 1 |
| 7654 | 3021 | 2985 | 30677 | 69.1 | CACGCGAACTGTCAGCCCTA | 30 | 16 | 14 | 31 26 | 0 |
| 7655 | 3022 | 2986 | 9483 | 70.7 | CACGCGAAGCTTCCATTCGT | 30 | 16 | 17 | 15 10 | 0 |
| 7656 | 3023 | 2987 | 9484 | 67.5 | CACGCGAAGGTACTCATCCC | 30 | 16 | 18 | 13 28 | 0 |
| 7657 | 3024 | 2988 | 9485 | 70.9 | CACGCGAAGTCTTCCCGATG | 30 | 16 | 19 | 28 27 | 0 |

FIG. 29LLL

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7658 | 3025 | 2989 | 16003 | 66.7 | CACGCGAAGCAACGAAATAC | 30 | 16 | 21 | 16 | 5 | 0 |
| 7659 | 3026 | 2990 | 40723 | 65.6 | CACGCGAAGATGTTAGAGCC | 30 | 16 | 27 | 3 | 36 | 0 |
| 7660 | 3027 | 2991 | 9490 | 73.5 | CACGCGAATCCCGGTACGAA | 30 | 16 | 28 | 18 | 16 | 0 |
| 7661 | 3028 | 2992 | 9491 | 75 | CACGCGAATGCGGATGCTTG | 30 | 16 | 29 | 27 | 11 | 0 |
| 7662 | 3029 | 2993 | 9495 | 63.1 | GCTTTTAGTGATGGACTGCG | 17 | 3 | 2 | 34 | 29 | 0 |
| 7663 | 3030 | 2994 | 9498 | 68.3 | CACGGCTTTCGTGTCTGCTT | 30 | 17 | 10 | 19 | 17 | 0 |
| 7664 | 3031 | 2995 | 9503 | 69.2 | CACGGCTTGCAAGCAACTGT | 30 | 17 | 21 | 21 | 14 | 0 |
| 7665 | 3032 | 2996 | 40725 | 73 | CACGGCTTATCGGTGCGCTT | 30 | 17 | 24 | 33 | 17 | 0 |
| 7666 | 3033 | 2997 | 9510 | 74.8 | CACGGCTTTCCCGTGCCTGT | 30 | 17 | 28 | 33 | 14 | 0 |
| 7667 | 3034 | 2998 | 9513 | 68.1 | CACGGCTTGGACCTGTTGTC | 30 | 17 | 34 | 14 | 9 | 0 |
| 7668 | 3035 | 2999 | 40726 | 69.7 | CACGGCTTAGCCCCATAGGA | 30 | 17 | 36 | 15 | 25 | 0 |
| 7669 | 3036 | 3000 | 9516 | 66.7 | GGTATGATCAGCGATGCACG | 18 | 2 | 31 | 27 | 30 | 0 |
| 7670 | 3037 | 3001 | 40727 | 68.5 | CACGGGTATCGTGCTTCAGC | 30 | 18 | 10 | 17 | 31 | 0 |
| 7671 | 3038 | 3002 | 16011 | 66.3 | GGTACCATGTCTGTGCGTGC | 18 | 15 | 19 | 33 | 33 | 0 |
| 7672 | 3039 | 3003 | 40728 | 64.1 | GGTAGCTTAAAGTCCCGTGC | 18 | 17 | 6 | 28 | 33 | 1 |
| 7673 | 3040 | 3004 | 9527 | 66.1 | CACGGGTAGCAAAGTGATCG | 30 | 18 | 21 | 22 | 24 | 0 |
| 7674 | 3041 | 3005 | 30679 | 67.7 | CACGGGTAAGGACACGTCGT | 30 | 18 | 25 | 30 | 10 | 0 |
| 7675 | 3042 | 3006 | 9530 | 70.7 | GGTAGATGTGCGTCCCTGCG | 18 | 27 | 29 | 28 | 29 | 0 |
| 7676 | 3043 | 3007 | 30680 | 73.5 | CACGGGTAGACCAGCCGCAA | 30 | 18 | 32 | 36 | 21 | 0 |
| 7677 | 3044 | 3008 | 9532 | 66.4 | CACGGGTAGGACAAAGGGAC | 30 | 18 | 34 | 6 | 34 | 0 |
| 7678 | 3045 | 3009 | 9533 | 69.5 | CACGGTCTTGATCACGGCAA | 30 | 19 | 2 | 30 | 21 | 0 |
| 7679 | 3046 | 3010 | 9534 | 71.2 | CACGGTCTTCTGTGCGCCAT | 30 | 19 | 8 | 29 | 15 | 0 |
| 7680 | 3047 | 3011 | 30681 | 67.3 | CACGGTCTGCAAGGTATCCC | 30 | 19 | 21 | 18 | 28 | 0 |
| 7681 | 3048 | 3012 | 9540 | 73.6 | CACGGTCTTGCGACGACCT | 30 | 19 | 29 | 30 | 23 | 0 |
| 7682 | 3049 | 3013 | 9542 | 67.6 | CACGGTCTACGGTTGAAGCC | 30 | 19 | 35 | 1 | 36 | 1 |
| 7683 | 3050 | 3014 | 9545 | 69.4 | CACGGAGTTGATCAGCTGCG | 30 | 20 | 2 | 31 | 29 | 0 |
| 7684 | 3051 | 3015 | 9546 | 65.7 | CACGGAGTTCGTTTAGCAGC | 30 | 20 | 10 | 3 | 31 | 0 |
| 7685 | 3052 | 3016 | 9549 | 71.9 | CACGGAGTGCTTACGGCACG | 30 | 20 | 17 | 35 | 30 | 0 |
| 7686 | 3053 | 3017 | 9550 | 67.4 | CACGGAGTAGGAGACCGTGT | 30 | 20 | 25 | 32 | 33 | 0 |
| 7687 | 3054 | 3019 | 21741 | 72.3 | CACGGAGTAGCCGGACCAGC | 30 | 20 | 36 | 34 | 31 | 0 |
| 7688 | 3055 | 3020 | 9554 | 66.6 | CACGGCAATTGATCTGCCTA | 30 | 21 | 1 | 8 | 26 | 0 |
| 7689 | 3056 | 3022 | 21742 | 69.2 | CACGGCAATGTCACGGAAAG | 30 | 21 | 9 | 35 | 6 | 0 |
| 7690 | 3057 | 3023 | 16021 | 66.8 | CACGGCAACTTGAATCATCG | 30 | 21 | 11 | 4 | 24 | 0 |
| 7691 | 3058 | 3024 | 9561 | 64.9 | CACGGCAAGGTACTCAGACC | 30 | 21 | 18 | 13 | 32 | 0 |
| 7692 | 3059 | 3025 | 30684 | 67.8 | CACGGCAACCTAAGGAATCG | 30 | 21 | 26 | 25 | 24 | 0 |
| 7693 | 3060 | 3026 | 40732 | 65.6 | CACGGCAAGATGTTGAGACC | 30 | 21 | 27 | 1 | 32 | 0 |
| 7694 | 3061 | 3027 | 9568 | 72.5 | CACGGCAATCCCCCTACGAA | 30 | 21 | 28 | 26 | 16 | 0 |
| 7695 | 3062 | 3028 | 9569 | 75.9 | CACGGCAATGCGTCTGCACG | 30 | 21 | 29 | 8 | 30 | 0 |
| 7696 | 3063 | 3029 | 9570 | 75.6 | CACGGCAACACGGTGCATCG | 30 | 21 | 30 | 33 | 24 | 0 |
| 7697 | 3064 | 3030 | 30685 | 68.4 | CACGAGTGGCTTATCGCGTT | 30 | 22 | 17 | 24 | 12 | 0 |
| 7698 | 3065 | 3031 | 9578 | 70.3 | AGTGGATGAGGATGCGCAGC | 22 | 27 | 25 | 29 | 31 | 0 |
| 7699 | 3066 | 3032 | 16024 | 71.3 | AGTGTCCCGCAACCATTCCC | 22 | 28 | 21 | 15 | 28 | 1 |
| 7700 | 3067 | 3033 | 40735 | 69.9 | AGTGGACCAATCCAGCCACG | 22 | 32 | 4 | 31 | 30 | 0 |
| 7701 | 3068 | 3034 | 9585 | 68.4 | CACGACCTTGATGGACCGAA | 30 | 23 | 2 | 34 | 16 | 0 |
| 7702 | 3069 | 3035 | 9586 | 72.2 | ACCTTCTGCGAAACGGCAGC | 23 | 8 | 16 | 35 | 31 | 0 |
| 7703 | 3070 | 3036 | 9587 | 70.9 | CACGACCTTCGTGCAAAGCC | 30 | 23 | 10 | 21 | 36 | 0 |
| 7704 | 3071 | 3037 | 30686 | 69.1 | ACCTCCATATCGGACCGTGC | 23 | 15 | 24 | 32 | 33 | 0 |
| 7705 | 3072 | 3038 | 16026 | 72.7 | CACGACCTATCGTGCGTGCG | 30 | 23 | 24 | 29 | 29 | 0 |

FIG. 29MMM

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7706 | 3073 | 3039 | 9593 | 71.2 | CACGACCTGATGTGCGGACC | 30 | 23 | 27 | 29 | 32 | 0 |
| 7707 | 3074 | 3040 | 9597 | 70.2 | ACCTGGACGGTACACGCAGC | 23 | 34 | 18 | 30 | 31 | 0 |
| 7708 | 3075 | 3041 | 9600 | 70.2 | CACGATCGAATCACGGGACC | 30 | 24 | 4 | 35 | 32 | 0 |
| 7709 | 3076 | 3042 | 9604 | 65.1 | ATCGCTGTAGTGATCGCCAT | 24 | 14 | 22 | 24 | 15 | 0 |
| 7710 | 3077 | 3043 | 30687 | 65.9 | CACGATCGGGTATACAACGG | 30 | 24 | 18 | 7 | 35 | 0 |
| 7711 | 3078 | 3044 | 40739 | 68.8 | ATCGGTCTCTTGTCCCCGAA | 24 | 19 | 11 | 28 | 16 | 1 |
| 7712 | 3079 | 3046 | 9609 | 71.8 | ATCGAGTGCCATCAGCGCAA | 24 | 22 | 15 | 31 | 21 | 0 |
| 7713 | 3080 | 3047 | 9610 | 70.7 | CACGATCGACCTCGAAACGG | 30 | 24 | 23 | 16 | 35 | 0 |
| 7714 | 3081 | 3048 | 16031 | 73.1 | CACGATCGAGCCGATGAGCC | 30 | 24 | 36 | 27 | 36 | 0 |
| 7715 | 3082 | 3049 | 9619 | 69.1 | CACGAGGAAAAGGCAATCCC | 30 | 25 | 6 | 21 | 28 | 0 |
| 7716 | 3083 | 3050 | 9620 | 68.2 | CACGAGGATCGTCTTGACGG | 30 | 25 | 10 | 11 | 35 | 0 |
| 7717 | 3084 | 3051 | 9621 | 69.9 | CACGAGGACTTGTGCGCTCA | 30 | 25 | 11 | 29 | 13 | 0 |
| 7718 | 3085 | 3052 | 30688 | 72.7 | AGGACCATTCCCCAGCGACC | 25 | 15 | 28 | 31 | 32 | 0 |
| 7719 | 3086 | 3054 | 9627 | 67.9 | CACGAGGAACCTTGCGAAAG | 30 | 25 | 23 | 29 | 6 | 0 |
| 7720 | 3087 | 3055 | 9631 | 68.8 | CACGAGGACACGGCTTCTCA | 30 | 25 | 30 | 17 | 13 | 0 |
| 7721 | 3088 | 3056 | 16035 | 71.3 | AGGACAGCGCTTCAGCTCCC | 25 | 31 | 17 | 31 | 28 | 0 |
| 7722 | 3089 | 3058 | 9634 | 67.6 | AGGAGGACAGTGGACCCGTT | 25 | 34 | 22 | 32 | 12 | 0 |
| 7723 | 3090 | 3059 | 30689 | 70.1 | CACGAGGAAGCCTTGAACGG | 30 | 25 | 36 | 1 | 35 | 0 |
| 7724 | 3091 | 3060 | 9640 | 68.6 | CACGCCTAAATCGACCATCG | 30 | 26 | 4 | 32 | 24 | 0 |
| 7725 | 3092 | 3061 | 30691 | 67.6 | CACGCCTAGCTTCGTTAGCC | 30 | 26 | 17 | 12 | 36 | 0 |
| 7726 | 3093 | 3062 | 30692 | 69.6 | CACGCCTAATCGTGCGTCTG | 30 | 26 | 24 | 29 | 8 | 0 |
| 7727 | 3094 | 3063 | 9650 | 65.3 | CACGCCTAGATGGGTACAGC | 30 | 26 | 27 | 18 | 31 | 0 |
| 7728 | 3095 | 3064 | 30693 | 67.8 | CACGGATGTCGTCTTGGGAC | 30 | 27 | 10 | 11 | 34 | 0 |
| 7729 | 3096 | 3065 | 40744 | 72.1 | CACGGATGCTTGTCCCCAT | 30 | 27 | 11 | 28 | 15 | 1 |
| 7730 | 3097 | 3066 | 9660 | 66 | CACGGATGCTCAGCTTTGTC | 30 | 27 | 13 | 17 | 9 | 0 |
| 7731 | 3098 | 3067 | 9663 | 67.4 | CACGGATGGGTATCGTAGCC | 30 | 27 | 18 | 10 | 36 | 0 |
| 7732 | 3099 | 3068 | 30694 | 67.8 | CACGGATGGAGTCAGCCCTA | 30 | 27 | 20 | 31 | 26 | 0 |
| 7733 | 3100 | 3069 | 9671 | 72.5 | CACGGATGCAGCGACCAGTG | 30 | 27 | 31 | 32 | 22 | 0 |
| 7734 | 3101 | 3070 | 9672 | 74.5 | CACGGATGGTGCCGTTCACG | 30 | 27 | 33 | 12 | 30 | 0 |
| 7735 | 3102 | 3071 | 9676 | 75.2 | CACGTCCCAATCGTGCGCAA | 30 | 28 | 4 | 33 | 21 | 0 |
| 7736 | 3103 | 3072 | 16048 | 72.9 | CACGTCCCTCTGGTCAGCC | 30 | 28 | 8 | 33 | 36 | 0 |
| 7737 | 3104 | 3073 | 21776 | 68.1 | CACGTCCCGCTTGGTAGGTA | 30 | 28 | 17 | 18 | 18 | 0 |
| 7738 | 3105 | 3074 | 30695 | 69.2 | TCCCGGTAGCTTGATGGGAC | 28 | 18 | 17 | 27 | 34 | 0 |
| 7739 | 3106 | 3075 | 9686 | 72.1 | TCCCTGCGGGTACTTGCCAT | 28 | 29 | 18 | 11 | 15 | 0 |
| 7740 | 3107 | 3076 | 21783 | 69 | CACGTCCCACGGTGATCTCA | 30 | 28 | 35 | 2 | 13 | 0 |
| 7741 | 3108 | 3077 | 21785 | 69.9 | CACGTGCGTTGAAGTGCGTT | 30 | 29 | 1 | 22 | 12 | 0 |
| 7742 | 3109 | 3078 | 16052 | 71.3 | CACGTGCGATACACGGGAC | 30 | 29 | 5 | 35 | 34 | 0 |
| 7743 | 3110 | 3079 | 30696 | 69.4 | CACGTGCGTACATCCCAGGA | 30 | 29 | 7 | 28 | 25 | 0 |
| 7744 | 3111 | 3080 | 30697 | 72.7 | TGCGTCTGCGTTTCTGCAGC | 29 | 8 | 12 | 8 | 31 | 0 |
| 7745 | 3112 | 3081 | 21787 | 69.6 | CACGTGCGTGTCTCGTTCGT | 30 | 29 | 9 | 10 | 10 | 0 |
| 7746 | 3113 | 3082 | 21789 | 70.6 | TGCGGCTTCCTATCTGGTGC | 29 | 17 | 26 | 8 | 33 | 0 |
| 7747 | 3114 | 3083 | 9697 | 72.6 | CACGTGCGGGTAAGTGCACG | 30 | 29 | 18 | 22 | 30 | 0 |
| 7748 | 3115 | 3084 | 9699 | 69.7 | TGCGGAGTCGTTGAGTCACG | 29 | 20 | 12 | 20 | 30 | 0 |
| 7749 | 3116 | 3085 | 9700 | 71.9 | CACGTGCGGCAAGGTACAGC | 30 | 29 | 21 | 18 | 31 | 0 |
| 7750 | 3117 | 3086 | 9701 | 72.3 | CACGTGCGAGTGCCATGACC | 30 | 29 | 22 | 15 | 32 | 0 |
| 7751 | 3118 | 3087 | 30698 | 71 | CACGTGCGATCGAAAGAGCC | 30 | 29 | 24 | 6 | 36 | 0 |
| 7752 | 3119 | 3088 | 40756 | 72.1 | TGCGCCTACTGTGACCACGG | 29 | 26 | 14 | 32 | 35 | 0 |
| 7753 | 3120 | 3089 | 30700 | 76.3 | TGCGTGCGGCAATACATGCG | 29 | 29 | 21 | 7 | 29 | 0 |

FIG. 29NNN

| SEQ ID NO: | ZIP ID# | 4,633 ID# | H3X ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7754 | 3121 | 3090 | 9705 | 72 | TGCGACGGCCTAAAAGTCCC | 29 | 35 | 26 | 6 | 28 | 1 |
| 7755 | 3122 | 3091 | 9706 | 68.3 | CACGCACGTTGAAATCTCCC | 30 | 30 | 1 | 4 | 28 | 0 |
| 7756 | 3123 | 3092 | 9709 | 71.9 | CACGCACGTCTGGCTTCAGC | 30 | 30 | 8 | 17 | 31 | 0 |
| 7757 | 3124 | 3093 | 40757 | 73.5 | CACGCACGTCGTCTCATGCG | 30 | 30 | 10 | 13 | 29 | 0 |
| 7758 | 3125 | 3094 | 9713 | 66.7 | CACGCACGCCATAAAGAAAG | 30 | 30 | 15 | 6 | 6 | 0 |
| 7759 | 3126 | 3095 | 40759 | 67.1 | CACGGTCTTACACGTTTGCG | 30 | 19 | 7 | 12 | 29 | 0 |
| 7760 | 3127 | 3096 | 9716 | 72.7 | CACGCACGATCGCAGCAATC | 30 | 30 | 24 | 31 | 4 | 0 |
| 7761 | 3128 | 3097 | 9718 | 73.9 | CACGCACGCAGCCGAAGAGT | 30 | 30 | 31 | 16 | 20 | 0 |
| 7762 | 3129 | 3098 | 9719 | 75.6 | CACGCACGGACCGACCGTCT | 30 | 30 | 32 | 32 | 19 | 0 |
| 7763 | 3130 | 3099 | 30701 | 72.2 | CACGCAGCTTAGCACGGTGC | 30 | 31 | 3 | 30 | 33 | 0 |
| 7764 | 3131 | 3100 | 16054 | 73.8 | CACGCAGCTCTGCAGCCCAT | 30 | 31 | 8 | 31 | 15 | 0 |
| 7765 | 3132 | 3101 | 9724 | 68.1 | CACGCAGCCTTGGGTAAAAG | 30 | 31 | 11 | 18 | 6 | 0 |
| 7766 | 3133 | 3102 | 40763 | 76.3 | CACGCAGCCTCAACGGACGG | 30 | 31 | 13 | 35 | 35 | 0 |
| 7767 | 3134 | 3104 | 30702 | 69.7 | CACGCAGCGGTACGTTATCG | 30 | 31 | 18 | 12 | 24 | 0 |
| 7768 | 3135 | 3105 | 9729 | 70.9 | CACGCAGCGTCTGAGTTCCC | 30 | 31 | 19 | 20 | 28 | 0 |
| 7769 | 3136 | 3106 | 9732 | 68.9 | CACGCAGCACCTTTGATCGT | 30 | 31 | 23 | 1 | 10 | 1 |
| 7770 | 3137 | 3107 | 9733 | 71 | CACGCAGCATCGCCTAGACC | 30 | 31 | 24 | 26 | 32 | 0 |
| 7771 | 3138 | 3108 | 9734 | 70.7 | CACGCAGCGATGGGTAGACC | 30 | 31 | 27 | 18 | 32 | 0 |
| 7772 | 3139 | 3109 | 9735 | 75.4 | CACGCAGCTCCCCTTGGTGC | 30 | 31 | 28 | 11 | 33 | 0 |
| 7773 | 3140 | 3110 | 40766 | 70.1 | CACGGACCAATCTGCGACCT | 30 | 32 | 4 | 29 | 23 | 0 |
| 7774 | 3141 | 3111 | 16056 | 71.6 | CACGGACCTCTGCGTTCACG | 30 | 32 | 8 | 12 | 30 | 0 |
| 7775 | 3142 | 3112 | 30703 | 73.2 | CACGGACCCCATGATGGTGC | 30 | 32 | 15 | 27 | 33 | 0 |
| 7776 | 3143 | 3113 | 9749 | 71.6 | CACGGACCGCAATCGTCTTG | 30 | 32 | 21 | 10 | 11 | 0 |
| 7777 | 3144 | 3114 | 9750 | 70.9 | CACGGACCATCGAATCCGAA | 30 | 32 | 24 | 4 | 16 | 0 |
| 7778 | 3145 | 3115 | 9751 | 64.8 | GACCAGGAGGTATGTCTGCG | 32 | 25 | 18 | 9 | 29 | 0 |
| 7779 | 3146 | 3116 | 40770 | 67.8 | CACGGACCGATGTTAGCCAT | 30 | 32 | 27 | 3 | 15 | 0 |
| 7780 | 3147 | 3117 | 16058 | 70.8 | CACGGTGCTTAGACGGGTGC | 30 | 33 | 3 | 35 | 33 | 0 |
| 7781 | 3148 | 3118 | 9758 | 72.1 | CACGGTGCAATCCCATCACG | 30 | 33 | 4 | 15 | 30 | 0 |
| 7782 | 3149 | 3119 | 40772 | 68.9 | CACGGTGCAAAGAAAGCAGC | 30 | 33 | 6 | 6 | 31 | 0 |
| 7783 | 3150 | 3121 | 30704 | 72.5 | CACGGTGCTCTGCTTGCGAA | 30 | 33 | 8 | 11 | 16 | 0 |
| 7784 | 3151 | 3122 | 9760 | 72.2 | CACGGTGCCTTGCGAACTCA | 30 | 33 | 11 | 16 | 13 | 0 |
| 7785 | 3152 | 3123 | 40773 | 68.6 | CACGGTGCCTCAACCTCTCA | 30 | 33 | 13 | 23 | 13 | 0 |
| 7786 | 3153 | 3124 | 9764 | 72.1 | CACGGTGCCGAAAGGAGACC | 30 | 33 | 16 | 25 | 32 | 0 |
| 7787 | 3154 | 3125 | 9766 | 74.1 | CACGGTGCGAGTGCAAAGCC | 30 | 33 | 20 | 21 | 36 | 0 |
| 7788 | 3155 | 3126 | 40775 | 68.9 | CACGGTGCACCTAGGAGCAA | 30 | 33 | 23 | 25 | 21 | 0 |
| 7789 | 3156 | 3127 | 9770 | 71 | CACGGTGCAGGAATCGAGGA | 30 | 33 | 25 | 24 | 25 | 0 |
| 7790 | 3157 | 3128 | 9771 | 67.2 | CACGGTGCCCTAACCTCCTA | 30 | 33 | 26 | 23 | 26 | 0 |
| 7791 | 3158 | 3129 | 9772 | 74.7 | CACGGTGCTCCCAGCCTGT | 30 | 33 | 28 | 31 | 14 | 0 |
| 7792 | 3159 | 3130 | 9773 | 73.4 | CACGGTGCTGCGTGATGTGC | 30 | 33 | 29 | 2 | 33 | 0 |
| 7793 | 3160 | 3131 | 30705 | 79.3 | CACGGTGCGGACGTGCAGCC | 30 | 33 | 34 | 33 | 36 | 0 |
| 7794 | 3161 | 3132 | 40776 | 68.1 | GGACTTGAGCTTCGTTTGCG | 34 | 1 | 17 | 12 | 29 | 0 |
| 7795 | 3162 | 3133 | 9778 | 67.4 | CACGGGACAATCTTGAAGCC | 30 | 34 | 4 | 1 | 36 | 0 |
| 7796 | 3163 | 3134 | 9779 | 67.5 | CACGGGACATACAGCCACCT | 30 | 34 | 5 | 36 | 23 | 0 |
| 7797 | 3164 | 3135 | 21811 | 66.9 | CACGGGACCTCACTCAGCTT | 30 | 34 | 13 | 13 | 17 | 0 |
| 7798 | 3165 | 3136 | 9783 | 65.5 | GGACCTGTCTTGAGTGCACG | 34 | 14 | 11 | 22 | 30 | 0 |
| 7799 | 3166 | 3137 | 9789 | 68.3 | CACGGGACGAGTTTGAATCG | 30 | 34 | 20 | 1 | 24 | 0 |
| 7800 | 3167 | 3138 | 30706 | 72 | CACGGGACCCTAGTGCGGAC | 30 | 34 | 26 | 33 | 34 | 0 |
| 7801 | 3168 | 3139 | 9793 | 72.9 | CACGGGACGACCACGGTGAT | 30 | 34 | 32 | 35 | 2 | 0 |

FIG. 29OOO

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7802 | 3169 | 3140 | 9796 | 66 | ACGGAATCTCGTTGATTCCC | 35 | 4 | 10 | 2 | 28 | 0 |
| 7803 | 3170 | 3141 | 16062 | 70.8 | CACGACGGTACAAGCCCAGC | 30 | 35 | 7 | 36 | 31 | 0 |
| 7804 | 3171 | 3142 | 9799 | 75.7 | CACGACGGTGTCGTGCGTGC | 30 | 35 | 9 | 33 | 33 | 0 |
| 7805 | 3172 | 3143 | 21817 | 68.9 | ACGGAGTGCTTGTTGATGCG | 35 | 22 | 11 | 1 | 29 | 1 |
| 7806 | 3173 | 3144 | 16063 | 73.5 | CACGACGGATCGCGTTTCGT | 30 | 35 | 24 | 12 | 10 | 0 |
| 7807 | 3174 | 3145 | 9806 | 73 | CACGACGGCAGCTCTGGCTT | 30 | 35 | 31 | 8 | 17 | 0 |
| 7808 | 3175 | 3146 | 9807 | 69.5 | CACGACGGGACAGGAAATC | 30 | 35 | 34 | 25 | 4 | 0 |
| 7809 | 3176 | 3147 | 9810 | 70.5 | CACGAGCCAAAGTGCGGAGT | 30 | 36 | 6 | 29 | 20 | 0 |
| 7810 | 3177 | 3148 | 9811 | 71.9 | CACGAGCCTACAACGGTGCG | 30 | 36 | 7 | 35 | 29 | 0 |
| 7811 | 3178 | 3149 | 9812 | 67.5 | CACGAGCCTCTGAATCGCTT | 30 | 36 | 8 | 4 | 17 | 0 |
| 7812 | 3179 | 3150 | 9813 | 70.5 | CACGAGCCTGTCAGCCCCTA | 30 | 36 | 9 | 36 | 26 | 0 |
| 7813 | 3180 | 3151 | 40781 | 70.5 | CACGAGCCCTCACGTTGGAC | 30 | 36 | 13 | 12 | 34 | 0 |
| 7814 | 3181 | 3152 | 9817 | 67.8 | CACGAGCCGCTTACCTAGGA | 30 | 36 | 17 | 23 | 25 | 0 |
| 7815 | 3182 | 3154 | 30707 | 71.1 | CACGAGCCAGTGCGTTAGCC | 30 | 36 | 22 | 12 | 36 | 0 |
| 7816 | 3183 | 3155 | 30708 | 70.6 | AGCCACCTCAGCAGTGCAGC | 36 | 23 | 31 | 22 | 31 | 0 |
| 7817 | 3184 | 3156 | 16069 | 77.5 | CACGAGCCTGCGGACCGGAC | 30 | 36 | 29 | 32 | 34 | 0 |
| 7818 | 3185 | 3157 | 9827 | 76.3 | CACGAGCCCACGGCAACAGC | 30 | 36 | 30 | 21 | 31 | 0 |
| 7819 | 3186 | 3158 | 9830 | 73.9 | AGCCGTGCGAGTCTTGTGCG | 36 | 33 | 20 | 11 | 29 | 0 |
| 7820 | 3187 | 3159 | 9831 | 72.5 | CACGAGCCGGACCTCATCGT | 30 | 36 | 34 | 13 | 10 | 0 |
| 7821 | 3188 | 3160 | 9837 | 72.8 | TTGAGTGCCGAAAGCCGGAC | 1 | 33 | 16 | 36 | 34 | 0 |
| 7822 | 3189 | 3161 | 9839 | 71.2 | TGATGCTTGGACAGCCCAGC | 2 | 17 | 34 | 36 | 31 | 0 |
| 7823 | 3190 | 3162 | 16071 | 70.6 | TGATGCAACACGCTTGGTGC | 2 | 21 | 30 | 11 | 33 | 0 |
| 7824 | 3191 | 3163 | 40784 | 71.8 | TGATTCCCAGTGCACGGTGC | 2 | 28 | 22 | 30 | 33 | 0 |
| 7825 | 3192 | 3164 | 9848 | 70.2 | AATCTCGTACGGCACGCGTT | 4 | 10 | 35 | 30 | 12 | 0 |
| 7826 | 3193 | 3165 | 9849 | 67.3 | AATCCTCACGTTAGCCGTGC | 4 | 13 | 12 | 36 | 33 | 0 |
| 7827 | 3194 | 3166 | 9851 | 68.8 | CAGCAATCGGTAACGGCTTG | 31 | 4 | 18 | 35 | 11 | 0 |
| 7828 | 3195 | 3167 | 9852 | 70 | CAGCAATCGTCTTCCCCAGC | 31 | 4 | 19 | 28 | 31 | 0 |
| 7829 | 3196 | 3168 | 9854 | 67.2 | CAGCAATCATCGAAAGCACG | 31 | 4 | 24 | 6 | 30 | 0 |
| 7830 | 3197 | 3169 | 9861 | 72.1 | ATACTCCCACGGACGGCGAA | 5 | 28 | 35 | 35 | 16 | 0 |
| 7831 | 3198 | 3170 | 40787 | 73.9 | CAGCATACTGCGCACGTGCG | 31 | 5 | 29 | 30 | 29 | 0 |
| 7832 | 3199 | 3172 | 9874 | 69.1 | AAAGGTGCGTCTAGCCAGCC | 6 | 33 | 19 | 36 | 36 | 0 |
| 7833 | 3200 | 3173 | 9875 | 69.6 | AAAGACGGCACGAGTGAGCC | 6 | 35 | 30 | 22 | 36 | 0 |
| 7834 | 3201 | 3174 | 9880 | 74.3 | TCTGGATGAGCCACGGCACG | 8 | 27 | 36 | 35 | 30 | 0 |
| 7835 | 3202 | 3175 | 9886 | 71.6 | TGTCCTTGTCCCGCTTTCCC | 9 | 11 | 28 | 17 | 28 | 1 |
| 7836 | 3203 | 3176 | 9887 | 74.2 | TGTCCTCATGCGTGCGGACC | 9 | 13 | 29 | 29 | 32 | 0 |
| 7837 | 3204 | 3177 | 9894 | 73 | CAGCTGTCGTGCCCATGCAA | 31 | 9 | 33 | 15 | 21 | 0 |
| 7838 | 3205 | 3178 | 9896 | 70.4 | TGTCAGCCCGAAACCTACGG | 9 | 36 | 16 | 23 | 35 | 0 |
| 7839 | 3206 | 3179 | 9902 | 72.4 | CAGCTCGTTCCCGCTTGGAC | 31 | 10 | 28 | 17 | 34 | 0 |
| 7840 | 3207 | 3180 | 40795 | 70 | TCGTCAGCTCGTGAGTTGCG | 10 | 31 | 10 | 20 | 29 | 0 |
| 7841 | 3208 | 3181 | 16096 | 67.8 | CTTGAAAGGCTTAGCCTGCG | 11 | 6 | 17 | 36 | 29 | 0 |
| 7842 | 3209 | 3182 | 21838 | 69.8 | CAGCCTTGTCTGGACCAGCC | 31 | 11 | 8 | 32 | 36 | 0 |
| 7843 | 3210 | 3183 | 9910 | 63.9 | CAGCCTTGTCGTATACGTGC | 31 | 11 | 10 | 5 | 33 | 0 |
| 7844 | 3211 | 3184 | 9915 | 70.9 | CAGCCTTGAGTGGACCTGCG | 31 | 11 | 22 | 32 | 29 | 0 |
| 7845 | 3212 | 3185 | 40798 | 67.6 | CTTGAGGAGCAAGACCACGG | 11 | 25 | 21 | 32 | 35 | 0 |
| 7846 | 3213 | 3186 | 16097 | 69.8 | CAGCCTTGTCCCCTCAATCG | 31 | 11 | 28 | 13 | 24 | 1 |
| 7847 | 3214 | 3187 | 9921 | 71.7 | CAGCCTTGGACCCGTTCGTT | 31 | 11 | 32 | 12 | 12 | 0 |
| 7848 | 3215 | 3188 | 9922 | 69.7 | CAGCCTTGACGGGCAAGTCT | 31 | 11 | 35 | 21 | 19 | 0 |
| 7849 | 3216 | 3189 | 16099 | 65 | CAGCCGTTTACATCTGTCCC | 31 | 12 | 7 | 8 | 28 | 0 |

FIG. 29PPP

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7850 | 3217 | 3190 | 30714 | 68.2 | CAGCCGTTTCTGAAAGCAGC | 31 | 12 | 8 | 6 | 31 | 0 |
| 7851 | 3218 | 3191 | 30715 | 70.9 | CAGCCGTTGCTTAGCCCTCA | 31 | 12 | 17 | 36 | 13 | 0 |
| 7852 | 3219 | 3192 | 9931 | 67.4 | CAGCCGTTGGTAACCTGACC | 31 | 12 | 18 | 23 | 32 | 0 |
| 7853 | 3220 | 3193 | 16101 | 70.5 | CAGCCGTTGCAAATCGGTCT | 31 | 12 | 21 | 24 | 19 | 0 |
| 7854 | 3221 | 3194 | 9933 | 67.1 | CAGCCGTTATCGGATGACCT | 31 | 12 | 24 | 27 | 23 | 0 |
| 7855 | 3222 | 3195 | 16102 | 65.4 | CGTTCCTAACGGATACCACG | 12 | 26 | 35 | 5 | 30 | 0 |
| 7856 | 3223 | 3196 | 30717 | 67.1 | CGTTGTGCTCGTAAAGGCAA | 12 | 33 | 10 | 6 | 21 | 0 |
| 7857 | 3224 | 3197 | 9939 | 72.7 | CAGCCGTTGGACGATGGCTT | 31 | 12 | 34 | 27 | 17 | 0 |
| 7858 | 3225 | 3198 | 16104 | 72.1 | CAGCCGTTAGCCGCTTAGCC | 31 | 12 | 36 | 17 | 36 | 0 |
| 7859 | 3226 | 3199 | 30718 | 65.4 | CAGCCTCATCGTAAAGGTGC | 31 | 13 | 10 | 6 | 33 | 0 |
| 7860 | 3227 | 3200 | 30719 | 71.7 | CAGCCTCACCATCAGCGTGC | 31 | 13 | 15 | 31 | 33 | 0 |
| 7861 | 3228 | 3201 | 40805 | 68.1 | CAGCCTCACGAACGAACGTT | 31 | 13 | 16 | 16 | 12 | 0 |
| 7862 | 3229 | 3202 | 40806 | 69.4 | CAGCCTCAGCTTTCGTGCAA | 31 | 13 | 17 | 10 | 21 | 0 |
| 7863 | 3230 | 3203 | 9945 | 67.3 | CAGCCTCAGCAAGACCGAGT | 31 | 13 | 21 | 32 | 20 | 0 |
| 7864 | 3231 | 3204 | 40807 | 64.4 | CAGCCTCAACCTAATCGACC | 31 | 13 | 23 | 4 | 32 | 0 |
| 7865 | 3232 | 3205 | 9947 | 69.8 | CAGCCTCATCCCGACCAAAG | 31 | 13 | 28 | 32 | 6 | 0 |
| 7866 | 3233 | 3206 | 9950 | 67.4 | CTCAGACCTGATTCCCTGCG | 13 | 32 | 2 | 28 | 29 | 0 |
| 7867 | 3234 | 3207 | 9954 | 64 | CAGCCTGTTTGATCGTTTGA | 31 | 14 | 1 | 10 | 1 | 0 |
| 7868 | 3235 | 3208 | 9955 | 68.2 | CTGTTGATCGAATCCCGTGC | 14 | 2 | 16 | 28 | 33 | 0 |
| 7869 | 3236 | 3209 | 9956 | 70.1 | CAGCCTGTTCTGCGTTGCAA | 31 | 14 | 8 | 12 | 21 | 0 |
| 7870 | 3237 | 3210 | 9959 | 70 | CAGCCTGTCTCAAGCCGGAC | 31 | 14 | 13 | 36 | 34 | 0 |
| 7871 | 3238 | 3211 | 40810 | 69.1 | CAGCCTGTCCATCTCATGCG | 31 | 14 | 15 | 13 | 29 | 0 |
| 7872 | 3239 | 3212 | 9961 | 67.4 | CAGCCTGTGCTTCTCATCCC | 31 | 14 | 17 | 13 | 28 | 0 |
| 7873 | 3240 | 3213 | 21844 | 70.7 | CAGCCTGTGTGCCGAAGCTT | 31 | 14 | 33 | 16 | 17 | 0 |
| 7874 | 3241 | 3214 | 16113 | 70.1 | CAGCCCATTACACACGCACG | 31 | 15 | 7 | 30 | 30 | 0 |
| 7875 | 3242 | 3215 | 16114 | 70 | CAGCCCATTCTGCCATCCAT | 31 | 15 | 8 | 15 | 15 | 0 |
| 7876 | 3243 | 3216 | 30720 | 66.4 | CAGCCCATCTTGTGATCACG | 31 | 15 | 11 | 2 | 30 | 0 |
| 7877 | 3244 | 3217 | 30721 | 70.3 | CAGCCCATCGTTGCTTCCAT | 31 | 15 | 12 | 17 | 15 | 0 |
| 7878 | 3245 | 3218 | 40813 | 68.4 | CCATGTCTCCATGACCACGG | 15 | 19 | 15 | 32 | 35 | 0 |
| 7879 | 3246 | 3219 | 40814 | 68.5 | CCATGAGTGCTTAGCCACGG | 15 | 20 | 17 | 36 | 35 | 0 |
| 7880 | 3247 | 3220 | 9977 | 69.7 | CAGCCCATGCAATCTGCTCA | 31 | 15 | 21 | 8 | 13 | 0 |
| 7881 | 3248 | 3221 | 40815 | 71.6 | CAGCCCATCCTAACGGCCAT | 31 | 15 | 26 | 35 | 15 | 0 |
| 7882 | 3249 | 3222 | 30722 | 69.7 | CAGCCCATCACGAAAGGCTT | 31 | 15 | 30 | 6 | 17 | 0 |
| 7883 | 3250 | 3223 | 9988 | 70.6 | CAGCCCATACGGGAGTGTGC | 31 | 15 | 35 | 20 | 33 | 0 |
| 7884 | 3251 | 3224 | 40818 | 68.6 | CAGCCGAATCTGAAAGCGAA | 31 | 16 | 8 | 6 | 16 | 0 |
| 7885 | 3252 | 3225 | 9994 | 68.5 | CAGCCGAATGTCCGTTCTTG | 31 | 16 | 9 | 12 | 11 | 0 |
| 7886 | 3253 | 3226 | 16124 | 67.9 | CAGCCGAAGTCTTGCGAATC | 31 | 16 | 19 | 29 | 4 | 0 |
| 7887 | 3254 | 3227 | 40821 | 67.8 | CGAAAGTGATACGTGCGCAA | 16 | 22 | 5 | 33 | 21 | 0 |
| 7888 | 3255 | 3228 | 40822 | 68.4 | CAGCCGAAAGGATGTCATCG | 31 | 16 | 25 | 9 | 24 | 0 |
| 7889 | 3256 | 3229 | 10006 | 76.9 | CAGCCGAATGCGCTTGGCAA | 31 | 16 | 29 | 11 | 21 | 0 |
| 7890 | 3257 | 3230 | 16127 | 73 | CAGCCGAACACGGCTTGCTT | 31 | 16 | 30 | 17 | 17 | 0 |
| 7891 | 3258 | 3231 | 10009 | 68.3 | CGAAGACCCACGATACGTGC | 16 | 32 | 30 | 5 | 33 | 0 |
| 7892 | 3259 | 3232 | 10010 | 74 | CAGCCGAAACGGCACGTGTC | 31 | 16 | 35 | 30 | 9 | 0 |
| 7893 | 3260 | 3233 | 10011 | 70.3 | CAGCCGAAAGCCGGTAGATG | 31 | 16 | 36 | 18 | 27 | 0 |
| 7894 | 3261 | 3234 | 30724 | 66.8 | CAGCGCTTAATCTGCGTCTG | 31 | 17 | 4 | 29 | 8 | 0 |
| 7895 | 3262 | 3235 | 10015 | 64.2 | CAGCGCTTTACACGTTTGTC | 31 | 17 | 7 | 12 | 9 | 0 |
| 7896 | 3263 | 3236 | 30725 | 68.4 | CAGCGCTTTGTCCGAAAAAG | 31 | 17 | 9 | 16 | 6 | 0 |
| 7897 | 3264 | 3237 | 16128 | 69.5 | CAGCGCTTTCGTTCGTTTGA | 31 | 17 | 10 | 10 | 1 | 0 |

FIG. 29QQQ

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7898 | 3265 | 3238 | 10019 | 69.5 | CAGCGCTTCTCAGGACCCAT | 31 | 17 | 13 | 34 15 | 0 |
| 7899 | 3266 | 3239 | 21856 | 69 | CAGCGCTTCTGTCGAAGTGC | 31 | 17 | 14 | 16 33 | 0 |
| 7900 | 3267 | 3240 | 10024 | 68.5 | CAGCGCTTATCGCGAAAATC | 31 | 17 | 24 | 16 4 | 0 |
| 7901 | 3268 | 3241 | 10026 | 73.3 | CAGCGCTTTGCGGCTTGAGT | 31 | 17 | 29 | 17 20 | 0 |
| 7902 | 3269 | 3242 | 10029 | 66.1 | CAGCGCTTAGCCTTGACTTG | 31 | 17 | 36 | 1 11 | 0 |
| 7903 | 3270 | 3243 | 30726 | 67.9 | CAGCGGTACCATCCATGACC | 31 | 18 | 15 | 15 32 | 0 |
| 7904 | 3271 | 3244 | 10036 | 66.4 | CAGCGGTACGAACGAACTTG | 31 | 18 | 16 | 16 11 | 0 |
| 7905 | 3272 | 3245 | 30727 | 68.4 | CAGCGGTACAGCACCTGCTT | 31 | 18 | 31 | 23 17 | 0 |
| 7906 | 3273 | 3246 | 10046 | 68.3 | CAGCGTCTTGATGGACCAGC | 31 | 19 | 2 | 34 31 | 0 |
| 7907 | 3274 | 3247 | 30728 | 65.6 | GTCTCCATCTCATCGTTGCG | 19 | 15 | 13 | 10 29 | 0 |
| 7908 | 3275 | 3248 | 30729 | 70 | CAGCGTCTCGAATCGTTCCC | 31 | 19 | 16 | 10 28 | 0 |
| 7909 | 3276 | 3249 | 21861 | 67.8 | CAGCGTCTGCTTATCGTCCC | 31 | 19 | 17 | 24 28 | 0 |
| 7910 | 3277 | 3250 | 10050 | 68.7 | CAGCGTCTTGCGAGGAGATG | 31 | 19 | 29 | 25 27 | 0 |
| 7911 | 3278 | 3251 | 30730 | 66 | CAGCGTCTGGACTTGAATCG | 31 | 19 | 34 | 1 24 | 0 |
| 7912 | 3279 | 3252 | 40828 | 68.5 | CAGCGTCTACGGAATCACGG | 31 | 19 | 35 | 4 35 | 0 |
| 7913 | 3280 | 3253 | 10056 | 69.8 | CAGCGAGTTCTGCAGCGATG | 31 | 20 | 8 | 31 27 | 0 |
| 7914 | 3281 | 3254 | 10057 | 69.5 | CAGCGAGTCTTGGCAACACG | 31 | 20 | 11 | 21 30 | 0 |
| 7915 | 3282 | 3255 | 10058 | 63.5 | CAGCGAGTCGTTATCGTGTC | 31 | 20 | 12 | 24 9 | 0 |
| 7916 | 3283 | 3257 | 30731 | 68.4 | CAGCGAGTCGAAAGGACGAA | 31 | 20 | 16 | 25 16 | 0 |
| 7917 | 3284 | 3259 | 16142 | 75.2 | CAGCGAGTGTGCGACCTGCG | 31 | 20 | 33 | 32 29 | 0 |
| 7918 | 3285 | 3260 | 40831 | 69.6 | CAGCGCAATGATCGAAATCG | 31 | 21 | 2 | 16 24 | 0 |
| 7919 | 3286 | 3261 | 16143 | 66.5 | CAGCGCAAATACAATCCAGC | 31 | 21 | 5 | 4 31 | 0 |
| 7920 | 3287 | 3262 | 16144 | 69.6 | CAGCGCAATCTGGCTTGATG | 31 | 21 | 8 | 17 27 | 0 |
| 7921 | 3288 | 3263 | 10076 | 71.6 | CAGCGCAATGTCCGTTGGAC | 31 | 21 | 9 | 12 34 | 0 |
| 7922 | 3289 | 3264 | 10078 | 69.4 | CAGCGCAACCATGGTAATCG | 31 | 21 | 15 | 18 24 | 0 |
| 7923 | 3290 | 3265 | 10079 | 69.7 | CAGCGCAACGAATCGTCTTG | 31 | 21 | 16 | 10 11 | 0 |
| 7924 | 3291 | 3266 | 30732 | 68.1 | CAGCGCAAGGTAGCAAGACC | 31 | 21 | 18 | 21 32 | 0 |
| 7925 | 3292 | 3267 | 10081 | 66.5 | CAGCGCAAGAGTCGTTCTTG | 31 | 21 | 20 | 12 11 | 0 |
| 7926 | 3293 | 3268 | 40833 | 68.5 | CAGCGCAAAGTGTGATTCCC | 31 | 21 | 22 | 2 28 | 0 |
| 7927 | 3294 | 3269 | 10084 | 73 | CAGCGCAAGGACGATGGACC | 31 | 21 | 34 | 27 32 | 0 |
| 7928 | 3295 | 3270 | 10085 | 75 | CAGCGCAAACGGTCGTCACG | 31 | 21 | 35 | 10 30 | 0 |
| 7929 | 3296 | 3271 | 10086 | 70.8 | AGTGTCGTGTGCTCCCCACG | 22 | 10 | 33 | 28 30 | 0 |
| 7930 | 3297 | 3272 | 30733 | 69.3 | AGTGGCTTGTGCCTGTTCCC | 22 | 17 | 33 | 14 28 | 0 |
| 7931 | 3298 | 3274 | 10093 | 69.8 | CAGCAGTGCCTAATCGCACG | 31 | 22 | 26 | 24 30 | 0 |
| 7932 | 3299 | 3275 | 16147 | 70.1 | CAGCAGTGTCCCCTTGCCAT | 31 | 22 | 28 | 11 15 | 1 |
| 7933 | 3300 | 3276 | 10097 | 70.2 | AGTGGGACGTCTACGGTGCG | 22 | 34 | 19 | 35 29 | 0 |
| 7934 | 3301 | 3277 | 16148 | 68.8 | CAGCACCTCGAAAATCTGCG | 31 | 23 | 16 | 4 29 | 0 |
| 7935 | 3302 | 3278 | 30734 | 69.9 | CAGCACCTCACGTCTGCGAA | 31 | 23 | 30 | 8 16 | 0 |
| 7936 | 3303 | 3279 | 10108 | 70.5 | ACCTGTGCGACCTGTCCGAA | 23 | 33 | 32 | 9 16 | 0 |
| 7937 | 3304 | 3280 | 10109 | 71.8 | CAGCACCTGGACGCTTGTGC | 31 | 23 | 34 | 17 33 | 0 |
| 7938 | 3305 | 3281 | 30735 | 68.7 | CAGCATCGGCTTACCTGTGC | 31 | 24 | 17 | 23 33 | 0 |
| 7939 | 3306 | 3282 | 30736 | 68.6 | ATCGGGTAAGTGAGCCGCTT | 24 | 18 | 22 | 36 17 | 0 |
| 7940 | 3307 | 3283 | 16154 | 70.1 | ATCGATCGGCAATCTGGTGC | 24 | 24 | 21 | 8 33 | 0 |
| 7941 | 3308 | 3284 | 10125 | 74.3 | CAGCATCGACGGCACGGGTA | 31 | 24 | 35 | 30 18 | 0 |
| 7942 | 3309 | 3285 | 10128 | 69.6 | CAGCAGGAAATCACGGTCCC | 31 | 25 | 4 | 35 28 | 1 |
| 7943 | 3310 | 3286 | 10130 | 67.9 | AGGATCGTGTCTCGAATGCG | 25 | 10 | 19 | 16 29 | 0 |
| 7944 | 3311 | 3287 | 10131 | 71.8 | CAGCAGGACTTGACGGCACG | 31 | 25 | 11 | 35 30 | 0 |
| 7945 | 3312 | 3288 | 30737 | 71 | CAGCAGGAGCAAATCGGTGC | 31 | 25 | 21 | 24 33 | 0 |

FIG. 29RRR

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 7946 | 3313 | 3289 | 10133 | 69.1 | CAGCAGGAAGTGTGCGCTGT | 31 | 25 | 22 | 29 | 14 | 0 |
| 7947 | 3314 | 3290 | 16157 | 70.3 | CAGCAGGACACGGATGGCTT | 31 | 25 | 30 | 27 | 17 | 0 |
| 7948 | 3315 | 3291 | 10135 | 67.4 | AGGAGTGCTCTGGGACTCCC | 25 | 33 | 8 | 34 | 28 | 0 |
| 7949 | 3316 | 3292 | 10136 | 67.6 | CAGCAGGAAGCCATACGGAC | 31 | 25 | 36 | 5 | 34 | 0 |
| 7950 | 3317 | 3293 | 30738 | 66.9 | CCTATCGTGCTTTGTCGCAA | 26 | 10 | 17 | 9 | 21 | 0 |
| 7951 | 3318 | 3294 | 30739 | 68 | CAGCCCTACGAATCTGCAGC | 31 | 26 | 16 | 8 | 31 | 0 |
| 7952 | 3319 | 3295 | 30740 | 65.1 | CCTAGCAAATACTCCCTGCG | 26 | 21 | 5 | 28 | 29 | 0 |
| 7953 | 3320 | 3296 | 16161 | 66.6 | CAGCCCTAAGTGAGCCGTCT | 31 | 26 | 22 | 36 | 19 | 0 |
| 7954 | 3321 | 3297 | 40839 | 70.6 | CAGCCCTAACCTTCCCAGCC | 31 | 26 | 23 | 28 | 36 | 1 |
| 7955 | 3322 | 3298 | 10148 | 67.1 | CAGCCCTAACGGTCGTCTGT | 31 | 26 | 35 | 10 | 14 | 0 |
| 7956 | 3323 | 3299 | 10151 | 70.4 | CAGCGATGAATCCACGGGAC | 31 | 27 | 4 | 30 | 34 | 0 |
| 7957 | 3324 | 3300 | 21879 | 63.4 | CAGCGATGTCTGACCTATCG | 31 | 27 | 8 | 23 | 24 | 0 |
| 7958 | 3325 | 3301 | 10152 | 69.1 | GATGTGTCCCATGCTTTGCG | 27 | 9 | 15 | 17 | 29 | 0 |
| 7959 | 3326 | 3302 | 10154 | 67.3 | CAGCGATGCTTGCTGTCTTG | 31 | 27 | 11 | 14 | 11 | 0 |
| 7960 | 3327 | 3303 | 16166 | 67.1 | CAGCGATGCTCAGTGCTCTG | 31 | 27 | 13 | 33 | 8 | 0 |
| 7961 | 3328 | 3304 | 40841 | 67.7 | GATGGTCTTGATTCCCGCAA | 27 | 19 | 2 | 28 | 21 | 0 |
| 7962 | 3329 | 3305 | 16169 | 67.9 | CAGCGATGAGGATCGTTCGT | 31 | 27 | 25 | 10 | 10 | 0 |
| 7963 | 3330 | 3306 | 30741 | 66.3 | CAGCGATGCCTAGCAACCTA | 31 | 27 | 26 | 21 | 26 | 0 |
| 7964 | 3331 | 3307 | 16170 | 70.4 | CAGCGATGTCCCCTTGCCTA | 31 | 27 | 28 | 11 | 26 | 0 |
| 7965 | 3332 | 3308 | 10164 | 68.9 | CAGCGATGGACCGATGAGTG | 31 | 27 | 32 | 27 | 22 | 0 |
| 7966 | 3333 | 3309 | 10167 | 70.9 | CAGCGATGACGGGATGTCGT | 31 | 27 | 35 | 27 | 10 | 0 |
| 7967 | 3334 | 3310 | 10168 | 72.3 | CAGCGATGAGCCCTGTGCAA | 31 | 27 | 36 | 14 | 21 | 0 |
| 7968 | 3335 | 3311 | 30742 | 68.5 | TCCCAAAGTCCCCTGTAGCC | 28 | 6 | 28 | 14 | 36 | 1 |
| 7969 | 3336 | 3312 | 30743 | 68.5 | TCCCCGTTAAAGATCGGACC | 28 | 12 | 6 | 24 | 32 | 0 |
| 7970 | 3337 | 3313 | 30744 | 69.7 | CAGCTCCCTGTATCGCGTT | 31 | 28 | 14 | 24 | 12 | 0 |
| 7971 | 3338 | 3314 | 10175 | 70.9 | TCCCCGAAATCGTGTCGATG | 28 | 16 | 24 | 9 | 27 | 0 |
| 7972 | 3339 | 3315 | 30745 | 69.8 | TCCCGAGTGCTTTTGAAGCC | 28 | 20 | 17 | 1 | 36 | 0 |
| 7973 | 3340 | 3316 | 10178 | 67.3 | TCCCAGTGTTAGACGGCCAT | 28 | 22 | 3 | 35 | 15 | 0 |
| 7974 | 3341 | 3317 | 10179 | 66.3 | CAGCTCCCACCTACCTGGAC | 31 | 28 | 23 | 23 | 34 | 0 |
| 7975 | 3342 | 3318 | 10180 | 69.6 | TCCCGATGGTCTTCGTCGTT | 28 | 27 | 19 | 10 | 12 | 0 |
| 7976 | 3343 | 3319 | 16176 | 72.6 | CAGCTCCCTCCCGAGTTCCC | 31 | 28 | 28 | 20 | 28 | 0 |
| 7977 | 3344 | 3320 | 10182 | 70.7 | TCCCTGCGAATCAGGACGAA | 28 | 29 | 4 | 25 | 16 | 0 |
| 7978 | 3345 | 3321 | 10183 | 73 | TCCCCACGGATGATCGATCG | 28 | 30 | 27 | 24 | 24 | 0 |
| 7979 | 3346 | 3322 | 10186 | 70.8 | TCCCACGGTCGTTGTCCTTG | 28 | 35 | 10 | 9 | 11 | 0 |
| 7980 | 3347 | 3323 | 16177 | 71.6 | CAGCTGCGTTGAGTGCCGTT | 31 | 29 | 1 | 33 | 12 | 0 |
| 7981 | 3348 | 3324 | 40843 | 68.5 | TGCGTTAGTCTGGGACCGAA | 29 | 3 | 8 | 34 | 16 | 0 |
| 7982 | 3349 | 3325 | 16179 | 72.4 | TGCGATACCGAAAGCCCGTT | 29 | 5 | 16 | 36 | 12 | 0 |
| 7983 | 3350 | 3326 | 16180 | 73.3 | CAGCTGCGTCTGGACCCAGC | 31 | 29 | 8 | 32 | 31 | 0 |
| 7984 | 3351 | 3327 | 30746 | 68 | CAGCTGCGACCTAATCAGCC | 31 | 29 | 23 | 4 | 36 | 0 |
| 7985 | 3352 | 3328 | 40845 | 72.8 | TGCGATCGGCTTTGATGCAA | 29 | 24 | 17 | 2 | 21 | 0 |
| 7986 | 3353 | 3329 | 10195 | 71.4 | TGCGGATGGCTTGAGTCAGC | 29 | 27 | 17 | 20 | 31 | 0 |
| 7987 | 3354 | 3330 | 10196 | 74 | CAGCTGCGTCCCTGTCCACG | 31 | 29 | 28 | 9 | 30 | 0 |
| 7988 | 3355 | 3331 | 10197 | 77.6 | CAGCTGCGCACGCTTGACGG | 31 | 29 | 30 | 11 | 35 | 0 |
| 7989 | 3356 | 3332 | 40848 | 66.6 | CACGTTGATTAGGACCGCAA | 30 | 1 | 3 | 32 | 21 | 0 |
| 7990 | 3357 | 3333 | 10203 | 71.9 | CAGCCACGAATCGAGTTGCG | 31 | 30 | 4 | 20 | 29 | 0 |
| 7991 | 3358 | 3334 | 10204 | 67.5 | CAGCCACGATACCGAAGGAC | 31 | 30 | 5 | 16 | 34 | 0 |
| 7992 | 3359 | 3335 | 30747 | 68.7 | CACGTCTGTGTCTCCCACGG | 30 | 8 | 9 | 28 | 35 | 0 |
| 7993 | 3360 | 3336 | 21894 | 68.9 | CAGCCACGTCGTGCAAGTCT | 31 | 30 | 10 | 21 | 19 | 0 |

FIG. 29SSS

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 7993 | 3361 | 3337 | 10208 | 73.5 | CAGCCACGCGTTCGTTCCAT | 31 | 30 | 12 | 12 15 | 0 |
| 7994 | 3362 | 3338 | 10210 | 71.9 | CAGCCACGCGAAGTGCAATC | 31 | 30 | 16 | 33 4 | 0 |
| 7995 | 3363 | 3339 | 40850 | 71.8 | CAGCCACGCCTATCCCCCTA | 31 | 30 | 26 | 28 26 | 0 |
| 7996 | 3364 | 3340 | 30748 | 68.2 | CAGCCAGCTTGAGGACGGTA | 31 | 31 | 1 | 34 18 | 0 |
| 7997 | 3365 | 3341 | 16183 | 70.3 | CAGCCAGCTTAGGACCGTGC | 31 | 31 | 3 | 32 33 | 0 |
| 7998 | 3366 | 3344 | 16184 | 71.2 | CAGCCAGCTGTCACGGAGGA | 31 | 31 | 9 | 35 25 | 0 |
| 7999 | 3367 | 3345 | 30749 | 66.4 | CAGCCTCAATACGGTATGCG | 31 | 13 | 5 | 18 29 | 0 |
| 8001 | 3368 | 3346 | 16186 | 66.3 | CAGCCCATATCGATACTGCG | 31 | 15 | 24 | 5 29 | 0 |
| 8002 | 3369 | 3347 | 10228 | 71.5 | CAGCCAGCAGGACGTTCGAA | 31 | 31 | 25 | 12 16 | 0 |
| 8003 | 3370 | 3348 | 10229 | 67.6 | CAGCCAGCGATGTTAGGGAC | 31 | 31 | 27 | 3 34 | 0 |
| 8004 | 3371 | 3349 | 10230 | 70.1 | CAGCCAGCTCCCGGTACTTG | 31 | 31 | 28 | 18 11 | 0 |
| 8005 | 3372 | 3350 | 10233 | 73.2 | CAGCCAGCAGCCCTTGGATG | 31 | 31 | 36 | 11 27 | 0 |
| 8006 | 3373 | 3351 | 30750 | 65.9 | CAGCGACCAATCATACAGCC | 31 | 32 | 4 | 5 36 | 0 |
| 8007 | 3374 | 3352 | 40857 | 68.4 | CAGCGACCTCGTAGGAGCAA | 31 | 32 | 10 | 25 21 | 0 |
| 8008 | 3375 | 3353 | 40858 | 69.2 | CAGCGACCCTTGCCTAGACC | 31 | 32 | 11 | 26 32 | 0 |
| 8009 | 3376 | 3354 | 10239 | 73.6 | CAGCGACCGCAACACGGTCT | 31 | 32 | 21 | 30 19 | 0 |
| 8010 | 3377 | 3355 | 10241 | 66.8 | CAGCGACCATCGTACACAGC | 31 | 32 | 24 | 7 31 | 0 |
| 8011 | 3378 | 3356 | 30751 | 72 | CAGCGACCTCCCAATCGGAC | 31 | 32 | 28 | 4 34 | 0 |
| 8012 | 3379 | 3357 | 10242 | 71.4 | CAGCGACCCACGGCTTTACA | 31 | 32 | 30 | 17 7 | 0 |
| 8013 | 3380 | 3358 | 10244 | 70.3 | CAGCGACCGACCTCGTCTGT | 31 | 32 | 32 | 10 14 | 0 |
| 8014 | 3381 | 3359 | 30752 | 70 | CAGCGACCAGCCAGGAAATC | 31 | 32 | 36 | 25 4 | 0 |
| 8015 | 3382 | 3360 | 10249 | 67.5 | CAGCGTGCATACTGCGAAAG | 31 | 33 | 5 | 29 6 | 0 |
| 8016 | 3383 | 3361 | 10251 | 68.2 | CAGCGTGCTACAAGTGCACG | 31 | 33 | 7 | 22 30 | 0 |
| 8017 | 3384 | 3362 | 30753 | 72.3 | CAGCGTGCTCTGGATGGCAA | 31 | 33 | 8 | 27 21 | 0 |
| 8018 | 3385 | 3363 | 30754 | 69.6 | CAGCGTGCTCGTAGTGACGG | 31 | 33 | 10 | 22 35 | 0 |
| 8019 | 3386 | 3364 | 10253 | 69.8 | CAGCGTGCCTGTAATCTGCG | 31 | 33 | 14 | 4 29 | 0 |
| 8020 | 3387 | 3365 | 10254 | 71.6 | CAGCGTGCCGAACTGTGCTT | 31 | 33 | 16 | 14 17 | 0 |
| 8021 | 3388 | 3366 | 10256 | 69.9 | CAGCGTGCGTCTCTTGCTTG | 31 | 33 | 19 | 11 11 | 0 |
| 8022 | 3389 | 3367 | 30755 | 72.7 | CAGCGTGCACCTTCGTCACG | 31 | 33 | 23 | 10 30 | 0 |
| 8023 | 3390 | 3368 | 10259 | 74.7 | CAGCGTGCCACGCTTGTCGT | 31 | 33 | 30 | 11 10 | 0 |
| 8024 | 3391 | 3369 | 10260 | 77 | CAGCGTGCGACCCACGGATG | 31 | 33 | 32 | 30 27 | 0 |
| 8025 | 3392 | 3370 | 10262 | 72 | CAGCGTGCGGACATCGTGAT | 31 | 33 | 34 | 24 2 | 0 |
| 8026 | 3393 | 3371 | 10263 | 77.1 | CAGCGTGCACGGCAGCGAGT | 31 | 33 | 35 | 31 20 | 0 |
| 8027 | 3394 | 3372 | 10264 | 76.4 | CAGCGTGCAGCCCTCAACGG | 31 | 33 | 36 | 13 35 | 0 |
| 8028 | 3395 | 3373 | 40861 | 68.1 | CAGCGGACTGATAGCCAGGA | 31 | 34 | 2 | 36 25 | 0 |
| 8029 | 3396 | 3374 | 10265 | 69.1 | CAGCGGACAATCAAAGGCAA | 31 | 34 | 4 | 6 21 | 0 |
| 8030 | 3397 | 3375 | 30757 | 68.8 | CAGCGGACTGTCAATCCGAA | 31 | 34 | 9 | 4 16 | 0 |
| 8031 | 3398 | 3376 | 10273 | 70 | CAGCGGACGAGTCGAAGCTT | 31 | 34 | 20 | 16 17 | 0 |
| 8032 | 3399 | 3377 | 40864 | 67.8 | CAGCGGACACCTTACAAGCC | 31 | 34 | 23 | 7 36 | 0 |
| 8033 | 3400 | 3378 | 30758 | 72.3 | CAGCGGACGATGGGACACCT | 31 | 34 | 27 | 34 23 | 0 |
| 8034 | 3401 | 3379 | 16192 | 73.1 | CAGCGGACTGCGGTCTGGAC | 31 | 34 | 29 | 19 34 | 0 |
| 8035 | 3402 | 3380 | 10278 | 75.8 | CAGCGGACCACGCCATGCTT | 31 | 34 | 30 | 15 17 | 0 |
| 8036 | 3403 | 3381 | 10279 | 71.7 | CAGCGGACCAGCCCTACCAT | 31 | 34 | 31 | 26 15 | 0 |
| 8037 | 3404 | 3382 | 10280 | 73.6 | CAGCGGACACGGCGAACTGT | 31 | 34 | 35 | 16 14 | 0 |
| 8038 | 3405 | 3383 | 40866 | 66.4 | ACGGTTGAAATCCCTAACGG | 35 | 1 | 4 | 26 35 | 1 |
| 8039 | 3406 | 3384 | 10283 | 69.5 | CAGCACGGTGATGATGCGTT | 31 | 35 | 2 | 27 12 | 0 |
| 8040 | 3407 | 3385 | 40867 | 67.1 | ACGGAATCTCTGGGTATGCG | 35 | 4 | 8 | 18 29 | 0 |
| 8041 | 3408 | 3386 | 10285 | 67.2 | CAGCACGGATACAAAGCACG | 31 | 35 | 5 | 6 30 | 0 |

FIG. 29TTT

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 8042 | 3409 | 3387 | 21913 | 73.8 | CAGCACGGCTGTGACCGCTT | 31 | 35 | 14 | 32 17 | 0 |
| 8043 | 3410 | 3388 | 10291 | 72.1 | CAGCACGGCGAAGCTTGATG | 31 | 35 | 16 | 17 27 | 0 |
| 8044 | 3411 | 3389 | 10292 | 69.7 | ACGGGCTTGTCTCCTATGCG | 35 | 17 | 19 | 26 29 | 0 |
| 8045 | 3412 | 3390 | 10293 | 71.9 | CAGCACGGGGTACGAATCCC | 31 | 35 | 18 | 16 28 | 0 |
| 8046 | 3413 | 3391 | 21915 | 66.1 | ACGGGAGTATCGAGTGAGCC | 35 | 20 | 24 | 22 36 | 0 |
| 8047 | 3414 | 3392 | 30759 | 70.5 | CAGCACGGACCTTCTGCGTT | 31 | 35 | 23 | 8 12 | 0 |
| 8048 | 3415 | 3393 | 10295 | 71.4 | CAGCACGGATCGTCCCAGTG | 31 | 35 | 24 | 28 22 | 0 |
| 8049 | 3416 | 3394 | 10296 | 67.4 | ACGGAGGAACCTGAGTGCAA | 35 | 25 | 23 | 20 21 | 0 |
| 8050 | 3417 | 3395 | 16194 | 74 | CAGCACGGAGCCACCTGTGC | 31 | 35 | 36 | 23 33 | 0 |
| 8051 | 3418 | 3396 | 30760 | 66.7 | AGCCTGATAAAGAGCCACGG | 36 | 2 | 6 | 36 35 | 0 |
| 8052 | 3419 | 3397 | 16195 | 70.8 | CAGCAGCCAATCCTTGGTGC | 31 | 36 | 4 | 11 33 | 0 |
| 8053 | 3420 | 3398 | 30761 | 68.3 | CAGCAGCCTCTGTCGTGGAC | 31 | 36 | 8 | 10 34 | 0 |
| 8054 | 3421 | 3399 | 40870 | 75.8 | CAGCAGCCTGTCGTGCGCAA | 31 | 36 | 9 | 33 21 | 0 |
| 8055 | 3422 | 3400 | 10310 | 69.8 | CAGCAGCCCGTTCCTAAGGA | 31 | 36 | 12 | 26 25 | 0 |
| 8056 | 3423 | 3401 | 10315 | 69.3 | CAGCAGCCGTCTCTTGCTCA | 31 | 36 | 19 | 11 13 | 0 |
| 8057 | 3424 | 3402 | 30762 | 70.1 | AGCCGAGTGAGTCACGCGTT | 36 | 20 | 20 | 30 12 | 0 |
| 8058 | 3425 | 3403 | 10319 | 69 | AGCCACCTGATGTGTCGCAA | 36 | 23 | 27 | 9 21 | 0 |
| 8059 | 3426 | 3404 | 30763 | 72.4 | CAGCAGCCGATGATCGCTCA | 31 | 36 | 27 | 24 13 | 0 |
| 8060 | 3427 | 3405 | 10322 | 69.8 | CAGCAGCCGACCTACATCCC | 31 | 36 | 32 | 7 28 | 0 |
| 8061 | 3428 | 3406 | 16203 | 74.3 | TTAGGCAAACGGCACGCGAA | 3 | 21 | 35 | 30 16 | 0 |
| 8062 | 3429 | 3407 | 30764 | 69.6 | AATCCGAACGAACGAAACGG | 4 | 16 | 16 | 16 35 | 0 |
| 8063 | 3430 | 3408 | 10346 | 72.7 | GACCAATCGGACGTGCGGAC | 32 | 4 | 34 | 33 34 | 0 |
| 8064 | 3431 | 3409 | 30765 | 67 | AAAGCGTTAGCCCTGTCAGC | 6 | 12 | 36 | 14 31 | 0 |
| 8065 | 3432 | 3410 | 10356 | 71.7 | AAAGATCGCGTTGTGCTGCG | 6 | 24 | 12 | 33 29 | 0 |
| 8066 | 3433 | 3411 | 10357 | 72.7 | AAAGGATGCACGGACCTGCG | 6 | 27 | 30 | 32 29 | 0 |
| 8067 | 3434 | 3412 | 10360 | 70.7 | AAAGGGACGACCAGGAACGG | 6 | 34 | 32 | 25 35 | 0 |
| 8068 | 3435 | 3413 | 16210 | 73.7 | TCTGGTGCCAGCGCTTGGAC | 8 | 33 | 31 | 17 34 | 0 |
| 8069 | 3436 | 3414 | 10372 | 72.6 | TCTGACGGCGTTTCGTTCCC | 8 | 35 | 12 | 10 28 | 0 |
| 8070 | 3437 | 3415 | 10375 | 69.5 | TGTCGTGCAAAGCCATGACC | 9 | 33 | 6 | 15 32 | 0 |
| 8071 | 3438 | 3416 | 30766 | 72.1 | TCGTCGAATGCGGTCTGTGC | 10 | 16 | 29 | 19 33 | 0 |
| 8072 | 3439 | 3417 | 10378 | 70.6 | TCGTGGTATCCCGTGCGAGT | 10 | 18 | 28 | 33 20 | 0 |
| 8073 | 3440 | 3418 | 10379 | 71 | TCGTCACGGCTTACGGCTGT | 10 | 30 | 17 | 35 14 | 0 |
| 8074 | 3441 | 3419 | 30767 | 67.4 | CTTGCGAATCGTTACATGCG | 11 | 16 | 10 | 7 29 | 0 |
| 8075 | 3442 | 3420 | 30768 | 67.6 | GACCCTTGGGTACCATTCCC | 32 | 11 | 18 | 15 28 | 0 |
| 8076 | 3443 | 3421 | 30769 | 70.4 | CTTGCAGCCCTACAGCCAGC | 11 | 31 | 26 | 31 31 | 0 |
| 8077 | 3444 | 3422 | 16219 | 67.4 | GACCCGTTTACAGTGCGGAC | 32 | 12 | 7 | 33 34 | 0 |
| 8078 | 3445 | 3423 | 10396 | 69.3 | GACCCGTTTCTGCACGGTCT | 32 | 12 | 8 | 30 19 | 0 |
| 8079 | 3446 | 3424 | 30770 | 68.2 | GACCCGTTCTCAGCTTTCCC | 32 | 12 | 13 | 17 28 | 0 |
| 8080 | 3447 | 3425 | 30771 | 67.2 | CGTTGGTACAGCAATCTGCG | 12 | 18 | 31 | 4 29 | 0 |
| 8081 | 3448 | 3426 | 10402 | 68.1 | CGTTAGTGTTGATGCGCACG | 12 | 22 | 1 | 29 30 | 1 |
| 8082 | 3449 | 3427 | 30772 | 69.5 | GACCCGTTAGGATCCCCCAT | 32 | 12 | 25 | 28 15 | 0 |
| 8083 | 3450 | 3428 | 40880 | 70.6 | GACCCGTTGATGATCGCAGC | 32 | 12 | 27 | 24 31 | 0 |
| 8084 | 3451 | 3429 | 10404 | 68.5 | CGTTTGCGAATCTGTCGCTT | 12 | 29 | 4 | 9 17 | 0 |
| 8085 | 3452 | 3430 | 21938 | 67.6 | GACCCGTTCACGTGATGCTT | 32 | 12 | 30 | 2 17 | 0 |
| 8086 | 3453 | 3431 | 10405 | 69.6 | CGTTCAGCGGGTATCTGTGCG | 12 | 31 | 18 | 8 29 | 0 |
| 8087 | 3454 | 3432 | 10406 | 72.2 | GACCCGTTGTGCGGACACCT | 32 | 12 | 33 | 34 23 | 0 |
| 8088 | 3455 | 3433 | 10422 | 68.3 | GACCCTGTGCAAGGTATGCG | 32 | 14 | 21 | 18 29 | 0 |
| 8089 | 3456 | 3434 | 40883 | 68.5 | CCATTTGAGCAAGTGCGACC | 15 | 1 | 21 | 33 32 | 0 |

FIG. 29UUU

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8090 | 3457 | 3435 | 40885 | 70.1 | CCATGGTACTTGTGCGCACG | 15 | 18 | 11 | 29 | 30 | 0 |
| 8091 | 3458 | 3436 | 16237 | 71.4 | CCATCACGGAGTGACCTGCG | 15 | 30 | 20 | 32 | 29 | 0 |
| 8092 | 3459 | 3437 | 16239 | 69.3 | GACCCCATACGGGGTACACG | 32 | 15 | 35 | 18 | 30 | 0 |
| 8093 | 3460 | 3438 | 30773 | 68.5 | CGAATTGAAGGATCCCCGTT | 16 | 1 | 25 | 28 | 12 | 0 |
| 8094 | 3461 | 3439 | 40890 | 67 | CGAAGGTACCATCGAAAGCC | 16 | 18 | 15 | 16 | 36 | 0 |
| 8095 | 3462 | 3440 | 10453 | 69.5 | GACCCGAAATCGGCTTCTCA | 32 | 16 | 24 | 17 | 13 | 0 |
| 8096 | 3463 | 3441 | 16250 | 71 | GACCCGAAACGGGCTTAGGA | 32 | 16 | 35 | 17 | 25 | 0 |
| 8097 | 3464 | 3442 | 10460 | 65.3 | GACCGCTTTGATGGTAATCG | 32 | 17 | 2 | 18 | 24 | 0 |
| 8098 | 3465 | 3443 | 30775 | 73.2 | GCTTTGTCGGACCAGCGTGC | 17 | 9 | 34 | 31 | 33 | 0 |
| 8099 | 3466 | 3444 | 16254 | 66 | GCTTCTGTCCATGAGTTGCG | 17 | 14 | 15 | 20 | 29 | 0 |
| 8100 | 3467 | 3445 | 30776 | 67.4 | GACCGCTTGCTTACGGAAAG | 32 | 17 | 17 | 35 | 6 | 0 |
| 8101 | 3468 | 3446 | 40894 | 65.8 | GCTTATCGAATCGGTATGCG | 17 | 24 | 4 | 18 | 29 | 0 |
| 8102 | 3469 | 3447 | 30777 | 67.9 | GACCGCTTCCTAAGGAAGCC | 32 | 17 | 26 | 25 | 36 | 0 |
| 8103 | 3470 | 3448 | 30778 | 74.1 | GACCGCTTTGCGTCGTGTGC | 32 | 17 | 29 | 10 | 33 | 0 |
| 8104 | 3471 | 3449 | 16256 | 70.3 | GACCGCTTGTGCAATCCGTT | 32 | 17 | 33 | 4 | 12 | 0 |
| 8105 | 3472 | 3450 | 10478 | 70.5 | GACCGGTATTGATGCGACGG | 32 | 18 | 1 | 29 | 35 | 0 |
| 8106 | 3473 | 3451 | 30779 | 68.2 | GGTACGTTGGACCTCATGCG | 18 | 12 | 34 | 13 | 29 | 0 |
| 8107 | 3474 | 3452 | 16261 | 68.7 | GACCGGTACGAAGACCGGAC | 32 | 18 | 16 | 32 | 34 | 0 |
| 8108 | 3475 | 3453 | 40896 | 66 | GGTAGCTTCACGAATCGCAA | 18 | 17 | 30 | 4 | 21 | 0 |
| 8109 | 3476 | 3454 | 10487 | 66.1 | GGTAGGTAGCTTTCCCCACG | 18 | 18 | 17 | 28 | 30 | 0 |
| 8110 | 3477 | 3455 | 30780 | 68.2 | GACCGGTAAGGAAGGAACGG | 32 | 18 | 25 | 25 | 35 | 0 |
| 8111 | 3478 | 3456 | 10491 | 71 | GACCGGTATGCGTGCGTGAT | 32 | 18 | 29 | 29 | 2 | 0 |
| 8112 | 3479 | 3457 | 40898 | 68.5 | GTCTTCGTTTGAAGCCGCAA | 19 | 10 | 1 | 36 | 21 | 0 |
| 8113 | 3480 | 3458 | 10498 | 68.3 | GACCGTCTCGAACAGCATCG | 32 | 19 | 16 | 31 | 24 | 0 |
| 8114 | 3481 | 3459 | 16265 | 64.8 | GTCTGCTTTGATGGACGCTT | 19 | 17 | 2 | 34 | 17 | 0 |
| 8115 | 3482 | 3460 | 10503 | 70.5 | GACCGTCTGACCGTGCCTTG | 32 | 19 | 32 | 33 | 11 | 0 |
| 8116 | 3483 | 3461 | 10509 | 64.6 | GAGTGGTAAAAGACGGCAGC | 20 | 18 | 6 | 35 | 31 | 0 |
| 8117 | 3484 | 3462 | 10512 | 72 | GACCGAGTGTGCCGTTGCAA | 32 | 20 | 33 | 12 | 21 | 0 |
| 8118 | 3485 | 3463 | 10513 | 69.7 | GACCGAGTGGACACGGTCGT | 32 | 20 | 34 | 35 | 10 | 0 |
| 8119 | 3486 | 3464 | 10514 | 70.2 | GACCGAGTAGCCGATGCAGC | 32 | 20 | 36 | 27 | 31 | 0 |
| 8120 | 3487 | 3465 | 30781 | 71.3 | GACCGCAATGATACGGCGAA | 32 | 21 | 2 | 35 | 16 | 0 |
| 8121 | 3488 | 3466 | 21954 | 66.2 | GCAAAATCTGTCCTGTTGCG | 21 | 4 | 9 | 14 | 29 | 0 |
| 8122 | 3489 | 3467 | 40904 | 67.1 | GACCGCAATCTGTGATTCCC | 32 | 21 | 8 | 2 | 28 | 0 |
| 8123 | 3490 | 3468 | 30782 | 66.5 | GACCGCAACTTGTGATGTGC | 32 | 21 | 11 | 2 | 33 | 0 |
| 8124 | 3491 | 3469 | 30783 | 69.2 | GACCGCAAGCTTTTGATCCC | 32 | 21 | 17 | 1 | 28 | 0 |
| 8125 | 3492 | 3470 | 30784 | 70.5 | GACCGCAAGTCTCACGCGTT | 32 | 21 | 19 | 30 | 12 | 0 |
| 8126 | 3493 | 3471 | 10528 | 65.6 | GCAAGAGTTGATGGACACGG | 21 | 20 | 2 | 34 | 35 | 0 |
| 8127 | 3494 | 3472 | 10529 | 68 | GACCGCAAAGTGGATGGATG | 32 | 21 | 22 | 27 | 27 | 0 |
| 8128 | 3495 | 3474 | 30785 | 75.1 | GACCGCAATCCCCATTCCC | 32 | 21 | 28 | 15 | 28 | 0 |
| 8129 | 3496 | 3475 | 10537 | 71.6 | AGTGTGCGGAGTGACCGCAA | 22 | 29 | 20 | 32 | 21 | 0 |
| 8130 | 3497 | 3476 | 10538 | 72.7 | AGTGCACGCTCACACGGCAA | 22 | 30 | 13 | 30 | 21 | 0 |
| 8131 | 3498 | 3477 | 16277 | 73.4 | AGTGAGCCGACCGACCCGTT | 22 | 36 | 32 | 32 | 12 | 0 |
| 8132 | 3499 | 3478 | 10545 | 70.7 | ACCTCACGGATGCCATCACG | 23 | 30 | 27 | 15 | 30 | 0 |
| 8133 | 3500 | 3479 | 40906 | 70.9 | ACCTACGGGCTTAGCCCGAA | 23 | 35 | 17 | 36 | 16 | 0 |
| 8134 | 3501 | 3480 | 10550 | 70.3 | GACCATCGCTCAAGCCCTCA | 32 | 24 | 13 | 36 | 13 | 0 |
| 8135 | 3502 | 3481 | 30786 | 71.4 | GACCATCGCGAATCCCCTGT | 32 | 24 | 16 | 28 | 14 | 0 |
| 8136 | 3503 | 3482 | 16287 | 68.9 | GACCAGGACCATACGGCCAT | 32 | 25 | 15 | 35 | 15 | 0 |
| 8137 | 3504 | 3483 | 10566 | 68.5 | AGGAATCGCGAAGATGGACC | 25 | 24 | 16 | 27 | 32 | 0 |

FIG. 29VVV

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8138 | 3505 | 3484 | 16289 | 69.9 | AGGATCCCGCTTGAGTTCCC | 25 | 28 | 17 | 20 | 28 | 0 |
| 8139 | 3506 | 3485 | 10570 | 70.2 | AGGAGTGCCTTGGCTTGCAA | 25 | 33 | 11 | 17 | 21 | 0 |
| 8140 | 3507 | 3486 | 10573 | 68.3 | CCTACTTGCCATCACGGTGC | 26 | 11 | 15 | 30 | 33 | 0 |
| 8141 | 3508 | 3487 | 40909 | 66 | GACCCCTACGTTAGGAACGG | 32 | 26 | 12 | 25 | 35 | 0 |
| 8142 | 3509 | 3488 | 30787 | 66.5 | CCTACGAAGGTAAGCCCAGC | 26 | 16 | 18 | 36 | 31 | 0 |
| 8143 | 3510 | 3489 | 30788 | 70.1 | CCTAGCAACACGACGGAGCC | 26 | 21 | 30 | 35 | 36 | 0 |
| 8144 | 3511 | 3490 | 10581 | 66.1 | CCTAGTGCTGTCAGGATGCG | 26 | 33 | 9 | 25 | 29 | 0 |
| 8145 | 3512 | 3491 | 16294 | 71.8 | GACCCCTAGGACAGCCGCAA | 32 | 26 | 34 | 36 | 21 | 0 |
| 8146 | 3513 | 3494 | 40915 | 71.2 | GACCGATGATCGTGCGCCTA | 32 | 27 | 24 | 29 | 26 | 0 |
| 8147 | 3514 | 3495 | 16299 | 68.4 | GACCGATGAGGAATCGGGAC | 32 | 27 | 25 | 24 | 34 | 0 |
| 8148 | 3515 | 3496 | 10595 | 69.1 | GACCGATGTGCGTCGTATCG | 32 | 27 | 29 | 10 | 24 | 0 |
| 8149 | 3516 | 3497 | 16302 | 70.7 | GACCGATGCAGCCCTACACG | 32 | 27 | 31 | 26 | 30 | 0 |
| 8150 | 3517 | 3498 | 16303 | 73.3 | GACCGATGGTGCCAGCAGGA | 32 | 27 | 33 | 31 | 25 | 0 |
| 8151 | 3518 | 3499 | 30791 | 66.8 | GACCGATGAGCCTCTGGGTA | 32 | 27 | 36 | 8 | 18 | 0 |
| 8152 | 3519 | 3500 | 10602 | 70.2 | TCCCAAAGCGAAGATGCGTT | 28 | 6 | 16 | 27 | 12 | 0 |
| 8153 | 3520 | 3502 | 10611 | 73.1 | TCCCAGTGGTGCGCTTTCGT | 28 | 22 | 33 | 17 | 10 | 0 |
| 8154 | 3521 | 3503 | 10612 | 68.8 | TCCCACCTTACACGAATGCG | 28 | 23 | 7 | 16 | 29 | 0 |
| 8155 | 3522 | 3504 | 10619 | 71.7 | GACCTCCCGGACTCTGCGAA | 32 | 28 | 34 | 8 | 16 | 0 |
| 8156 | 3523 | 3505 | 10621 | 73.1 | GACCTCCCAGCCCGTTGCTT | 32 | 28 | 36 | 12 | 17 | 0 |
| 8157 | 3524 | 3506 | 30793 | 69.7 | TGCGTTGAGTCTACGGCGAA | 29 | 1 | 19 | 35 | 16 | 0 |
| 8158 | 3525 | 3507 | 10626 | 68.4 | TGCGTCGTACCTGATGGACC | 29 | 10 | 23 | 27 | 32 | 0 |
| 8159 | 3526 | 3508 | 10629 | 68.8 | TGCGGAGTCTGTATCGACGG | 29 | 20 | 14 | 24 | 35 | 0 |
| 8160 | 3527 | 3509 | 10631 | 71.5 | TGCGATCGGTCTACCTTGCG | 29 | 24 | 19 | 23 | 29 | 0 |
| 8161 | 3528 | 3510 | 30794 | 69.4 | TGCGCCTAAGGAAAAGAGCC | 29 | 26 | 25 | 6 | 36 | 0 |
| 8162 | 3529 | 3511 | 10634 | 76 | TGCGTGCGCGTTTGTCAGGA | 29 | 29 | 12 | 9 | 25 | 0 |
| 8163 | 3530 | 3512 | 10637 | 75.7 | GACCTGCGGTGCCACGAGGA | 32 | 29 | 33 | 30 | 25 | 0 |
| 8164 | 3531 | 3513 | 10638 | 68.8 | CACGTTAGGGACGATGGCAA | 30 | 3 | 34 | 27 | 21 | 0 |
| 8165 | 3532 | 3514 | 10639 | 71 | CACGTGTCCCATGACCCAGC | 30 | 9 | 15 | 32 | 31 | 0 |
| 8166 | 3533 | 3515 | 10640 | 70.2 | GACCCACGCTGTCAGCGTCT | 32 | 30 | 14 | 31 | 19 | 0 |
| 8167 | 3534 | 3516 | 10644 | 67.7 | GACCCACGCCTATCGTCTCA | 32 | 30 | 26 | 10 | 13 | 0 |
| 8168 | 3535 | 3517 | 10651 | 74.4 | GACCCACGAGCCGCAAGACC | 32 | 30 | 36 | 21 | 32 | 0 |
| 8169 | 3536 | 3518 | 40923 | 67.8 | CAGCTTGATACATGCGCGAA | 31 | 1 | 7 | 29 | 16 | 0 |
| 8170 | 3537 | 3519 | 10654 | 69.6 | CAGCATACCTTGGCAATGCG | 31 | 5 | 11 | 21 | 29 | 0 |
| 8171 | 3538 | 3520 | 10655 | 65.8 | CAGCTACACTTGGTGCCGTT | 31 | 7 | 11 | 33 | 12 | 0 |
| 8172 | 3539 | 3521 | 16324 | 66.9 | GACCCAGCGGTAGCTTTGTC | 32 | 31 | 18 | 17 | 9 | 0 |
| 8173 | 3540 | 3522 | 10662 | 69.1 | CAGCAGTGGACCAAAGCGAA | 31 | 22 | 32 | 6 | 16 | 0 |
| 8174 | 3541 | 3523 | 40926 | 70.9 | CAGCGATGCCATTGTCCCAT | 31 | 27 | 15 | 9 | 15 | 0 |
| 8175 | 3542 | 3524 | 30796 | 72.6 | CAGCGTGCAGGATGTCGTGC | 31 | 33 | 25 | 9 | 33 | 0 |
| 8176 | 3543 | 3525 | 10665 | 72.3 | GACCCAGCAGCCGCAAAATC | 32 | 31 | 36 | 21 | 4 | 0 |
| 8177 | 3544 | 3526 | 16328 | 68.2 | GACCGACCTGATAGCCCCAT | 32 | 32 | 2 | 36 | 15 | 0 |
| 8178 | 3545 | 3527 | 10668 | 67.8 | GACCAAAGGTCTGACCGCAA | 32 | 6 | 19 | 32 | 21 | 0 |
| 8179 | 3546 | 3528 | 10670 | 68.9 | GACCGACCTCTGCGAAGGAC | 32 | 32 | 8 | 16 | 34 | 0 |
| 8180 | 3547 | 3529 | 16329 | 66.9 | GACCGACCCTGTAAAGCAGC | 32 | 32 | 14 | 6 | 31 | 0 |
| 8181 | 3548 | 3530 | 30797 | 70 | GACCGACCACCTGCAACGTT | 32 | 32 | 23 | 21 | 12 | 0 |
| 8182 | 3549 | 3531 | 10680 | 71.5 | GACCGTGCCTCATCTGCACG | 32 | 33 | 13 | 8 | 30 | 0 |
| 8183 | 3550 | 3532 | 16333 | 67.3 | GACCGTGCTTAGGCTTACGG | 32 | 33 | 3 | 17 | 35 | 0 |
| 8184 | 3551 | 3533 | 21989 | 63.7 | GTGCATACTCGTCTTGCAGC | 33 | 5 | 10 | 11 | 31 | 0 |
| 8185 | 3552 | 3534 | 10690 | 67.6 | GACCGTGCCGAAGGTAAGTG | 32 | 33 | 16 | 18 | 22 | 0 |

FIG. 29WWW

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8186 | 3553 | 3535 | 10691 | 65.2 | GACCGTGCGTCTCTCAAAAG | 32 | 33 | 19 | 13 | 6 | 0 |
| 8187 | 3554 | 3536 | 10693 | 71.1 | GACCGTGCGCAATCGTGTCT | 32 | 33 | 21 | 10 | 19 | 0 |
| 8188 | 3555 | 3537 | 40932 | 70 | GACCGTGCAGTGTCTGTGCG | 32 | 33 | 22 | 8 | 29 | 0 |
| 8189 | 3556 | 3538 | 30798 | 68.5 | GACCGTGCACCTCTCACGAA | 32 | 33 | 23 | 13 | 16 | 0 |
| 8190 | 3557 | 3539 | 30799 | 70.1 | GACCGTGCAGGACCATGGAC | 32 | 33 | 25 | 15 | 34 | 0 |
| 8191 | 3558 | 3540 | 10697 | 74.6 | GACCGTGCTGCGGTCTGCAA | 32 | 33 | 29 | 19 | 21 | 0 |
| 8192 | 3559 | 3541 | 10698 | 71.6 | GACCGTGCCACGCTCACTTG | 32 | 33 | 30 | 13 | 11 | 0 |
| 8193 | 3560 | 3542 | 10699 | 70.6 | GACCGTGCCAGCCTCATCTG | 32 | 33 | 31 | 13 | 8 | 0 |
| 8194 | 3561 | 3543 | 21992 | 73.7 | GACCGTGCGTGCGCTTGAGT | 32 | 33 | 33 | 17 | 20 | 0 |
| 8195 | 3562 | 3544 | 10706 | 72.9 | GACCGGACCGTTCAGCGATG | 32 | 34 | 12 | 31 | 27 | 0 |
| 8196 | 3563 | 3545 | 40935 | 71.2 | GACCGGACCTGTGGACCGTT | 32 | 34 | 14 | 34 | 12 | 0 |
| 8197 | 3564 | 3546 | 10709 | 67.2 | GGACCGAAAATCTGTCACGG | 34 | 16 | 4 | 9 | 35 | 0 |
| 8198 | 3565 | 3547 | 30800 | 73.8 | GACCGGACGCAAGCAAGCAA | 32 | 34 | 21 | 21 | 21 | 0 |
| 8199 | 3566 | 3548 | 10713 | 70.3 | GACCGGACATCGATCGATCG | 32 | 34 | 24 | 24 | 24 | 0 |
| 8200 | 3567 | 3549 | 40937 | 72.3 | GGACCAGCGTCTCAGCAGCC | 34 | 31 | 19 | 31 | 36 | 0 |
| 8201 | 3568 | 3550 | 30801 | 72.6 | GACCGGACGACCCTCACACG | 32 | 34 | 32 | 13 | 30 | 0 |
| 8202 | 3569 | 3551 | 10715 | 72.9 | GACCGGACGTGCCTCAATCG | 32 | 34 | 33 | 13 | 24 | 0 |
| 8203 | 3570 | 3552 | 10716 | 71.5 | GACCGGACACGGGTCTGCTT | 32 | 34 | 35 | 19 | 17 | 0 |
| 8204 | 3571 | 3553 | 16341 | 66.7 | ACGGTCGTAATCGATGTCCC | 35 | 10 | 4 | 27 | 28 | 0 |
| 8205 | 3572 | 3554 | 10722 | 67.6 | ACGGCTTGATCGTGATGCTT | 35 | 11 | 24 | 2 | 17 | 0 |
| 8206 | 3573 | 3555 | 10723 | 71.4 | GACCACGGCGTTGTCTGTGC | 32 | 35 | 12 | 19 | 33 | 0 |
| 8207 | 3574 | 3556 | 30802 | 69 | ACGGCTGTATACCACGTGCG | 35 | 14 | 5 | 30 | 29 | 0 |
| 8208 | 3575 | 3557 | 16342 | 66.6 | ACGGGGTATTAGACGGCTTG | 35 | 18 | 3 | 35 | 11 | 0 |
| 8209 | 3576 | 3558 | 10726 | 65.9 | ACGGGTCTAGGATGTCGCTT | 35 | 19 | 25 | 9 | 17 | 0 |
| 8210 | 3577 | 3559 | 40939 | 67.2 | ACGGGAGTATACAGCCGTGC | 35 | 20 | 5 | 36 | 33 | 0 |
| 8211 | 3578 | 3560 | 16343 | 69.3 | ACGGCAGCTCGTTTAGAGCC | 35 | 31 | 10 | 3 | 36 | 0 |
| 8212 | 3579 | 3561 | 30804 | 73.8 | GACCACGGAGCCAGCCACCT | 32 | 35 | 36 | 36 | 23 | 0 |
| 8213 | 3580 | 3562 | 10735 | 70.1 | GACCAGCCAATCACGGCTGT | 32 | 36 | 4 | 35 | 14 | 0 |
| 8214 | 3581 | 3563 | 10736 | 71.5 | GACCAGCCAAAGCGTTGCAA | 32 | 36 | 6 | 12 | 21 | 0 |
| 8215 | 3582 | 3564 | 10738 | 67.1 | AGCCTCGTCCATAATCACGG | 36 | 10 | 15 | 4 | 35 | 0 |
| 8216 | 3583 | 3565 | 10741 | 71.6 | GACCAGCCCCATGCTTCGTT | 32 | 36 | 15 | 17 | 12 | 0 |
| 8217 | 3584 | 3566 | 10742 | 70.6 | GACCAGCCGCTTCGAACTCA | 32 | 36 | 17 | 16 | 13 | 0 |
| 8218 | 3585 | 3567 | 30805 | 73.5 | AGCCAGTGAGCCAGCCCCAT | 36 | 22 | 36 | 36 | 15 | 0 |
| 8219 | 3586 | 3568 | 30806 | 67.8 | AGCCATCGTACAATCGCGTT | 36 | 24 | 7 | 24 | 12 | 0 |
| 8220 | 3587 | 3569 | 30807 | 69.3 | GACCAGCCCCTAAATCTGCG | 32 | 36 | 26 | 4 | 29 | 0 |
| 8221 | 3588 | 3570 | 10748 | 73.4 | AGCCTCCCGGACAGTGCCAT | 36 | 28 | 34 | 22 | 15 | 0 |
| 8222 | 3589 | 3571 | 10749 | 72.5 | GACCAGCCTGCGTGTCCGTT | 32 | 36 | 29 | 9 | 12 | 0 |
| 8223 | 3590 | 3572 | 10750 | 73.4 | GACCAGCCGACCGATGCTCA | 32 | 36 | 32 | 27 | 13 | 0 |
| 8224 | 3591 | 3573 | 10753 | 69.5 | TTGAGCTTATCGGCAATGCG | 1 | 17 | 24 | 21 | 29 | 0 |
| 8225 | 3592 | 3574 | 10758 | 76.3 | TTGAGTGCGTGCTGCGCGAA | 1 | 33 | 33 | 29 | 16 | 0 |
| 8226 | 3593 | 3575 | 22007 | 69.2 | TGATCCATGTGCCTTGACGG | 2 | 15 | 33 | 11 | 35 | 0 |
| 8227 | 3594 | 3576 | 10763 | 74.2 | TGATGTGCCGTTTGCGGGAC | 2 | 33 | 12 | 29 | 34 | 0 |
| 8228 | 3595 | 3577 | 10775 | 68.1 | GTGCAATCCGAACGTTGGAC | 33 | 4 | 16 | 12 | 34 | 0 |
| 8229 | 3596 | 3578 | 10776 | 66.4 | GTGCAATCGGTATCGTCGAA | 33 | 4 | 18 | 10 | 16 | 0 |
| 8230 | 3597 | 3579 | 10780 | 70 | GTGCAATCGATGAGCCCCAT | 33 | 4 | 27 | 36 | 15 | 0 |
| 8231 | 3598 | 3580 | 10781 | 67.6 | AATCTCCCGCAAATACTGCG | 4 | 28 | 21 | 5 | 29 | 0 |
| 8232 | 3599 | 3581 | 22013 | 66.2 | GTGCAATCCACGGATGTCTG | 33 | 4 | 30 | 27 | 8 | 0 |
| 8233 | 3600 | 3582 | 30809 | 73.9 | GTGCAATCCAGCAGCCCACG | 33 | 4 | 31 | 36 | 30 | 0 |

FIG. 29XXX

| SEQ ID NO: | ZIP ID# | 4,633 ID# | HEX ID# | Tm | ZIPCODE (NH2 -> COMH2) | TETRAMER NUMBERS | | | | "UNALLOWED DIMERS" |
|---|---|---|---|---|---|---|---|---|---|---|
| 8234 | 3601 | 3583 | 16358 | 69.2 | GTGCATACCACGGCAAATCG | 33 | 5 | 30 | 21 24 | 0 |
| 8235 | 3602 | 3584 | 10792 | 72.5 | GTGCATACAGCCACGGTGCG | 33 | 5 | 36 | 35 29 | 0 |
| 8236 | 3603 | 3585 | 10793 | 68.7 | AAAGTCGTCGAACACGCGAA | 6 | 10 | 16 | 30 16 | 0 |
| 8237 | 3604 | 3586 | 10799 | 68.6 | GTGCAAAGCCTAATCGGCAA | 33 | 6 | 26 | 24 21 | 0 |
| 8238 | 3605 | 3587 | 16360 | 70 | AAAGCAGCCAGCAGTGAGCC | 6 | 31 | 31 | 22 36 | 0 |
| 8239 | 3606 | 3588 | 30810 | 69.5 | GTGCAAAGGACCATCGGCTT | 33 | 6 | 32 | 24 17 | 0 |
| 8240 | 3607 | 3589 | 10808 | 70.3 | TCTGGGTAATCGGGACTGCG | 8 | 18 | 24 | 34 29 | 0 |
| 8241 | 3608 | 3590 | 10809 | 72 | TCTGCCTAGCTTTGCGCACG | 8 | 26 | 17 | 29 30 | 0 |
| 8242 | 3609 | 3591 | 10810 | 70.8 | TCTGTGCGCGTTAGTGCGAA | 8 | 29 | 12 | 22 16 | 0 |
| 8243 | 3610 | 3592 | 16367 | 70.3 | GTGCTGTCCGAAACGGCTGT | 33 | 9 | 16 | 35 14 | 0 |
| 8244 | 3611 | 3593 | 16368 | 73.5 | GTGCTGTCCACGGGACACGG | 33 | 9 | 30 | 34 35 | 0 |
| 8245 | 3612 | 3594 | 16369 | 73.8 | TGTCGACCGACCCAGCCTCA | 9 | 32 | 32 | 31 13 | 0 |
| 8246 | 3613 | 3595 | 10823 | 72.1 | TGTCACGGGTCTTCCCGGAC | 9 | 35 | 19 | 28 34 | 0 |
| 8247 | 3614 | 3596 | 10825 | 69.3 | TCGTTGATAGCCGCTTCACG | 10 | 2 | 36 | 17 30 | 0 |
| 8248 | 3615 | 3597 | 10828 | 70.1 | TCGTCTTGTGTCACGGCGAA | 10 | 11 | 9 | 35 16 | 0 |
| 8249 | 3616 | 3598 | 10834 | 68.9 | TCGTAGGAAATCAGCCGCAA | 10 | 25 | 4 | 36 21 | 0 |
| 8250 | 3617 | 3599 | 10836 | 71 | TCGTTCCCGTTTGACACG | 10 | 28 | 12 | 1 30 | 1 |
| 8251 | 3618 | 3600 | 16374 | 72.9 | TCGTGGACGGACGCTTCCAT | 10 | 34 | 34 | 17 15 | 0 |
| 8252 | 3619 | 3601 | 22025 | 69.4 | TCGTAGCCTCTGACGGGAC | 10 | 36 | 8 | 35 34 | 0 |
| 8253 | 3620 | 3602 | 10843 | 70.5 | GTGCCTTGTTGATCCCGTGC | 33 | 11 | 1 | 28 33 | 1 |
| 8254 | 3621 | 3603 | 10844 | 66.3 | CTTGAAAGGCAACTTGCGAA | 11 | 6 | 21 | 11 16 | 0 |
| 8255 | 3622 | 3604 | 30811 | 70.7 | GTGCCTTGGTCTGGACTGCG | 33 | 11 | 19 | 34 29 | 0 |
| 8256 | 3623 | 3605 | 40950 | 68.9 | GTGCCTTGAGGAGTGCTCCC | 33 | 11 | 25 | 33 28 | 0 |
| 8257 | 3624 | 3606 | 10852 | 65.5 | GTGCCTTGCCTATCGTATCG | 33 | 11 | 26 | 10 24 | 0 |
| 8258 | 3625 | 3607 | 10853 | 70.4 | GTGCCTTGGATGGCTTCAA | 33 | 11 | 27 | 17 16 | 0 |
| 8259 | 3626 | 3608 | 10855 | 66.8 | GTGCCTTGCAGCTGTCAGTG | 33 | 11 | 31 | 9 22 | 0 |
| 8260 | 3627 | 3609 | 30812 | 67.9 | CGTTTTGAAGGAGACCTGCG | 12 | 1 | 25 | 32 29 | 1 |
| 8261 | 3628 | 3610 | 30813 | 66.2 | CGTTTTAGATCGGATGCGAA | 12 | 3 | 24 | 27 16 | 0 |
| 8262 | 3629 | 3611 | 30814 | 66.2 | CGTTTCTGTGCGATACGCTT | 12 | 8 | 29 | 5 17 | 0 |
| 8263 | 3630 | 3612 | 30815 | 66.3 | CGTTCTGTAATCGTGCAGCC | 12 | 14 | 4 | 33 36 | 0 |
| 8264 | 3631 | 3613 | 40952 | 69 | GTGCCGTTCCATTTGACACG | 33 | 12 | 15 | 1 30 | 0 |
| 8265 | 3632 | 3614 | 30816 | 69.3 | GTGCCGTTGGTAGACCCGTT | 33 | 12 | 18 | 32 12 | 0 |
| 8266 | 3633 | 3615 | 40953 | 71.5 | GTGCCGTTGAGTAGCCGCAA | 33 | 12 | 20 | 36 21 | 0 |
| 8267 | 3634 | 3616 | 30817 | 67.8 | GTGCCGTTGATGTCTGGCTT | 33 | 12 | 27 | 8 17 | 0 |
| 8268 | 3635 | 3617 | 30818 | 68.4 | CGTTTCCCTTAGTCCCCAGC | 12 | 28 | 3 | 28 31 | 1 |
| 8269 | 3636 | 3618 | 10869 | 70.3 | GTGCCGTTGGACGACCAATC | 33 | 12 | 34 | 32 4 | 0 |
| 8270 | 3637 | 3619 | 10870 | 66.7 | CTCATTGACACGGGTATGCG | 13 | 1 | 30 | 18 29 | 0 |
| 8271 | 3638 | 3620 | 10874 | 69.3 | GTGCCTCACCATAGCCCGTT | 33 | 13 | 15 | 36 12 | 0 |
| 8272 | 3639 | 3621 | 10877 | 70.5 | CTCAAGTGGGACCAGCCACG | 13 | 22 | 34 | 31 30 | 0 |
| 8273 | 3640 | 3622 | 10880 | 64.9 | GTGCCTCACCTACTTGACGG | 33 | 13 | 26 | 11 35 | 0 |
| 8274 | 3641 | 3623 | 10881 | 66.3 | CTCATCCCTGATGATGCACG | 13 | 28 | 2 | 27 30 | 0 |
| 8275 | 3642 | 3624 | 30819 | 68.3 | CTCAAGCCTGATGGACGTGC | 13 | 36 | 2 | 34 33 | 0 |
| 8276 | 3643 | 3625 | 10886 | 71.6 | CTGTTCTGTGCGTCCCGTGC | 14 | 8 | 29 | 28 33 | 0 |
| 8277 | 3644 | 3626 | 10890 | 72.8 | CTGTGATGCACGGCTTTGCG | 14 | 27 | 30 | 17 29 | 0 |
| 8278 | 3645 | 3627 | 30820 | 68.3 | GTGCCATTTGACGAAGTGC | 33 | 15 | 1 | 16 33 | 0 |
| 8279 | 3646 | 3628 | 40960 | 69.4 | CCATTCTGATCGTCCGCTT | 15 | 8 | 24 | 28 17 | 0 |
| 8280 | 3647 | 3629 | 30821 | 68 | CCATTGTCTGTCCAGCGCTT | 15 | 9 | 9 | 31 17 | 0 |
| 8281 | 3648 | 3630 | 16391 | 69.2 | GTGCCCATTCGTACGGGTCT | 33 | 15 | 10 | 35 19 | 0 |

FIG. 29YYY

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8282 | 3649 | 3631 | 16393 | 66.4 | CCATCTCAATACGGACGCAA | 15 | 13 | 5 | 34 | 21 | 0 |
| 8283 | 3650 | 3632 | 40963 | 68.2 | GTGCCCATAGGAGTGCGATG | 33 | 15 | 25 | 33 | 27 | 0 |
| 8284 | 3651 | 3633 | 40964 | 69.3 | GTGCCCATCCTACACGGACC | 33 | 15 | 26 | 30 | 32 | 0 |
| 8285 | 3652 | 3634 | 10910 | 72.9 | GTGCCCATTGCGGAGTACGG | 33 | 15 | 29 | 20 | 35 | 0 |
| 8286 | 3653 | 3635 | 10911 | 68.5 | CCATCAGCCTGTACCTTGCG | 15 | 31 | 14 | 23 | 29 | 0 |
| 8287 | 3654 | 3636 | 40967 | 66.7 | CGAATTGAGATGGATGCACG | 16 | 1 | 27 | 27 | 30 | 0 |
| 8288 | 3655 | 3637 | 30822 | 65.1 | GTGCCGAATGATAATCCAGC | 33 | 16 | 2 | 4 | 31 | 0 |
| 8289 | 3656 | 3638 | 10914 | 64.8 | GTGCCGAAAATCAATCGAGT | 33 | 16 | 4 | 4 | 20 | 0 |
| 8290 | 3657 | 3639 | 16396 | 68.2 | GTGCCGAAAAAGGGTATCCC | 33 | 16 | 6 | 18 | 28 | 0 |
| 8291 | 3658 | 3640 | 22045 | 67.6 | CGAATGTCGATGTGATTGCG | 16 | 9 | 27 | 2 | 29 | 0 |
| 8292 | 3659 | 3641 | 10918 | 68.1 | GTGCCGAACGTTTGATGACC | 33 | 16 | 12 | 2 | 32 | 0 |
| 8293 | 3660 | 3642 | 30823 | 70.7 | GTGCCGAACCATTCGTCAGC | 33 | 16 | 15 | 10 | 31 | 0 |
| 8294 | 3661 | 3643 | 30824 | 69.1 | GTGCCGAAAGTGAATCGCAA | 33 | 16 | 22 | 4 | 21 | 0 |
| 8295 | 3662 | 3644 | 10926 | 71.2 | GTGCCGAACACGCGTTGAGT | 33 | 16 | 30 | 12 | 20 | 0 |
| 8296 | 3663 | 3645 | 22050 | 65.6 | CGAAGGACCTGTAAAGCACG | 16 | 34 | 14 | 6 | 30 | 0 |
| 8297 | 3664 | 3646 | 16401 | 75.6 | GTGCCGAAACGGCCATCGAA | 33 | 16 | 35 | 15 | 16 | 0 |
| 8298 | 3665 | 3647 | 30825 | 66.5 | GTGCGCTTTTAGTCGTGTGC | 33 | 17 | 3 | 10 | 33 | 0 |
| 8299 | 3666 | 3648 | 10932 | 66.8 | GTGCGCTTAAAGAGTGCACG | 33 | 17 | 6 | 22 | 30 | 0 |
| 8300 | 3667 | 3649 | 40971 | 67 | GTGCGCTTTACAAAAGCACG | 33 | 17 | 7 | 6 | 30 | 0 |
| 8301 | 3668 | 3650 | 10936 | 64.9 | GTGCGCTTCTCACTCAGGAC | 33 | 17 | 13 | 13 | 34 | 0 |
| 8302 | 3669 | 3651 | 22053 | 65.6 | GTGCGCTTGGTAGTCTACGG | 33 | 17 | 18 | 19 | 35 | 0 |
| 8303 | 3670 | 3652 | 30826 | 67.3 | GTGCGCTTAGGACCATCGTT | 33 | 17 | 25 | 15 | 12 | 0 |
| 8304 | 3671 | 3654 | 10943 | 69.1 | GTGCGCTTGATGCTTGGGTA | 33 | 17 | 27 | 11 | 18 | 0 |
| 8305 | 3672 | 3655 | 10944 | 72.7 | GTGCGCTTTCCCCGAATTGA | 33 | 17 | 28 | 16 | 1 | 0 |
| 8306 | 3673 | 3656 | 10946 | 68 | GTGCGCTTGACCTCTGGGTA | 33 | 17 | 32 | 8 | 18 | 0 |
| 8307 | 3674 | 3657 | 10948 | 69.2 | GTGCGCTTGGACTGTCGATG | 33 | 17 | 34 | 9 | 27 | 0 |
| 8308 | 3675 | 3658 | 30828 | 69 | GTGCGGTAAAAGGACCGGAC | 33 | 18 | 6 | 32 | 34 | 0 |
| 8309 | 3676 | 3659 | 30829 | 67.4 | GTGCGGTACGTTTCTGGACC | 33 | 18 | 12 | 8 | 32 | 0 |
| 8310 | 3677 | 3660 | 22057 | 71.3 | GTGCGGTACGAATGCGAGGA | 33 | 18 | 16 | 29 | 25 | 0 |
| 8311 | 3678 | 3661 | 30830 | 67.9 | GTGCGGTAGCAAAGGACAGC | 33 | 18 | 21 | 25 | 31 | 0 |
| 8312 | 3679 | 3662 | 16408 | 69.9 | GTGCGGTACCTAACGGGTGC | 33 | 18 | 26 | 35 | 33 | 0 |
| 8313 | 3680 | 3663 | 16409 | 70.1 | GTGCGGTAAGCCGGACTCTG | 33 | 18 | 36 | 34 | 8 | 0 |
| 8314 | 3681 | 3664 | 10961 | 66.3 | GTGCGTCTTTGACCTATGCG | 33 | 19 | 1 | 26 | 29 | 0 |
| 8315 | 3682 | 3665 | 10963 | 69.9 | GTGCGTCTTGTCGCAACGAA | 33 | 19 | 9 | 21 | 16 | 0 |
| 8316 | 3683 | 3666 | 10966 | 68.3 | GTGCGTCTGGTAATCGGTGC | 33 | 19 | 18 | 24 | 33 | 0 |
| 8317 | 3684 | 3667 | 10967 | 68 | GTGCGTCTATCGGCTTACGG | 33 | 19 | 24 | 17 | 35 | 0 |
| 8318 | 3685 | 3668 | 10969 | 69.2 | GTGCGTCTGATGCTTGGTGC | 33 | 19 | 27 | 11 | 33 | 0 |
| 8319 | 3686 | 3669 | 10970 | 69.6 | GTGCGTCTTCCCGTCTGCTT | 33 | 19 | 28 | 19 | 17 | 0 |
| 8320 | 3687 | 3670 | 10983 | 68.9 | GTGCGAGTAGGAGCAATGCG | 33 | 20 | 25 | 21 | 29 | 0 |
| 8321 | 3688 | 3671 | 10984 | 71.8 | GTGCGAGTGATGCAGCCAGC | 33 | 20 | 27 | 31 | 31 | 0 |
| 8322 | 3689 | 3672 | 10985 | 69.9 | GTGCGAGTTCCCGTCTCAGC | 33 | 20 | 28 | 19 | 31 | 0 |
| 8323 | 3690 | 3673 | 16417 | 70.5 | GTGCGAGTTGCGAATCCGTT | 33 | 20 | 29 | 4 | 12 | 0 |
| 8324 | 3691 | 3674 | 40979 | 65.6 | GTGCGCAATTGATTAGAGCC | 33 | 21 | 1 | 3 | 36 | 0 |
| 8325 | 3692 | 3675 | 30831 | 66.7 | GTGCGCAAATACCAGCAAAG | 33 | 21 | 5 | 31 | 6 | 0 |
| 8326 | 3693 | 3676 | 40981 | 68.8 | GCAATACAAGCCCTGTTGCG | 21 | 7 | 36 | 14 | 29 | 0 |
| 8327 | 3694 | 3677 | 40982 | 68.1 | GTGCGCAATGTCTCTGGGAC | 33 | 21 | 9 | 8 | 34 | 0 |
| 8328 | 3695 | 3679 | 10993 | 69.2 | GTGCGCAACTCAGGACATCG | 33 | 21 | 13 | 34 | 24 | 0 |
| 8329 | 3696 | 3680 | 40983 | 68.8 | GTGCGCAACTGTGATGGACC | 33 | 21 | 14 | 27 | 32 | 0 |

FIG. 29ZZZ

| SEQ ID NO: | ZIP ID# | 4,633 HEX ID# | Tm | ZIPCODE (NH2 -> CONH2) | TETRAMER NUMBERS | | | | "UNALLOWED DIMERS" |
|---|---|---|---|---|---|---|---|---|---|
| 8330 | 3697 | 3681 | 16419 | 64.5 GTGCGCAAGGTATACAGCAA | 33 | 21 | 18 | 7 | 21 | 0 |
| 8331 | 3698 | 3682 | 10998 | 64   GTGCGCAAAGTGATACAGGA | 33 | 21 | 22 | 5 | 25 | 0 |
| 8332 | 3699 | 3683 | 30833 | 70.8 GTGCGCAAACCTTCGTGACC | 33 | 21 | 23 | 10 | 32 | 0 |
| 8333 | 3700 | 3684 | 10999 | 67.8 GTGCGCAAATCGTACACACG | 33 | 21 | 24 | 7 | 30 | 0 |
| 8334 | 3701 | 3685 | 16421 | 69.2 GTGCGCAAGATGAGTGACGG | 33 | 21 | 27 | 22 | 35 | 0 |
| 8335 | 3702 | 3686 | 11003 | 76.3 GTGCGCAATGCGGCTTGGAC | 33 | 21 | 29 | 17 | 34 | 0 |
| 8336 | 3703 | 3687 | 11006 | 71.4 GTGCGCAAGTGCAGGACGTT | 33 | 21 | 33 | 25 | 12 | 0 |
| 8337 | 3704 | 3688 | 40985 | 68.4 GTGCAGTGGCTTACGGCCTA | 33 | 22 | 17 | 35 | 26 | 0 |
| 8338 | 3705 | 3689 | 11016 | 72.8 AGTGGATGGCAATGCGCCAT | 22 | 27 | 21 | 29 | 15 | 0 |
| 8339 | 3706 | 3690 | 16425 | 71.6 AGTGTGCGGCTTTGTCTGCG | 22 | 29 | 17 | 9 | 29 | 0 |
| 8340 | 3707 | 3691 | 22072 | 68.6 GTGCAGTGGGACATCGGATG | 33 | 22 | 34 | 24 | 27 | 0 |
| 8341 | 3708 | 3692 | 11020 | 71.4 AGTGACGGCAGCGTCTCACG | 22 | 35 | 31 | 19 | 30 | 0 |
| 8342 | 3709 | 3693 | 30834 | 69.2 AGTGAGCCAATCGACCGACC | 22 | 36 | 4 | 32 | 32 | 0 |
| 8343 | 3710 | 3694 | 11029 | 73.2 ACCTGATGACGGGTGCGTGC | 23 | 27 | 35 | 33 | 33 | 0 |
| 8344 | 3711 | 3695 | 11031 | 70.7 ACCTCACGCACGAATCCGAA | 23 | 30 | 30 | 4 | 16 | 0 |
| 8345 | 3712 | 3696 | 11034 | 68.8 GTGCACCTACGGCCATTTGA | 33 | 23 | 35 | 15 | 1 | 0 |
| 8346 | 3713 | 3697 | 11037 | 71.5 ATCGTGATCAGCACGGGCAA | 24 | 2 | 31 | 35 | 21 | 0 |
| 8347 | 3714 | 3698 | 30835 | 71.9 GTGCATCGCTTGCTCAACGG | 33 | 24 | 11 | 13 | 35 | 0 |
| 8348 | 3715 | 3699 | 30836 | 67.9 ATCGCTGTTTAGAGCCTGCG | 24 | 14 | 3 | 36 | 29 | 0 |
| 8349 | 3716 | 3700 | 40991 | 71.3 GTGCATCGGTCTGTGCGACC | 33 | 24 | 19 | 33 | 32 | 0 |
| 8350 | 3717 | 3701 | 40992 | 75   GTGCATCGACCTTGCGCACG | 33 | 24 | 23 | 29 | 30 | 0 |
| 8351 | 3718 | 3702 | 40993 | 66.9 ATCGATCGTGATAGCCGACC | 24 | 24 | 2 | 36 | 32 | 0 |
| 8352 | 3719 | 3703 | 30837 | 71.7 GTGCATCGTCCCCTTGTCCC | 33 | 24 | 28 | 11 | 28 | 1 |
| 8353 | 3720 | 3704 | 16431 | 76.8 GTGCATCGCACGCACGGCTT | 33 | 24 | 30 | 30 | 17 | 0 |
| 8354 | 3721 | 3705 | 11050 | 73.7 GTGCATCGCAGCCGTTTCGT | 33 | 24 | 31 | 12 | 10 | 0 |
| 8355 | 3722 | 3706 | 11051 | 70.9 GTGCATCGACGGGCAATGAT | 33 | 24 | 35 | 21 | 2 | 0 |
| 8356 | 3723 | 3707 | 30838 | 69.8 AGGATCGTTGTCTCCCGCAA | 25 | 10 | 9 | 28 | 21 | 0 |
| 8357 | 3724 | 3708 | 11052 | 69   AGGACTTGCGAAATCGAGCC | 25 | 11 | 16 | 24 | 36 | 0 |
| 8358 | 3725 | 3709 | 22086 | 67.6 GTGCAGGAGCTTGCTTCGTT | 33 | 25 | 17 | 17 | 12 | 0 |
| 8359 | 3726 | 3710 | 30839 | 68.2 AGGAAGGAAATCGACCCGAA | 25 | 25 | 4 | 32 | 16 | 0 |
| 8360 | 3727 | 3712 | 16435 | 70.4 GTGCAGGACACGTGTCGCAA | 33 | 25 | 30 | 9 | 21 | 0 |
| 8361 | 3728 | 3713 | 11063 | 71.3 GTGCAGGACAGCCGAACGAA | 33 | 25 | 31 | 16 | 16 | 0 |
| 8362 | 3729 | 3714 | 11064 | 70.6 AGGAGACCCGAAGACCACGG | 25 | 32 | 16 | 32 | 35 | 0 |
| 8363 | 3730 | 3715 | 11065 | 70.1 GTGCAGGAGTGCCGTTAGCC | 33 | 25 | 33 | 12 | 36 | 0 |
| 8364 | 3731 | 3716 | 11067 | 70.3 GTGCAGGAACGGCTGTCGTT | 33 | 25 | 35 | 14 | 12 | 0 |
| 8365 | 3732 | 3717 | 11071 | 67.4 GTGCCCTAAAAGGACCTCCC | 33 | 26 | 6 | 32 | 28 | 0 |
| 8366 | 3733 | 3718 | 11072 | 68.6 CCTATGTCCGAAATCGCACG | 26 | 9 | 16 | 24 | 30 | 0 |
| 8367 | 3734 | 3719 | 40995 | 66   CCTACGTTGGTAGCTTTGCG | 26 | 12 | 18 | 17 | 29 | 0 |
| 8368 | 3735 | 3720 | 40996 | 69.1 CCTACCATTCTGCACGCGAA | 26 | 15 | 8 | 30 | 16 | 0 |
| 8369 | 3736 | 3721 | 41000 | 68   GTGCCCTAGACCTGTCGCAA | 33 | 26 | 32 | 9 | 21 | 0 |
| 8370 | 3737 | 3722 | 30840 | 66.4 GTGCCCTAAGCCTCGTCTGT | 33 | 26 | 36 | 10 | 14 | 0 |
| 8371 | 3738 | 3723 | 11084 | 67.3 GTGCGATGTGATATCGCGAA | 33 | 27 | 2 | 24 | 16 | 0 |
| 8372 | 3739 | 3724 | 11086 | 71.7 GTGCGATGTCTGTGCGAGCC | 33 | 27 | 8 | 29 | 36 | 0 |
| 8373 | 3740 | 3725 | 16441 | 66.5 GTGCGATGCTTGGCAATTAG | 33 | 27 | 11 | 21 | 3 | 0 |
| 8374 | 3741 | 3726 | 11092 | 70   GTGCGATGATCGCTGTGTGC | 33 | 27 | 24 | 14 | 33 | 0 |
| 8375 | 3742 | 3727 | 30841 | 76.5 GTGCGATGTCCCGGACGCAA | 33 | 27 | 28 | 34 | 21 | 0 |
| 8376 | 3743 | 3728 | 11099 | 70.9 TCCCTTAGCTTGGTGCTGCG | 28 | 3 | 11 | 33 | 29 | 0 |
| 8377 | 3744 | 3729 | 11104 | 70.2 TCCCCTTGGAGTTGATTGCG | 28 | 11 | 20 | 2 | 29 | 0 |

FIG. 29AAAA

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8378 | 3745 | 3730 | 16449 | 71.1 | TCCCCGTTCTGTCTGTTGCG | 28 | 12 | 14 | 14 | 29 | 0 |
| 8379 | 3746 | 3731 | 11111 | 68.8 | TCCCGAGTTACAGTGCCACG | 28 | 20 | 7 | 33 | 30 | 0 |
| 8380 | 3747 | 3732 | 16451 | 70.2 | TCCCACCTGACCCCTATCCC | 28 | 23 | 32 | 26 | 28 | 0 |
| 8381 | 3748 | 3733 | 22097 | 72.6 | GTGCTCCCATCGATCGCGTT | 33 | 28 | 24 | 24 | 12 | 0 |
| 8382 | 3749 | 3734 | 41006 | 73.6 | TCCCGTGCAGTGTCCCGGTA | 28 | 33 | 22 | 28 | 18 | 1 |
| 8383 | 3750 | 3735 | 11116 | 69.8 | GTGCTCCCGGACTTGAGTGC | 33 | 28 | 34 | 1 | 33 | 0 |
| 8384 | 3751 | 3736 | 11118 | 73.7 | TCCCAGCCGTCTTCTGCACG | 28 | 36 | 19 | 8 | 30 | 0 |
| 8385 | 3752 | 3737 | 41007 | 70.3 | GTGCTGCGTCTGTCTGCACG | 33 | 29 | 8 | 8 | 30 | 0 |
| 8386 | 3753 | 3738 | 11125 | 69.7 | GTGCTGCGCTGTGCAAAATC | 33 | 29 | 14 | 21 | 4 | 0 |
| 8387 | 3754 | 3739 | 41008 | 67.3 | TGCGGAGTAAAGAGCCCCTA | 29 | 20 | 6 | 36 | 26 | 0 |
| 8388 | 3755 | 3740 | 11132 | 70.3 | TGCGTCCCTACACAGCTCCC | 29 | 28 | 7 | 31 | 28 | 0 |
| 8389 | 3756 | 3741 | 11133 | 75.6 | TGCGCACGGCTTGTCTGTGC | 29 | 30 | 17 | 19 | 33 | 0 |
| 8390 | 3757 | 3742 | 11134 | 75.5 | GTGCTGCGCAGCAAAGCACG | 33 | 29 | 31 | 6 | 30 | 0 |
| 8391 | 3758 | 3743 | 11135 | 72.2 | TGCGGACCTCTGAGTGTGCG | 29 | 32 | 8 | 22 | 29 | 0 |
| 8392 | 3759 | 3744 | 16457 | 74.9 | TGCGAGCCGCAAGATGCTTG | 29 | 36 | 21 | 27 | 11 | 0 |
| 8393 | 3760 | 3745 | 16458 | 71.7 | GTGCCACGTTAGGTGCGTGC | 33 | 30 | 3 | 33 | 33 | 0 |
| 8394 | 3761 | 3746 | 11144 | 67.7 | GTGCCACGTCTGAGTGGACC | 33 | 30 | 8 | 22 | 32 | 0 |
| 8395 | 3762 | 3747 | 16460 | 67 | GTGCCACGGGTAACCTAGGA | 33 | 30 | 18 | 23 | 25 | 0 |
| 8396 | 3763 | 3748 | 30842 | 69.2 | GTGCCACGGAGTACGGGAGT | 33 | 30 | 20 | 35 | 20 | 0 |
| 8397 | 3764 | 3749 | 11152 | 67 | GTGCCACGAGTGTGTCATCG | 33 | 30 | 22 | 9 | 24 | 0 |
| 8398 | 3765 | 3750 | 11158 | 71 | GTGCCACGAGCCAATCCTCA | 33 | 30 | 36 | 4 | 13 | 0 |
| 8399 | 3766 | 3751 | 30843 | 65.6 | GTGCCAGCTGATAGCCAAAG | 33 | 31 | 2 | 36 | 6 | 0 |
| 8400 | 3767 | 3752 | 41012 | 65.7 | GTGCCAGCAATCAAAGGGTA | 33 | 31 | 4 | 6 | 18 | 0 |
| 8401 | 3768 | 3753 | 11162 | 69.3 | GTGCCAGCATACCAGCGATG | 33 | 31 | 5 | 31 | 27 | 0 |
| 8402 | 3769 | 3754 | 22115 | 68.4 | GTGCCAGCAAAGGTCTGTGC | 33 | 31 | 6 | 19 | 33 | 0 |
| 8403 | 3770 | 3755 | 30844 | 71.1 | GTGCCAGCCGAATTAGTGCG | 33 | 31 | 16 | 3 | 29 | 0 |
| 8404 | 3771 | 3756 | 11171 | 71.8 | GTGCCAGCGTCTTGTCGTGC | 33 | 31 | 19 | 9 | 33 | 0 |
| 8405 | 3772 | 3757 | 41014 | 68.1 | CAGCGAGTTTAGGTGCAGCC | 31 | 20 | 3 | 33 | 36 | 0 |
| 8406 | 3773 | 3758 | 30845 | 69.1 | GTGCCAGCCCTAAATCGGAC | 33 | 31 | 26 | 4 | 34 | 0 |
| 8407 | 3774 | 3759 | 11176 | 69.8 | GTGCCAGCTCCCCTCACTTG | 33 | 31 | 28 | 13 | 11 | 0 |
| 8408 | 3775 | 3760 | 11178 | 75.5 | GTGCCAGCGTGCAGTGGCAA | 33 | 31 | 33 | 22 | 21 | 0 |
| 8409 | 3776 | 3761 | 11179 | 70.8 | GTGCCAGCACGGAAAGATCG | 33 | 31 | 35 | 6 | 24 | 0 |
| 8410 | 3777 | 3762 | 16466 | 68.2 | GTGCGACCTTAGGTGCGGTA | 33 | 32 | 3 | 33 | 18 | 0 |
| 8411 | 3778 | 3763 | 11183 | 70.5 | GTGCGACCATACAGCCGGAC | 33 | 32 | 5 | 36 | 34 | 0 |
| 8412 | 3779 | 3764 | 11186 | 67.9 | GTGCGACCCTGTTTAGCAGC | 33 | 32 | 14 | 3 | 31 | 0 |
| 8413 | 3780 | 3765 | 16468 | 72.2 | GTGCGACCCGAAAGCCTGTC | 33 | 32 | 16 | 36 | 9 | 0 |
| 8414 | 3781 | 3766 | 41018 | 68 | GTGCGACCGCTTATACCAGC | 33 | 32 | 17 | 5 | 31 | 0 |
| 8415 | 3782 | 3767 | 30847 | 70.2 | GTGCGACCGGTAGGACGGTA | 33 | 32 | 18 | 34 | 18 | 0 |
| 8416 | 3783 | 3768 | 11191 | 72.3 | GTGCGACCAGTGGATGCACG | 33 | 32 | 22 | 27 | 30 | 0 |
| 8417 | 3784 | 3769 | 16469 | 71.7 | GTGCGACCAGGAAGCCACCT | 33 | 32 | 25 | 36 | 23 | 0 |
| 8418 | 3785 | 3770 | 11196 | 72.4 | GTGCGACCCAGCGAGTAGCC | 33 | 32 | 31 | 20 | 36 | 0 |
| 8419 | 3786 | 3771 | 11197 | 73.9 | GTGCGACCACGGCTCAATCG | 33 | 32 | 35 | 13 | 24 | 0 |
| 8420 | 3787 | 3772 | 41020 | 68.4 | GTGCGTGCTTGACGAAGGAC | 33 | 33 | 1 | 16 | 34 | 0 |
| 8421 | 3788 | 3773 | 11198 | 68.5 | GTGCGTGCTGATTCCCAAAG | 33 | 33 | 2 | 28 | 6 | 0 |
| 8422 | 3789 | 3774 | 22127 | 69.9 | GTGCGTGCTACATGCGAGGA | 33 | 33 | 7 | 29 | 25 | 0 |
| 8423 | 3790 | 3775 | 11205 | 68.1 | GTGCGTGCCTGTACCTGACC | 33 | 33 | 14 | 23 | 32 | 0 |
| 8424 | 3791 | 3776 | 11208 | 73 | GTGCGTGCGTCTCCATGCAA | 33 | 33 | 19 | 15 | 21 | 0 |
| 8425 | 3792 | 3777 | 11209 | 70.1 | GTGCGTGCGAGTCTGTGTGC | 33 | 33 | 20 | 14 | 33 | 0 |

FIG. 29BBBB

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8426 | 3793 | 3778 | 11210 | 74   | GTGCGTGCATCGCCATAGCC | 33 | 33 | 24 | 15 | 36 | 0 |
| 8427 | 3794 | 3779 | 11212 | 77.2 | GTGCGTGCCACGGCTTCACG | 33 | 33 | 30 | 17 | 30 | 0 |
| 8428 | 3795 | 3780 | 11216 | 70.9 | GTGCGGACATACGCAAAGCC | 33 | 34 | 5  | 21 | 36 | 0 |
| 8429 | 3796 | 3781 | 30848 | 68.7 | GTGCGGACGTCTCGTTGGTA | 33 | 34 | 19 | 12 | 18 | 0 |
| 8430 | 3797 | 3782 | 11226 | 74   | GTGCGGACTCCCCAGCGTCT | 33 | 34 | 28 | 31 | 19 | 0 |
| 8431 | 3798 | 3783 | 11227 | 69.7 | GGACTGCGAGTGTGTCGCAA | 34 | 29 | 22 | 9  | 21 | 0 |
| 8432 | 3799 | 3784 | 11228 | 71.1 | GTGCGGACGACCTCGTTTGA | 33 | 34 | 32 | 10 | 1  | 0 |
| 8433 | 3800 | 3785 | 41026 | 74.2 | GTGCACGGAATCGCTTTGCG | 33 | 35 | 4  | 17 | 29 | 0 |
| 8434 | 3801 | 3786 | 41027 | 73.9 | ACGGTCTGTCCCCACGCCAT | 35 | 8  | 28 | 30 | 15 | 0 |
| 8435 | 3802 | 3787 | 30849 | 69.8 | ACGGCTCAACCTTCTGCAGC | 35 | 13 | 23 | 8  | 31 | 0 |
| 8436 | 3803 | 3788 | 11239 | 70.1 | GTGCACGGCCATCTTGACCT | 33 | 35 | 15 | 11 | 23 | 0 |
| 8437 | 3804 | 3789 | 22145 | 73.9 | GTGCACGGGTCTTGCGATCG | 33 | 35 | 19 | 29 | 24 | 0 |
| 8438 | 3805 | 3790 | 41028 | 70.9 | GTGCACGGGAGTCCATCGAA | 33 | 35 | 20 | 15 | 16 | 0 |
| 8439 | 3806 | 3791 | 41029 | 73.7 | ACGGAGTGGACCAGCCGGAC | 35 | 22 | 32 | 36 | 34 | 0 |
| 8440 | 3807 | 3792 | 41030 | 72.8 | GTGCACGGATCGGATGAGCC | 33 | 35 | 24 | 27 | 36 | 0 |
| 8441 | 3808 | 3793 | 11243 | 69.3 | GTGCACGGAGGATCCCTGTC | 33 | 35 | 25 | 28 | 9  | 0 |
| 8442 | 3809 | 3794 | 11246 | 74.8 | GTGCACGGGTGCGAGTGTGC | 33 | 35 | 33 | 20 | 33 | 0 |
| 8443 | 3810 | 3795 | 22147 | 72.6 | GTGCACGGGGACCCATTCTG | 33 | 35 | 34 | 15 | 8  | 0 |
| 8444 | 3811 | 3796 | 11248 | 73.7 | GTGCACGGACGGAGTGGTGC | 33 | 35 | 35 | 22 | 33 | 0 |
| 8445 | 3812 | 3797 | 16475 | 73   | GTGCAGCCAAAGCAGCCGTT | 33 | 36 | 6  | 31 | 12 | 0 |
| 8446 | 3813 | 3798 | 11250 | 68.6 | GTGCAGCCTCGTTACAACGG | 33 | 36 | 10 | 7  | 35 | 0 |
| 8447 | 3814 | 3799 | 16478 | 72.2 | GTGCAGCCATCGAATCGCAA | 33 | 36 | 24 | 4  | 21 | 0 |
| 8448 | 3815 | 3800 | 16479 | 73.8 | GTGCAGCCTCCCGACCACCT | 33 | 36 | 28 | 32 | 23 | 0 |
| 8449 | 3816 | 3801 | 11261 | 74.2 | GTGCAGCCTGCGCCATCTTG | 33 | 36 | 29 | 15 | 11 | 0 |
| 8450 | 3817 | 3802 | 11264 | 75.9 | GTGCAGCCGACCCATGTGC | 33 | 36 | 32 | 15 | 33 | 0 |
| 8451 | 3818 | 3803 | 11265 | 75.6 | GTGCAGCCGTGCAGTGCGAA | 33 | 36 | 33 | 22 | 16 | 0 |
| 8452 | 3819 | 3804 | 11266 | 73.4 | GTGCAGCCACGGGATGCTGT | 33 | 36 | 35 | 27 | 14 | 0 |
| 8453 | 3820 | 3805 | 41034 | 71.2 | TTGAAGCCAATCCCATTGCG | 1  | 36 | 4  | 15 | 29 | 0 |
| 8454 | 3821 | 3806 | 11275 | 75.7 | TTAGCAGCCACGCACGTGCG | 3  | 31 | 30 | 30 | 29 | 0 |
| 8455 | 3822 | 3807 | 11276 | 69.4 | AATCCTTGACGGCCATCAGC | 4  | 11 | 35 | 15 | 31 | 0 |
| 8456 | 3823 | 3808 | 30850 | 67.1 | AATCTGCGTACAAGCCCGTT | 4  | 29 | 7  | 36 | 12 | 0 |
| 8457 | 3824 | 3809 | 11295 | 72.6 | AAAGGATGACGGGCAATGCG | 6  | 27 | 35 | 21 | 29 | 0 |
| 8458 | 3825 | 3810 | 30851 | 68.2 | GGACAAAGCACGAGCCTTGA | 34 | 6  | 30 | 36 | 1  | 0 |
| 8459 | 3826 | 3811 | 11300 | 69.9 | TCTGCGTTTCGTTCGTGTGC | 8  | 12 | 10 | 10 | 33 | 0 |
| 8460 | 3827 | 3812 | 11303 | 73.1 | TCTGCCTAACGGGCTTTGCG | 8  | 26 | 35 | 17 | 29 | 0 |
| 8461 | 3828 | 3813 | 11305 | 71.1 | TCTGCACGGCAAACCTGCTT | 8  | 30 | 21 | 23 | 17 | 0 |
| 8462 | 3829 | 3814 | 30852 | 69.6 | TCGTCGTTATCGCAGCAGGA | 10 | 12 | 24 | 31 | 25 | 0 |
| 8463 | 3830 | 3815 | 16494 | 71.7 | TCGTCCATGATGGGACTGCG | 10 | 15 | 27 | 34 | 29 | 0 |
| 8464 | 3831 | 3816 | 11321 | 71.6 | TCGTACGGCTTGGTCTTGCG | 10 | 35 | 11 | 19 | 29 | 0 |
| 8465 | 3832 | 3817 | 30853 | 67.7 | CTTGCTTGTGCGTTAGCACG | 11 | 11 | 29 | 3  | 30 | 0 |
| 8466 | 3833 | 3818 | 30854 | 69.8 | GGACCTTGCGTTACGGCCTA | 34 | 11 | 12 | 35 | 26 | 0 |
| 8467 | 3834 | 3819 | 41042 | 68.4 | CTTGCTCAAAAGCAGCAGCC | 11 | 13 | 6  | 31 | 36 | 0 |
| 8468 | 3835 | 3820 | 11328 | 68.7 | GGACCTTGGAGTCACGAGCC | 34 | 11 | 20 | 30 | 36 | 0 |
| 8469 | 3836 | 3821 | 30855 | 72.6 | GGACCTTGGCAAGGACGCAA | 34 | 11 | 21 | 34 | 21 | 0 |
| 8470 | 3837 | 3823 | 11332 | 73.9 | GGACCTTGCAGCGCTTGCAA | 34 | 11 | 31 | 17 | 21 | 0 |
| 8471 | 3838 | 3824 | 16502 | 71.5 | GGACCTTGGTGCCGAATCGT | 34 | 11 | 33 | 16 | 10 | 0 |
| 8472 | 3839 | 3825 | 11335 | 72.5 | GGACCTTGGGACGCAACGAA | 34 | 11 | 34 | 21 | 16 | 0 |
| 8473 | 3840 | 3826 | 30856 | 66.8 | CGTTCGTTATACACGGGCAA | 12 | 12 | 5  | 35 | 21 | 0 |

FIG. 29CCCC

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8474 | 3841 | 3827 | 16508 | 67.6 | GGACCGTTACCTGAGTTGCG | 34 | 12 | 23 | 20 | 29 | 0 |
| 8475 | 3842 | 3828 | 22167 | 69.9 | GGACCGTTTGCGGAGTATCG | 34 | 12 | 29 | 20 | 24 | 0 |
| 8476 | 3843 | 3829 | 11361 | 66.7 | GGACCTGTTTGATGCGGAGT | 34 | 14 | 1 | 29 | 20 | 0 |
| 8477 | 3844 | 3830 | 11363 | 68.1 | GGACCTGTCCATCCATTCCC | 34 | 14 | 15 | 15 | 28 | 0 |
| 8478 | 3845 | 3831 | 16519 | 69.8 | CCATTGATCAGCGACCCCAT | 15 | 2 | 31 | 32 | 15 | 0 |
| 8479 | 3846 | 3832 | 11374 | 67.8 | CCATAAAGCTGTTCCCGTGC | 15 | 6 | 14 | 28 | 33 | 0 |
| 8480 | 3847 | 3833 | 11378 | 68.6 | GGACCCATCTTGCTTGTCCC | 34 | 15 | 11 | 11 | 28 | 1 |
| 8481 | 3848 | 3834 | 16522 | 72.5 | GGACCCATGGTATGCGGTGC | 34 | 15 | 18 | 29 | 33 | 0 |
| 8482 | 3849 | 3835 | 11385 | 73.4 | GGACCCATCACGCTTGCGAA | 34 | 15 | 30 | 11 | 16 | 0 |
| 8483 | 3850 | 3836 | 22172 | 69.4 | GGACCCATGTGCATACGCAA | 34 | 15 | 33 | 5 | 21 | 0 |
| 8484 | 3851 | 3837 | 30859 | 70.4 | CGAATTGACTTGCACGCACG | 16 | 1 | 11 | 30 | 30 | 0 |
| 8485 | 3852 | 3838 | 11392 | 69.6 | GGACCGAAATACACGGGTGC | 34 | 16 | 5 | 35 | 33 | 0 |
| 8486 | 3853 | 3839 | 41053 | 66.3 | CGAAAAAGTCTGCTTGGCAA | 16 | 6 | 8 | 11 | 21 | 0 |
| 8487 | 3854 | 3840 | 30860 | 70.9 | GGACCGAACTTGACGGTCCC | 34 | 16 | 11 | 35 | 28 | 1 |
| 8488 | 3855 | 3841 | 11397 | 66.7 | GGACCGAAGCTTTCGTAGGA | 34 | 16 | 17 | 10 | 25 | 0 |
| 8489 | 3856 | 3842 | 41055 | 68.9 | GGACCGAAACCTGCTTGCTT | 34 | 16 | 23 | 17 | 17 | 0 |
| 8490 | 3857 | 3843 | 41056 | 67.8 | CGAAAGGAATACCAGCCACG | 16 | 25 | 5 | 31 | 30 | 0 |
| 8491 | 3858 | 3844 | 11402 | 74.9 | GGACCGAAGACCCAGCGCAA | 34 | 16 | 32 | 31 | 21 | 0 |
| 8492 | 3859 | 3845 | 16533 | 68.9 | GGACGCTTTTAGGGACCGAA | 34 | 17 | 3 | 34 | 16 | 0 |
| 8493 | 3860 | 3846 | 16534 | 70.3 | GGACGCTTAAAGGTGCGTGC | 34 | 17 | 6 | 33 | 33 | 0 |
| 8494 | 3861 | 3847 | 41058 | 70.1 | GCTTTGTCACCTTCCCTGCG | 17 | 9 | 23 | 28 | 29 | 1 |
| 8495 | 3862 | 3848 | 41059 | 66.9 | GGACGCTTGGTAAATCGCTT | 34 | 17 | 18 | 4 | 17 | 0 |
| 8496 | 3863 | 3849 | 11413 | 68.4 | GGACGCTTACCTGCAACGAA | 34 | 17 | 23 | 21 | 16 | 0 |
| 8497 | 3864 | 3850 | 30862 | 65.7 | GCTTCCTATGTCATCGGCAA | 17 | 26 | 9 | 24 | 21 | 0 |
| 8498 | 3865 | 3851 | 30863 | 71.1 | GGACGCTTTGCGTTGAATCG | 34 | 17 | 29 | 1 | 24 | 0 |
| 8499 | 3866 | 3852 | 41061 | 70.9 | GGACGGTACGTTTCGTTGCG | 34 | 18 | 12 | 10 | 29 | 0 |
| 8500 | 3867 | 3853 | 16537 | 68.6 | GGACGGTACCATTGTCGCAA | 34 | 18 | 15 | 9 | 21 | 0 |
| 8501 | 3868 | 3854 | 16539 | 68.4 | GGACGGTAGTGCAGTGCAGC | 34 | 18 | 33 | 22 | 31 | 0 |
| 8502 | 3869 | 3855 | 11431 | 71 | GGACGGTAGGACGCAATCCC | 34 | 18 | 34 | 21 | 28 | 0 |
| 8503 | 3870 | 3856 | 16540 | 71.7 | GGACGGTAAGCCGTGCACCT | 34 | 18 | 36 | 33 | 23 | 0 |
| 8504 | 3871 | 3857 | 11433 | 70.2 | GTCTTTGATCCCCACGCGAA | 19 | 1 | 28 | 30 | 16 | 0 |
| 8505 | 3872 | 3858 | 11434 | 69 | GGACGTCTTCGTGCAAGCAA | 34 | 19 | 10 | 21 | 21 | 0 |
| 8506 | 3873 | 3859 | 16541 | 69.3 | GGACGTCTCCATGGACCAGC | 34 | 19 | 15 | 34 | 31 | 0 |
| 8507 | 3874 | 3860 | 11437 | 65.9 | GTCTGCAAGACCTCTGTGCG | 19 | 21 | 32 | 8 | 29 | 0 |
| 8508 | 3875 | 3861 | 16543 | 68.8 | GTCTCACGCACGAAAGCAGC | 19 | 30 | 30 | 6 | 31 | 0 |
| 8509 | 3876 | 3862 | 11449 | 66.7 | GAGTATCGGGACCCTATGCG | 20 | 24 | 34 | 26 | 29 | 0 |
| 8510 | 3877 | 3863 | 11452 | 74.2 | GGACGAGTCAGCGTGCGTGC | 34 | 20 | 31 | 33 | 33 | 0 |
| 8511 | 3878 | 3864 | 11455 | 65 | GGACGAGTACGGTTGAATCG | 34 | 20 | 35 | 1 | 24 | 1 |
| 8512 | 3879 | 3865 | 30864 | 68.6 | GCAATTGAACGGAGTGCAGC | 21 | 1 | 35 | 22 | 31 | 0 |
| 8513 | 3880 | 3866 | 11458 | 70.2 | GGACGCAAATACGTGCCCAT | 34 | 21 | 5 | 33 | 15 | 0 |
| 8514 | 3881 | 3867 | 22187 | 68.3 | GGACGCAATGTCCCATGGTA | 34 | 21 | 9 | 15 | 18 | 0 |
| 8515 | 3882 | 3868 | 11460 | 70.7 | GGACGCAATCGTTCTGGTGC | 34 | 21 | 10 | 8 | 33 | 0 |
| 8516 | 3883 | 3869 | 30865 | 66.7 | GCAACCTAATACTGCGTGCG | 21 | 26 | 5 | 29 | 29 | 0 |
| 8517 | 3884 | 3870 | 11468 | 71.3 | GGACGCAATGCGTTGAAGGA | 34 | 21 | 29 | 1 | 25 | 0 |
| 8518 | 3885 | 3871 | 11469 | 67.8 | GGACGCAAGTGCAGTGGTCT | 34 | 21 | 33 | 22 | 19 | 0 |
| 8519 | 3886 | 3872 | 30866 | 71.6 | GGACGCAAGGACTCCCGGTA | 34 | 21 | 34 | 28 | 18 | 0 |
| 8520 | 3887 | 3873 | 22189 | 70.7 | GGACGCAAACGGTGATCAGC | 34 | 21 | 35 | 2 | 31 | 0 |
| 8521 | 3888 | 3874 | 16552 | 71 | AGTGTGCGACGGACCTGTGC | 22 | 29 | 35 | 23 | 33 | 0 |

FIG. 29DDDD

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8522 | 3889 | 3875 | 16556 | 70.1 | ACCTCACGGGACTGATTGCG | 23 | 30 | 34 | 2 | 29 | 0 |
| 8523 | 3890 | 3876 | 16557 | 73.5 | GGACACCTGACCGTGCACGG | 34 | 23 | 32 | 33 | 35 | 0 |
| 8524 | 3891 | 3877 | 30867 | 67.4 | ACCTAGCCTTAGCGTTTGCG | 23 | 36 | 3 | 12 | 29 | 0 |
| 8525 | 3892 | 3878 | 11490 | 72.5 | ATCGAAAGACGGGTGCCACG | 24 | 6 | 35 | 33 | 30 | 0 |
| 8526 | 3893 | 3879 | 41069 | 69.8 | ATCGGCTTCTTGCTTGACGG | 24 | 17 | 11 | 11 | 35 | 0 |
| 8527 | 3894 | 3880 | 11496 | 70.5 | ATCGCACGGTCTAGCCATCG | 24 | 30 | 19 | 36 | 24 | 0 |
| 8528 | 3895 | 3881 | 11499 | 71.1 | GGACATCGACGGGACCTGT | 34 | 24 | 35 | 34 | 14 | 0 |
| 8529 | 3896 | 3882 | 22199 | 70.6 | AGGACGAAATCGTCCCGGAC | 25 | 16 | 24 | 28 | 34 | 0 |
| 8530 | 3897 | 3883 | 16564 | 69.4 | GGACAGGAATCGACGGCCTA | 34 | 25 | 24 | 35 | 26 | 0 |
| 8531 | 3898 | 3884 | 11505 | 66.1 | AGGAAGGATTGAGGACGTGC | 25 | 25 | 1 | 34 | 33 | 0 |
| 8532 | 3899 | 3885 | 41072 | 68 | CCTACGAAAGGATCGTTGCG | 26 | 16 | 25 | 10 | 29 | 0 |
| 8533 | 3900 | 3886 | 11511 | 67 | GGACCCTAGCTTGCAAGTGC | 34 | 26 | 17 | 21 | 33 | 0 |
| 8534 | 3901 | 3887 | 30869 | 69.5 | CCTAGCAACAGCGATGCGAA | 26 | 21 | 31 | 27 | 16 | 0 |
| 8535 | 3902 | 3888 | 11516 | 66.8 | CCTACCTAGACCAGCCACGG | 26 | 26 | 32 | 36 | 35 | 0 |
| 8536 | 3903 | 3889 | 41076 | 69.2 | GGACGATGCTCACTGTTGCG | 34 | 27 | 13 | 14 | 29 | 0 |
| 8537 | 3904 | 3890 | 30870 | 69.1 | GGACGATGGGTAACGGGGTA | 34 | 27 | 18 | 35 | 18 | 0 |
| 8538 | 3905 | 3891 | 11527 | 69.4 | GGACGATGGTCTAGCCCGAA | 34 | 27 | 19 | 36 | 16 | 0 |
| 8539 | 3906 | 3892 | 41077 | 72.2 | GGACGATGATCGCGAAAGCC | 34 | 27 | 24 | 16 | 36 | 0 |
| 8540 | 3907 | 3893 | 11535 | 71.7 | TCCCTGTCCGTTGCTTGCAA | 28 | 9 | 12 | 17 | 21 | 0 |
| 8541 | 3908 | 3894 | 11537 | 67.9 | TCCCCTGTTACAGACCTGCG | 28 | 14 | 7 | 32 | 29 | 0 |
| 8542 | 3909 | 3895 | 16576 | 70.1 | TCCCCCATTTAGCACGGATG | 28 | 15 | 3 | 30 | 27 | 0 |
| 8543 | 3910 | 3896 | 30872 | 70.4 | GGACTCCCACCTAGCCCAGC | 34 | 28 | 23 | 36 | 31 | 0 |
| 8544 | 3911 | 3897 | 16578 | 71.7 | GGACTCCCATCGCGAAAGGA | 34 | 28 | 24 | 16 | 25 | 0 |
| 8545 | 3912 | 3898 | 41080 | 74 | GGACTCCCCACGCTTGCGTT | 34 | 28 | 30 | 11 | 12 | 0 |
| 8546 | 3913 | 3899 | 11548 | 74.4 | GGACTCCCGGACGCTTCACG | 34 | 28 | 34 | 17 | 30 | 0 |
| 8547 | 3914 | 3900 | 11551 | 72.2 | TGCGTTAGCCATCACGACGG | 29 | 3 | 15 | 30 | 35 | 0 |
| 8548 | 3915 | 3901 | 11555 | 70.8 | GGACTGCGTCGTCGTTCAGC | 34 | 29 | 10 | 12 | 31 | 0 |
| 8549 | 3916 | 3902 | 16583 | 70.9 | GGACTGCGCTTGACCTCACG | 34 | 29 | 11 | 23 | 30 | 0 |
| 8550 | 3917 | 3903 | 11557 | 70.5 | TGCGCTCATCGTCGTTTTGA | 29 | 13 | 10 | 12 | 1 | 1 |
| 8551 | 3918 | 3904 | 30874 | 71 | TGCGGCTTAGGAGCTTCACG | 29 | 17 | 25 | 17 | 30 | 0 |
| 8552 | 3919 | 3905 | 16587 | 69.7 | TGCGACCTTTGAGCAACGAA | 29 | 23 | 1 | 21 | 16 | 1 |
| 8553 | 3920 | 3906 | 11563 | 70.8 | TGCGATCGACCTCCATGGAC | 29 | 24 | 23 | 15 | 34 | 0 |
| 8554 | 3921 | 3907 | 11565 | 70.6 | TGCGGATGGAGTATCGCCAT | 29 | 27 | 20 | 24 | 15 | 0 |
| 8555 | 3922 | 3908 | 11567 | 72.7 | TGCGCACGATACCAGCAGGA | 29 | 30 | 5 | 31 | 25 | 0 |
| 8556 | 3923 | 3909 | 11568 | 73.4 | GGACTGCGGGACCCATCCAT | 34 | 29 | 34 | 15 | 15 | 0 |
| 8557 | 3924 | 3910 | 16588 | 70.7 | CACGTGATGACCTCCCCGAA | 30 | 2 | 32 | 28 | 16 | 0 |
| 8558 | 3925 | 3911 | 30875 | 69.3 | GGACCACGCTCATTGATCCC | 34 | 30 | 13 | 1 | 28 | 0 |
| 8559 | 3926 | 3912 | 11578 | 73.1 | GGACCACGGCTTTCTGCACG | 34 | 30 | 17 | 8 | 30 | 0 |
| 8560 | 3927 | 3913 | 41086 | 67.7 | GGACCACGGAGTATCGCTCA | 34 | 30 | 20 | 24 | 13 | 0 |
| 8561 | 3928 | 3914 | 11584 | 74 | GGACCACGCACGCTCAGTGC | 34 | 30 | 30 | 13 | 33 | 0 |
| 8562 | 3929 | 3915 | 11589 | 73.7 | GGACCACGACGGTCTGTGCG | 34 | 30 | 35 | 8 | 29 | 0 |
| 8563 | 3930 | 3916 | 16594 | 73.8 | GGACCACGAGCCCGAACGTT | 34 | 30 | 36 | 16 | 12 | 0 |
| 8564 | 3931 | 3917 | 41088 | 68.7 | CAGCTTGATCGTCGAAACGG | 31 | 1 | 10 | 16 | 35 | 0 |
| 8565 | 3932 | 3918 | 11595 | 70.1 | GGACCAGCTGTCCAGCAGGA | 34 | 31 | 9 | 31 | 25 | 0 |
| 8566 | 3933 | 3919 | 30876 | 75.2 | GGACCAGCCTTGTGCGACGG | 34 | 31 | 11 | 29 | 35 | 0 |
| 8567 | 3934 | 3921 | 11599 | 68.9 | CAGCCTGTGGACTGTCCACG | 31 | 14 | 34 | 9 | 30 | 0 |
| 8568 | 3935 | 3922 | 30877 | 68.2 | CAGCGGTATGATGACCAGCC | 31 | 18 | 2 | 32 | 36 | 0 |
| 8569 | 3936 | 3923 | 41094 | 69.1 | CAGCAGTGACCTGTGCGCTT | 31 | 22 | 23 | 33 | 17 | 0 |

FIG. 29EEEE

| SEQ ID NO: | ZIP ID# | 4,633 ID# | H3X ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8570 | 3937 | 3924 | 11607 | 74.8 | GGACCAGCTGCGGACCCTCA | 34 | 31 | 29 | 32 | 13 | 0 |
| 8571 | 3938 | 3925 | 30879 | 71.3 | GGACGACCTTGAGTGCGCAA | 34 | 32 | 1 | 33 | 21 | 0 |
| 8572 | 3939 | 3926 | 30880 | 66.9 | GGACGACCCTGTAGTGCGTT | 34 | 32 | 14 | 22 | 12 | 0 |
| 8573 | 3940 | 3927 | 22225 | 72.1 | GGACGACCGGTAGTGCAGCC | 34 | 32 | 18 | 33 | 36 | 0 |
| 8574 | 3941 | 3928 | 22226 | 69.9 | GGACGACCGTCTGTGCACCT | 34 | 32 | 19 | 33 | 23 | 0 |
| 8575 | 3942 | 3929 | 11615 | 68.5 | GGACGACCGAGTCTTGGGAC | 34 | 32 | 20 | 11 | 34 | 0 |
| 8576 | 3943 | 3930 | 41097 | 67.3 | GACCAGTGAAAGGTGCAGCC | 32 | 22 | 6 | 33 | 36 | 0 |
| 8577 | 3944 | 3931 | 16601 | 72 | GGACGACCGACCCCATCTCA | 34 | 32 | 32 | 15 | 13 | 0 |
| 8578 | 3945 | 3932 | 11626 | 67.1 | GGACGTGCTGATTGATTCCC | 34 | 33 | 2 | 2 | 28 | 0 |
| 8579 | 3946 | 3933 | 16603 | 72.3 | GGACGTGCAATCGGACCGTT | 34 | 33 | 4 | 34 | 12 | 0 |
| 8580 | 3947 | 3934 | 11629 | 67.5 | GGACGTGCTCTGTCGTCCAT | 34 | 33 | 8 | 10 | 15 | 0 |
| 8581 | 3948 | 3935 | 11630 | 73.9 | GGACGTGCTGTCCAGCACGG | 34 | 33 | 9 | 31 | 35 | 0 |
| 8582 | 3949 | 3936 | 30881 | 71.4 | GGACGTGCTCGTCGAAGCAA | 34 | 33 | 10 | 16 | 21 | 0 |
| 8583 | 3950 | 3937 | 11632 | 73.6 | GGACGTGCCGTTGCTTCGAA | 34 | 33 | 12 | 17 | 16 | 0 |
| 8584 | 3951 | 3938 | 30882 | 69.9 | GTGCCGAAATACTCCCGTGC | 33 | 16 | 5 | 28 | 33 | 0 |
| 8585 | 3952 | 3939 | 30883 | 70.4 | GGACGTGCGGTATGTCGGAC | 34 | 33 | 18 | 9 | 34 | 0 |
| 8586 | 3953 | 3940 | 16606 | 74.9 | GGACGTGCAGTGGTGCTGCG | 34 | 33 | 22 | 33 | 29 | 0 |
| 8587 | 3954 | 3941 | 30884 | 66.2 | GGACGTGCCCTACCTATCGT | 34 | 33 | 26 | 26 | 10 | 0 |
| 8588 | 3955 | 3942 | 16609 | 71.6 | GGACGTGCTGCGTGTCCTTG | 34 | 33 | 29 | 9 | 11 | 0 |
| 8589 | 3956 | 3943 | 11644 | 73.5 | GGACGTGCCACGGGACAGTG | 34 | 33 | 30 | 34 | 22 | 0 |
| 8590 | 3957 | 3944 | 11646 | 68.6 | GGACGTGCACGGTGATTGTC | 34 | 33 | 35 | 2 | 9 | 0 |
| 8591 | 3958 | 3945 | 16610 | 67.9 | GGACGGACTCGTCTGTCACG | 34 | 34 | 10 | 14 | 30 | 0 |
| 8592 | 3959 | 3946 | 30885 | 68 | GGACGGACCGTTTTAGGACC | 34 | 34 | 12 | 3 | 32 | 0 |
| 8593 | 3960 | 3947 | 16612 | 66.9 | GGACCTGTTACATCCCCACG | 34 | 14 | 7 | 28 | 30 | 0 |
| 8594 | 3961 | 3948 | 30886 | 72.1 | GGACGGACCGAAGATGCAGC | 34 | 34 | 16 | 27 | 31 | 0 |
| 8595 | 3962 | 3949 | 41101 | 68.3 | GGACGGACGAGTTACATGCG | 34 | 34 | 20 | 7 | 29 | 0 |
| 8596 | 3963 | 3950 | 30887 | 68.7 | GGACACCTGCAACTTGGCAA | 34 | 23 | 21 | 11 | 21 | 0 |
| 8597 | 3964 | 3951 | 41103 | 67.3 | GGACGGACGATGTTAGACGG | 34 | 34 | 27 | 3 | 35 | 0 |
| 8598 | 3965 | 3952 | 11662 | 71.7 | GGACGGACTCCCAGTGACGG | 34 | 34 | 28 | 22 | 35 | 0 |
| 8599 | 3966 | 3953 | 22239 | 69.7 | GGACGGACTGCGAGGATCTG | 34 | 34 | 29 | 25 | 8 | 0 |
| 8600 | 3967 | 3954 | 11664 | 73.7 | GGACGGACCAGCCCATGCTT | 34 | 34 | 31 | 15 | 17 | 0 |
| 8601 | 3968 | 3955 | 11667 | 71 | ACGGTTAGGACCTGCGAGCC | 35 | 3 | 32 | 29 | 36 | 0 |
| 8602 | 3969 | 3956 | 16616 | 70.2 | ACGGTCTGAGCCTCGTGTGC | 35 | 8 | 36 | 10 | 33 | 0 |
| 8603 | 3970 | 3957 | 11670 | 71 | GGACACGGCGTTAATCTGCG | 34 | 35 | 12 | 4 | 29 | 0 |
| 8604 | 3971 | 3958 | 11672 | 66.6 | ACGGCTGTTACAGCTTTCCC | 35 | 14 | 7 | 17 | 28 | 0 |
| 8605 | 3972 | 3959 | 22240 | 69.2 | ACGGGAGTCGAAGGACATCG | 35 | 20 | 16 | 34 | 24 | 0 |
| 8606 | 3973 | 3960 | 11674 | 68.9 | ACGGAGTGCGTTCCTAAGCC | 35 | 22 | 12 | 26 | 36 | 0 |
| 8607 | 3974 | 3961 | 11681 | 68.8 | AGCCCGTTCTTGAATCCAGC | 36 | 12 | 11 | 4 | 31 | 0 |
| 8608 | 3975 | 3962 | 30889 | 68.1 | AGCCCTGTAAAGAGCCGACC | 36 | 14 | 6 | 36 | 32 | 0 |
| 8609 | 3976 | 3963 | 11688 | 73.7 | GGACAGCCTGCGGCAACTCA | 34 | 36 | 29 | 21 | 13 | 0 |
| 8610 | 3977 | 3964 | 16618 | 74.8 | AGCCCACGCACGTGATGCAA | 36 | 30 | 30 | 2 | 21 | 0 |
| 8611 | 3978 | 3965 | 11690 | 72.6 | AGCCGACCCGTTCTGTCACG | 36 | 32 | 12 | 14 | 30 | 0 |
| 8612 | 3979 | 3966 | 11692 | 70.9 | AGCCGGACCCTACTCAACGG | 36 | 34 | 26 | 13 | 35 | 0 |
| 8613 | 3980 | 3968 | 30890 | 68.6 | ACGGTTGACCATTGATTGCG | 35 | 1 | 15 | 2 | 29 | 1 |
| 8614 | 3981 | 3969 | 11704 | 71 | ACGGTTGACAGCCACGATCG | 35 | 1 | 31 | 30 | 24 | 1 |
| 8615 | 3982 | 3970 | 11705 | 70.9 | TTGAGACCGGACGATGACGG | 1 | 32 | 34 | 27 | 35 | 0 |
| 8616 | 3983 | 3971 | 41106 | 69.3 | ACGGTTGAGTGCTGCGTTGA | 35 | 1 | 33 | 29 | 1 | 1 |
| 8617 | 3984 | 3972 | 41107 | 69.3 | TGATCGAAGCAAATCGCAGC | 2 | 16 | 21 | 24 | 31 | 0 |

FIG. 29FFFF

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 8618 | 3985 | 3973 | 16624 | 69.1 | ACGGTGATGCAAACCTTCCC | 35 | 2 | 21 | 23 28 | 1 |
| 8619 | 3986 | 3974 | 16625 | 72.3 | ACGGTGATGGACTCCCTGCG | 35 | 2 | 34 | 28 29 | 0 |
| 8620 | 3987 | 3975 | 30891 | 67.9 | ACGGTTAGGCAACACGGATG | 35 | 3 | 21 | 30 27 | 0 |
| 8621 | 3988 | 3976 | 11723 | 65.3 | ACGGTTAGTCCCAAAGGGAC | 35 | 3 | 28 | 6 34 | 0 |
| 8622 | 3989 | 3977 | 41110 | 69 | ACGGTTAGCACGCAGCTTGA | 35 | 3 | 30 | 31 1 | 0 |
| 8623 | 3990 | 3978 | 22253 | 68.5 | ACGGAATCCCATTCGTAGCC | 35 | 4 | 15 | 10 36 | 0 |
| 8624 | 3991 | 3979 | 16633 | 68.3 | ACGGAATCCGAAACCTGGAC | 35 | 4 | 16 | 23 34 | 0 |
| 8625 | 3992 | 3980 | 30892 | 71.7 | ACGGAATCATCGAGCCCAGC | 35 | 4 | 24 | 36 31 | 0 |
| 8626 | 3993 | 3981 | 41116 | 69.4 | AATCCCTACACGAGCCACGG | 4 | 26 | 30 | 36 35 | 0 |
| 8627 | 3994 | 3982 | 11742 | 66.4 | ACGGAATCGATGTCTGGACC | 35 | 4 | 27 | 8 32 | 0 |
| 8628 | 3995 | 3983 | 11743 | 69.1 | ACGGAATCTCCCGGTAGCAA | 35 | 4 | 28 | 18 21 | 0 |
| 8629 | 3996 | 3984 | 41117 | 66.9 | ACGGAATCGGACTGATACGG | 35 | 4 | 34 | 2 35 | 0 |
| 8630 | 3997 | 3985 | 30893 | 67.6 | ACGGATACCGAACGTTCGAA | 35 | 5 | 16 | 12 16 | 0 |
| 8631 | 3998 | 3986 | 41119 | 69.1 | ACGGATACGCTTGACCCGTT | 35 | 5 | 17 | 32 12 | 0 |
| 8632 | 3999 | 3987 | 16644 | 66.1 | ATACGGACTTGACACGCGAA | 5 | 34 | 1 | 30 16 | 0 |
| 8633 | 4000 | 3988 | 41122 | 67.6 | ACGGAAAGCTCAGCAACAGC | 35 | 6 | 13 | 21 31 | 0 |
| 8634 | 4001 | 3989 | 16647 | 65.4 | ACGGAAAGCTGTATCGCTTG | 35 | 6 | 14 | 24 11 | 0 |
| 8635 | 4002 | 3990 | 30894 | 66.9 | ACGGAAAGCGAATTAGACGG | 35 | 6 | 16 | 3 35 | 0 |
| 8636 | 4003 | 3991 | 16650 | 65.3 | ACGGAAAGGAGTATCGTCCC | 35 | 6 | 20 | 24 28 | 0 |
| 8637 | 4004 | 3992 | 30895 | 68.4 | AAAGAGGACACGTCCCCAGC | 6 | 25 | 30 | 28 31 | 0 |
| 8638 | 4005 | 3993 | 11771 | 70.7 | ACGGAAAGCAGCTCGTGTGC | 35 | 6 | 31 | 10 33 | 0 |
| 8639 | 4006 | 3994 | 16653 | 73.2 | ACGGAAAGGTGCGACCCCAT | 35 | 6 | 33 | 32 15 | 0 |
| 8640 | 4007 | 3995 | 41125 | 69.5 | ACGGAAAGAGCCGGTAGCAA | 35 | 6 | 36 | 18 21 | 0 |
| 8641 | 4008 | 3996 | 11777 | 67.1 | TACAGCTTGATGGCTTTGCG | 7 | 17 | 27 | 17 29 | 0 |
| 8642 | 4009 | 3997 | 30896 | 67.1 | ACGGTACATGCGTCCCTGAT | 35 | 7 | 29 | 28 2 | 0 |
| 8643 | 4010 | 3998 | 11786 | 73.1 | TCTGAAAGCACGCACGCGAA | 8 | 6 | 30 | 30 16 | 0 |
| 8644 | 4011 | 3999 | 16655 | 68.5 | ACGGTCTGCGTTGACCAGTG | 35 | 8 | 12 | 32 22 | 0 |
| 8645 | 4012 | 4000 | 11789 | 67.9 | ACGGTCTGCTCACGTTCAGC | 35 | 8 | 13 | 12 31 | 0 |
| 8646 | 4013 | 4001 | 11790 | 68 | ACGGTCTGCTGTCGAAATCG | 35 | 8 | 14 | 16 24 | 0 |
| 8647 | 4014 | 4002 | 16656 | 74.1 | ACGGTCTGCCATGTGCCACG | 35 | 8 | 15 | 33 30 | 0 |
| 8648 | 4015 | 4003 | 41126 | 66.4 | TCTGGGTATTGAATCGTGCG | 8 | 18 | 1 | 24 29 | 0 |
| 8649 | 4016 | 4004 | 16657 | 68 | TCTGAGGAACCTAGCCGCAA | 8 | 25 | 23 | 36 21 | 0 |
| 8650 | 4017 | 4005 | 11800 | 71.2 | ACGGTCTGGGACCCATACGG | 35 | 8 | 34 | 15 35 | 0 |
| 8651 | 4018 | 4006 | 30897 | 69.9 | ACGGTGTCCTCAGGACGTGC | 35 | 9 | 13 | 34 33 | 0 |
| 8652 | 4019 | 4007 | 30898 | 65.2 | TGTCCCATATCGAATCGCTT | 9 | 15 | 24 | 4 17 | 0 |
| 8653 | 4020 | 4008 | 11803 | 66.5 | TGTCGGTAAGTGGTCTTGCG | 9 | 18 | 22 | 19 29 | 0 |
| 8654 | 4021 | 4009 | 16662 | 69.5 | ACGGTGTCCACGACCTGACC | 35 | 9 | 30 | 23 32 | 0 |
| 8655 | 4022 | 4010 | 30899 | 69.8 | TCGTTGATTTGAACGGCACG | 10 | 2 | 1 | 35 30 | 0 |
| 8656 | 4023 | 4011 | 30900 | 68.5 | TCGTCGTTTTAGACGGCAGC | 10 | 12 | 3 | 35 31 | 0 |
| 8657 | 4024 | 4012 | 41130 | 67.1 | TCGTCTCATTAGCAGCTGCG | 10 | 13 | 3 | 31 29 | 0 |
| 8658 | 4025 | 4013 | 30901 | 66.9 | ACGGTCGTGCTTAGGACGTT | 35 | 10 | 17 | 25 12 | 0 |
| 8659 | 4026 | 4014 | 16667 | 70.5 | ACGGTCGTACCTTCGTTGCG | 35 | 10 | 23 | 10 29 | 0 |
| 8660 | 4027 | 4015 | 30902 | 68.8 | TCGTGATGAAAGGGACTGCG | 10 | 27 | 6 | 34 29 | 0 |
| 8661 | 4028 | 4016 | 11823 | 73.2 | ACGGTCGTTGCGCTTGTCGT | 35 | 10 | 29 | 11 10 | 0 |
| 8662 | 4029 | 4017 | 11824 | 71.5 | ACGGTCGTGTGCCCATGATG | 35 | 10 | 33 | 15 27 | 0 |
| 8663 | 4030 | 4018 | 41133 | 68.1 | ACGGTCGTACGGATACTGCG | 35 | 10 | 35 | 5 29 | 0 |
| 8664 | 4031 | 4019 | 16668 | 67 | ACGGCTTGTCTGAGGAGTGC | 35 | 11 | 8 | 25 33 | 0 |
| 8665 | 4032 | 4020 | 16669 | 65.2 | ACGGCTTGTCGTGCTTAATC | 35 | 11 | 10 | 17 4 | 0 |

FIG. 29GGGG

| SEQ ID NO: | ZIP ID# | 4,633 ID# | HEX ID# | Tm | ZIPCOD3 (NH2 -> CONH2) | TETRAMER NUMBERS | | | | "UNALLOWED DIMERS" |
|---|---|---|---|---|---|---|---|---|---|---|
| 8666 | 4033 | 4021 | 30903 | 67.8 | ACGGCTTGGGTACTCACACG | 35 | 11 | 18 | 13 | 30 | 0 |
| 8667 | 4034 | 4022 | 30904 | 69.6 | ACGGCTTGGAGTCGTTCAGC | 35 | 11 | 20 | 12 | 31 | 0 |
| 8668 | 4035 | 4023 | 30905 | 66.9 | ACGGCTTGAGTGTCCCTCTG | 35 | 11 | 22 | 28 | 8 | 1 |
| 8669 | 4036 | 4024 | 41138 | 70.9 | ACGGCTTGACCTGACCCCAT | 35 | 11 | 23 | 32 | 15 | 0 |
| 8670 | 4037 | 4025 | 30906 | 69.9 | ACGGCTTGAGGAGGACTCCC | 35 | 11 | 25 | 34 | 28 | 0 |
| 8671 | 4038 | 4026 | 11842 | 72.6 | ACGGCTTGCAGCCAGCTGAT | 35 | 11 | 31 | 31 | 2 | 0 |
| 8672 | 4039 | 4027 | 11844 | 71.9 | ACGGCTTGGTGCCCATTGAT | 35 | 11 | 33 | 15 | 2 | 0 |
| 8673 | 4040 | 4028 | 11845 | 73.3 | ACGGCTTGGGACCACGACCT | 35 | 11 | 34 | 30 | 23 | 0 |
| 8674 | 4041 | 4029 | 16671 | 69.1 | ACGGCTTGACGGATACCGTT | 35 | 11 | 35 | 5 | 12 | 0 |
| 8675 | 4042 | 4030 | 11847 | 68.6 | ACGGCGTTTGATGATGATCG | 35 | 12 | 2 | 27 | 24 | 0 |
| 8676 | 4043 | 4031 | 11849 | 66.7 | ACGGCGTTTACAGACCCTGT | 35 | 12 | 7 | 32 | 14 | 0 |
| 8677 | 4044 | 4032 | 11850 | 69.6 | ACGGCGTTTCTGGTCTCAGC | 35 | 12 | 8 | 19 | 31 | 0 |
| 8678 | 4045 | 4033 | 11851 | 67.7 | ACGGCGTTTGTCTTGAAGGA | 35 | 12 | 9 | 1 | 25 | 0 |
| 8679 | 4046 | 4034 | 41141 | 65.1 | ACGGCGTTCTCATTGAAAAG | 35 | 12 | 13 | 1 | 6 | 0 |
| 8680 | 4047 | 4035 | 41142 | 64.9 | ACGGCGTTCTGTACCTCTTG | 35 | 12 | 14 | 23 | 11 | 0 |
| 8681 | 4048 | 4036 | 11856 | 70.5 | ACGGCGTTGCTTGCTTAGGA | 35 | 12 | 17 | 17 | 25 | 0 |
| 8682 | 4049 | 4037 | 11857 | 67.7 | ACGGCGTTGGTATCGTAGGA | 35 | 12 | 18 | 10 | 25 | 0 |
| 8683 | 4050 | 4038 | 41143 | 67.4 | ACGGCGTTACCTAGTGACGG | 35 | 12 | 23 | 22 | 35 | 0 |
| 8684 | 4051 | 4039 | 30907 | 68.4 | ACGGCGTTAGGAATCGGTCT | 35 | 12 | 25 | 24 | 19 | 0 |
| 8685 | 4052 | 4040 | 11861 | 69.8 | ACGGCGTTCCTAAATCGTGC | 35 | 12 | 26 | 4 | 33 | 0 |
| 8686 | 4053 | 4041 | 11862 | 71.4 | ACGGCGTTTGCGTTGAGATG | 35 | 12 | 29 | 1 | 27 | 0 |
| 8687 | 4054 | 4042 | 11863 | 72.2 | ACGGCGTTCACGGTCTTCGT | 35 | 12 | 30 | 19 | 10 | 0 |
| 8688 | 4055 | 4043 | 11864 | 73.3 | ACGGCGTTCAGCTGCGTGAT | 35 | 12 | 31 | 29 | 2 | 0 |
| 8689 | 4056 | 4044 | 11865 | 72.2 | ACGGCGTTGGACACCTGCTT | 35 | 12 | 34 | 23 | 17 | 0 |
| 8690 | 4057 | 4045 | 41145 | 68.3 | ACGGCGTTACGGTACAATCG | 35 | 12 | 35 | 7 | 24 | 0 |
| 8691 | 4058 | 4046 | 41146 | 70.9 | ACGGCTCATGATCACGACGG | 35 | 13 | 2 | 30 | 35 | 0 |
| 8692 | 4059 | 4047 | 11867 | 67.1 | ACGGCTCATTAGGCAACGTT | 35 | 13 | 3 | 21 | 12 | 0 |
| 8693 | 4060 | 4048 | 30908 | 73.4 | ACGGCTCAAAAGGTGCGCAA | 35 | 13 | 6 | 33 | 21 | 0 |
| 8694 | 4061 | 4049 | 16677 | 65.5 | ACGGCTCATCGTATCGAGTG | 35 | 13 | 10 | 24 | 22 | 0 |
| 8695 | 4062 | 4050 | 11874 | 67.2 | ACGGCTCACGTTCTGTCCAT | 35 | 13 | 12 | 14 | 15 | 0 |
| 8696 | 4063 | 4051 | 30909 | 74 | ACGGCTCAGCTTGCAATGCG | 35 | 13 | 17 | 21 | 29 | 0 |
| 8697 | 4064 | 4052 | 11878 | 64 | ACGGCTCAGGTAATACGGAC | 35 | 13 | 18 | 5 | 34 | 0 |
| 8698 | 4065 | 4053 | 11881 | 66.8 | ACGGCTCAGCAAAGGACTGT | 35 | 13 | 21 | 25 | 14 | 0 |
| 8699 | 4066 | 4054 | 41151 | 65.8 | ACGGCTCACCTACCTAAGCC | 35 | 13 | 26 | 26 | 36 | 0 |
| 8700 | 4067 | 4055 | 11886 | 71.1 | ACGGCTCATGCGGATGAGTG | 35 | 13 | 29 | 27 | 22 | 0 |
| 8701 | 4068 | 4056 | 11888 | 71.7 | ACGGCTCAGACCCTTGGTGC | 35 | 13 | 32 | 11 | 33 | 0 |
| 8702 | 4069 | 4058 | 11890 | 63.6 | ACGGCTGTAATCTCTGTCCC | 35 | 14 | 4 | 8 | 28 | 0 |
| 8703 | 4070 | 4059 | 41153 | 71.5 | ACGGCTGTTCTGGGACGACC | 35 | 14 | 8 | 34 | 32 | 0 |
| 8704 | 4071 | 4060 | 30911 | 69.3 | ACGGCTGTCGAAAGTGGACC | 35 | 14 | 16 | 22 | 32 | 0 |
| 8705 | 4072 | 4061 | 11896 | 69.5 | ACGGCTGTGCTTCTGTGCAA | 35 | 14 | 17 | 14 | 21 | 0 |
| 8706 | 4073 | 4063 | 30912 | 69.9 | ACGGCTGTGTCTTGCGGAGT | 35 | 14 | 19 | 29 | 20 | 0 |
| 8707 | 4074 | 4064 | 41155 | 64.6 | ACGGCTGTGAGTAGTGAGCC | 35 | 14 | 20 | 22 | 36 | 0 |
| 8708 | 4075 | 4065 | 30913 | 67.1 | ACGGCTGTACCTTGTCAGCC | 35 | 14 | 23 | 9 | 36 | 0 |
| 8709 | 4076 | 4066 | 30914 | 67.4 | ACGGCTGTACGGTGATTCGT | 35 | 14 | 35 | 2 | 10 | 0 |
| 8710 | 4077 | 4067 | 11907 | 70.2 | ACGGCCATTGTCCGTTTCTG | 35 | 15 | 9 | 12 | 8 | 0 |
| 8711 | 4078 | 4068 | 11908 | 72.9 | ACGGCCATTCGTGTGCCCTA | 35 | 15 | 10 | 33 | 26 | 0 |
| 8712 | 4079 | 4069 | 30916 | 67 | ACGGCCATCTCAACCTCTTG | 35 | 15 | 13 | 23 | 11 | 0 |
| 8713 | 4080 | 4070 | 30917 | 69.6 | ACGGCCATAGTGCCATAGCC | 35 | 15 | 22 | 15 | 36 | 0 |

FIG. 29HHHH

| SEQ ID NO: | ZIP ID# | 4,633 ID# | HEX ID# | Tm | ZIPCODE (NH2 -> CONH2) | T3TRAMER NUMBERS | | | | "UNALLOWED DIMERS" |
|---|---|---|---|---|---|---|---|---|---|---|
| 8714 | 4081 | 4071 | 41157 | 66.5 | ACGGCCATCCTAGCTTTGTC | 35 | 15 | 26 | 17 9 | 0 |
| 8715 | 4082 | 4072 | 11917 | 73 | ACGGCCATTCCCCCATCTGT | 35 | 15 | 28 | 15 14 | 0 |
| 8716 | 4083 | 4073 | 11918 | 75.4 | ACGGCCATTGCGCGTTGAGT | 35 | 15 | 29 | 12 20 | 0 |
| 8717 | 4084 | 4074 | 11919 | 71.5 | ACGGCCATGACCCTGTCCAT | 35 | 15 | 32 | 14 15 | 0 |
| 8718 | 4085 | 4075 | 41158 | 68.4 | ACGGCCATAGCCCCTAAAAG | 35 | 15 | 36 | 26 6 | 0 |
| 8719 | 4086 | 4076 | 41159 | 68.1 | ACGGCGAATTGAAGTGATCG | 35 | 16 | 1 | 22 24 | 0 |
| 8720 | 4087 | 4077 | 30918 | 67.2 | ACGGCGAATGATAGGACAGC | 35 | 16 | 2 | 25 31 | 0 |
| 8721 | 4088 | 4078 | 41160 | 67.6 | ACGGCGAATTAGGATGCTTG | 35 | 16 | 3 | 27 11 | 0 |
| 8722 | 4089 | 4079 | 11922 | 65.3 | ACGGCGAAAATCTACAATCG | 35 | 16 | 4 | 7 24 | 0 |
| 8723 | 4090 | 4080 | 11924 | 67.5 | ACGGCGAATCTGTCTGGGTA | 35 | 16 | 8 | 8 18 | 0 |
| 8724 | 4091 | 4081 | 41161 | 69.9 | ACGGCGAATCGTTGATCGTT | 35 | 16 | 10 | 2 12 | 0 |
| 8725 | 4092 | 4082 | 11926 | 70.3 | ACGGCGAACTTGGAGTGTGC | 35 | 16 | 11 | 20 33 | 0 |
| 8726 | 4093 | 4083 | 11927 | 70 | ACGGCGAACGTTTCGTCTGT | 35 | 16 | 12 | 10 14 | 0 |
| 8727 | 4094 | 4084 | 11928 | 67.2 | ACGGCGAACTCATTGACCAT | 35 | 16 | 13 | 1 15 | 0 |
| 8728 | 4095 | 4085 | 11931 | 64.8 | ACGGCGAAGGTATCTGAGTG | 35 | 16 | 18 | 8 22 | 0 |
| 8729 | 4096 | 4086 | 41162 | 67.7 | ACGGCGAAGAGTGATGGATG | 35 | 16 | 20 | 27 27 | 0 |
| 8730 | 4097 | 4087 | 41163 | 69.4 | ACGGCGAAATCGAGGATGTC | 35 | 16 | 24 | 25 9 | 0 |
| 8731 | 4098 | 4088 | 11935 | 73.5 | ACGGCGAATCCCACCTGCTT | 35 | 16 | 28 | 23 17 | 0 |
| 8732 | 4099 | 4089 | 11937 | 72.3 | ACGGCGAACACGCTTGGAGT | 35 | 16 | 30 | 11 20 | 0 |
| 8733 | 4100 | 4090 | 30919 | 75.3 | ACGGCGAAGTGCACGGTCGT | 35 | 16 | 33 | 35 10 | 0 |
| 8734 | 4101 | 4091 | 11939 | 72.6 | ACGGCGAAGGACCTCACACG | 35 | 16 | 34 | 13 30 | 0 |
| 8735 | 4102 | 4092 | 11940 | 74.5 | ACGGCGAAAGCCAATCCGAA | 35 | 16 | 36 | 4 16 | 0 |
| 8736 | 4103 | 4093 | 30920 | 66.7 | ACGGGCTTTTGACCTAATCG | 35 | 17 | 1 | 26 24 | 0 |
| 8737 | 4104 | 4094 | 16691 | 68.3 | ACGGGCTTTGATTACATGCG | 35 | 17 | 2 | 7 29 | 0 |
| 8738 | 4105 | 4095 | 30921 | 70.8 | ACGGGCTTTTAGGTGCCGTT | 35 | 17 | 3 | 33 12 | 0 |
| 8739 | 4106 | 4096 | 30922 | 67.5 | ACGGGCTTAAAGCCTATCCC | 35 | 17 | 6 | 26 28 | 0 |
| 8740 | 4107 | 4097 | 16692 | 67.3 | ACGGGCTTTACATCGTCAGC | 35 | 17 | 7 | 10 31 | 0 |
| 8741 | 4108 | 4098 | 30923 | 69.2 | ACGGGCTTCGTTCTCACGTT | 35 | 17 | 12 | 13 12 | 0 |
| 8742 | 4109 | 4099 | 30924 | 66.8 | ACGGGCTTCTCATCGTCCTA | 35 | 17 | 13 | 10 26 | 0 |
| 8743 | 4110 | 4100 | 41164 | 65.5 | ACGGGCTTCTGTAGGAGCTT | 35 | 17 | 14 | 25 17 | 0 |
| 8744 | 4111 | 4101 | 11949 | 66.4 | ACGGGCTTGGTAAAAGCTGT | 35 | 17 | 18 | 6 14 | 0 |
| 8745 | 4112 | 4102 | 30926 | 67.1 | ACGGGCTTGAGTGGTAGTGC | 35 | 17 | 20 | 18 33 | 0 |
| 8746 | 4113 | 4103 | 11957 | 74.8 | ACGGGCTTTCCCGCTTCCAT | 35 | 17 | 28 | 17 15 | 0 |
| 8747 | 4114 | 4104 | 11958 | 64.2 | ACGGGCTTGACCTTGATTAG | 35 | 17 | 32 | 1 3 | 0 |
| 8748 | 4115 | 4105 | 11960 | 67.3 | ACGGGGTATGATCACGGATG | 35 | 18 | 2 | 30 27 | 0 |
| 8749 | 4116 | 4106 | 16703 | 69.5 | ACGGGGTATACAAGCCGTGC | 35 | 18 | 7 | 36 33 | 0 |
| 8750 | 4117 | 4107 | 16704 | 66.6 | ACGGGGTATCTGACGGAGTG | 35 | 18 | 8 | 35 22 | 0 |
| 8751 | 4118 | 4108 | 22300 | 66.8 | ACGGGGTACGTTCACGAATC | 35 | 18 | 12 | 30 4 | 0 |
| 8752 | 4119 | 4109 | 30927 | 65.7 | ACGGGGTACTGTGAGTTCCC | 35 | 18 | 14 | 20 28 | 0 |
| 8753 | 4120 | 4110 | 30928 | 66.5 | ACGGGGTAGCTTGGTACAGC | 35 | 18 | 17 | 18 31 | 0 |
| 8754 | 4121 | 4111 | 30929 | 69.2 | ACGGGGTAGCAAAATCCGAA | 35 | 18 | 21 | 4 16 | 0 |
| 8755 | 4122 | 4112 | 11972 | 66.1 | ACGGGGTAAGGAGTCTCACG | 35 | 18 | 25 | 19 30 | 0 |
| 8756 | 4123 | 4113 | 16710 | 67.1 | ACGGGGTACCTATCCCTCGT | 35 | 18 | 26 | 28 10 | 0 |
| 8757 | 4124 | 4114 | 11975 | 72.3 | ACGGGGTATGCGCGTTAGGA | 35 | 18 | 29 | 12 25 | 0 |
| 8758 | 4125 | 4115 | 11976 | 64.2 | ACGGGGTAGTGCATACGAGT | 35 | 18 | 33 | 5 20 | 0 |
| 8759 | 4126 | 4116 | 30930 | 66.3 | ACGGGGTAGGACTCTGCTTG | 35 | 18 | 34 | 8 11 | 0 |
| 8760 | 4127 | 4117 | 16711 | 68 | ACGGGGTAACGGCCTAAATC | 35 | 18 | 35 | 26 4 | 0 |
| 8761 | 4128 | 4118 | 16712 | 70.4 | ACGGGGTAAGCCCGAACTGT | 35 | 18 | 36 | 16 14 | 0 |

FIG. 29IIII

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8762 | 4129 | 4119 | 11982 | 68 | ACGGGTCTAAAGCGAATCCC | 35 | 19 | 6 | 16 | 28 | 0 |
| 8763 | 4130 | 4120 | 41170 | 67.8 | ACGGGTCTCGTTGCAAGATG | 35 | 19 | 12 | 21 | 27 | 0 |
| 8764 | 4131 | 4121 | 11987 | 68 | ACGGGTCTCTCAAGCCACCT | 35 | 19 | 13 | 36 | 23 | 0 |
| 8765 | 4132 | 4122 | 11990 | 68 | ACGGGTCTCGAAGGACGTCT | 35 | 19 | 16 | 34 | 19 | 0 |
| 8766 | 4133 | 4123 | 30931 | 70.5 | ACGGGTCTATCGACGGGCTT | 35 | 19 | 24 | 35 | 17 | 0 |
| 8767 | 4134 | 4124 | 11997 | 70.3 | ACGGGTCTGACCCTTGGGAC | 35 | 19 | 32 | 11 | 34 | 0 |
| 8768 | 4135 | 4125 | 11998 | 67.7 | ACGGGTCTGTGCAAAGGATG | 35 | 19 | 33 | 6 | 27 | 0 |
| 8769 | 4136 | 4126 | 11999 | 70.2 | ACGGGTCTACGGGACCTCGT | 35 | 19 | 35 | 32 | 10 | 0 |
| 8770 | 4137 | 4127 | 12000 | 65.7 | ACGGGAGTTGATCTGTTCCC | 35 | 20 | 2 | 14 | 28 | 0 |
| 8771 | 4138 | 4128 | 16717 | 69 | ACGGGAGTCTTGCAGCACCT | 35 | 20 | 11 | 31 | 23 | 0 |
| 8772 | 4139 | 4129 | 12004 | 66.4 | ACGGGAGTCTCAAGCCAAAG | 35 | 20 | 13 | 36 | 6 | 0 |
| 8773 | 4140 | 4130 | 30932 | 66.7 | ACGGGAGTGGTAAGTGGTGC | 35 | 20 | 18 | 22 | 33 | 0 |
| 8774 | 4141 | 4131 | 12011 | 67.5 | ACGGGAGTGATGGTGCTCTG | 35 | 20 | 27 | 33 | 8 | 0 |
| 8775 | 4142 | 4132 | 12012 | 71.4 | ACGGGAGTTCCCCTGTCACG | 35 | 20 | 28 | 14 | 30 | 0 |
| 8776 | 4143 | 4133 | 30933 | 66.5 | ACGGGAGTCAGCTGATGACC | 35 | 20 | 31 | 2 | 32 | 0 |
| 8777 | 4144 | 4134 | 30934 | 69.8 | ACGGGCAAAATCAGTGCCAT | 35 | 21 | 4 | 22 | 15 | 0 |
| 8778 | 4145 | 4135 | 30935 | 65.5 | ACGGGCAAATACAGTGATCG | 35 | 21 | 5 | 22 | 24 | 0 |
| 8779 | 4146 | 4136 | 41174 | 67.2 | ACGGGCAATACACTTGAGCC | 35 | 21 | 7 | 11 | 36 | 0 |
| 8780 | 4147 | 4137 | 30936 | 67.5 | ACGGGCAACGTTTTAGCCTA | 35 | 21 | 12 | 3 | 26 | 0 |
| 8781 | 4148 | 4138 | 12024 | 72.2 | ACGGGCAAGCTTCGAACAGC | 35 | 21 | 17 | 16 | 31 | 0 |
| 8782 | 4149 | 4139 | 12026 | 66 | ACGGGCAAGAGTCTCAGACC | 35 | 21 | 20 | 13 | 32 | 0 |
| 8783 | 4150 | 4140 | 30937 | 74.6 | ACGGGCAAGCAAATCGCGTT | 35 | 21 | 21 | 24 | 12 | 0 |
| 8784 | 4151 | 4141 | 16725 | 70.1 | ACGGGCAACCTACACGCCTA | 35 | 21 | 26 | 30 | 26 | 0 |
| 8785 | 4152 | 4142 | 12033 | 74.2 | ACGGGCAAACGGCCATGTCT | 35 | 21 | 35 | 15 | 19 | 0 |
| 8786 | 4153 | 4143 | 12034 | 71.8 | ACGGGCAAAGCCTCTGCCTA | 35 | 21 | 36 | 8 | 26 | 0 |
| 8787 | 4154 | 4144 | 30938 | 67.4 | ACGGAGTGCGAATTGATCGT | 35 | 22 | 16 | 1 | 10 | 0 |
| 8788 | 4155 | 4146 | 22312 | 66.9 | ACGGAGTGGGTACGAAGTGC | 35 | 22 | 18 | 16 | 33 | 0 |
| 8789 | 4156 | 4147 | 12044 | 65.8 | AGTGGAGTTGTCTCCCCAGC | 22 | 20 | 9 | 28 | 31 | 0 |
| 8790 | 4157 | 4148 | 41178 | 70.4 | ACGGAGTGGCAACAGCCTTG | 35 | 22 | 21 | 31 | 11 | 0 |
| 8791 | 4158 | 4149 | 22313 | 65.3 | ACGGAGTGATCGTCGTCTCA | 35 | 22 | 24 | 10 | 13 | 0 |
| 8792 | 4159 | 4150 | 12047 | 64.7 | ACGGAGTGCCTACGTTTGTC | 35 | 22 | 26 | 12 | 9 | 0 |
| 8793 | 4160 | 4151 | 12048 | 72.5 | ACGGAGTGTGCGTCGTGCAA | 35 | 22 | 29 | 10 | 21 | 0 |
| 8794 | 4161 | 4152 | 16729 | 73.1 | ACGGAGTGGGACGCTTGCAA | 35 | 22 | 34 | 17 | 21 | 0 |
| 8795 | 4162 | 4153 | 12055 | 67.2 | ACCTTGATGATGTCCCACGG | 23 | 2 | 27 | 28 | 35 | 0 |
| 8796 | 4163 | 4154 | 12058 | 68.9 | ACGGACCTTGTCCGTTGACC | 35 | 23 | 9 | 12 | 32 | 0 |
| 8797 | 4164 | 4155 | 12059 | 70.1 | ACGGACCTCTTGCACGCCTA | 35 | 23 | 11 | 30 | 26 | 0 |
| 8798 | 4165 | 4156 | 30939 | 66.3 | ACGGACCTGCTTAAAGCCAT | 35 | 23 | 17 | 6 | 15 | 0 |
| 8799 | 4166 | 4157 | 12063 | 68.2 | ACGGACCTGTCTGACCCCAT | 35 | 23 | 19 | 32 | 15 | 0 |
| 8800 | 4167 | 4158 | 12066 | 68.9 | ACGGACCTTCCCGAGTTTGA | 35 | 23 | 28 | 20 | 1 | 1 |
| 8801 | 4168 | 4159 | 30940 | 69.1 | ACGGACCTGACCAAAGACGG | 35 | 23 | 32 | 6 | 35 | 0 |
| 8802 | 4169 | 4160 | 16731 | 69.1 | ACGGACCTAGCCGCTTTCTG | 35 | 23 | 36 | 17 | 8 | 0 |
| 8803 | 4170 | 4161 | 41185 | 66.3 | ACGGATCGAAAGTCCCAAAG | 35 | 24 | 6 | 28 | 6 | 1 |
| 8804 | 4171 | 4163 | 12074 | 70.8 | ACGGATCGTGTCCGAACACG | 35 | 24 | 9 | 16 | 30 | 0 |
| 8805 | 4172 | 4164 | 30942 | 71.5 | ACGGATCGCTCACGAATCCC | 35 | 24 | 13 | 16 | 28 | 0 |
| 8806 | 4173 | 4165 | 12079 | 66.8 | ATCGCTGTCTGTGATGCGAA | 24 | 14 | 14 | 27 | 16 | 0 |
| 8807 | 4174 | 4166 | 41188 | 69.8 | ACGGATCGGAGTCGAACGAA | 35 | 24 | 20 | 16 | 16 | 0 |
| 8808 | 4175 | 4167 | 41189 | 71.5 | ACGGATCGGCAACTTGGACC | 35 | 24 | 21 | 11 | 32 | 0 |
| 8809 | 4176 | 4168 | 12083 | 67.1 | ACGGATCGAGTGTCTGCCAT | 35 | 24 | 22 | 8 | 15 | 0 |

FIG. 29JJJJ

| SEQ ID NO: | ZIP ID# | 4,633 ID# | H3X ID# | Tm | ZIPCODE (NH2 -> CONH2) | TETRAMER NUMBERS | | | | "UNALLOWED DIMERS" |
|---|---|---|---|---|---|---|---|---|---|---|
| 8810 | 4177 | 4169 | 30943 | 69.2 | ACGGATCGACCTCTTGACGG | 35 | 24 | 23 | 11 35 | 0 |
| 8811 | 4178 | 4170 | 30945 | 71.3 | ACGGATCGCAGCTCCCTGAT | 35 | 24 | 31 | 28 2 | 0 |
| 8812 | 4179 | 4171 | 12088 | 68.5 | ACGGATCGGGACGGACTTAG | 35 | 24 | 34 | 34 3 | 0 |
| 8813 | 4180 | 4172 | 12089 | 70.6 | ATCGACGGCTCAGAGTTGCG | 24 | 35 | 13 | 20 29 | 0 |
| 8814 | 4181 | 4173 | 22320 | 70.5 | ACGGATCGAGCCCCTAAGGA | 35 | 24 | 36 | 26 25 | 0 |
| 8815 | 4182 | 4175 | 22321 | 68 | ACGGAGGATCTGGCAAACCT | 35 | 25 | 8 | 21 23 | 0 |
| 8816 | 4183 | 4176 | 12098 | 64.3 | ACGGAGGACCATAATCGATG | 35 | 25 | 15 | 4 27 | 0 |
| 8817 | 4184 | 4177 | 30946 | 71.5 | ACGGAGGAGCTTGTGCCGTT | 35 | 25 | 17 | 33 12 | 0 |
| 8818 | 4185 | 4178 | 41192 | 68.1 | AGGAGGTATCGTGTGCTGCG | 25 | 18 | 10 | 33 29 | 0 |
| 8819 | 4186 | 4179 | 22323 | 69.7 | AGGAGTCTAGCCCACGTGCG | 25 | 19 | 36 | 30 29 | 0 |
| 8820 | 4187 | 4180 | 16734 | 68.8 | ACGGAGGAGCAAAGCCAATC | 35 | 25 | 21 | 36 4 | 0 |
| 8821 | 4188 | 4181 | 12106 | 70.6 | ACGGAGGATGCGCCTAACCT | 35 | 25 | 29 | 26 23 | 0 |
| 8822 | 4189 | 4182 | 12110 | 66.3 | ACGGCCTATCTGGAGTCAGC | 35 | 26 | 8 | 20 31 | 0 |
| 8823 | 4190 | 4183 | 41199 | 70.1 | ACGGCCTACTGTGGACACGG | 35 | 26 | 14 | 34 35 | 0 |
| 8824 | 4191 | 4184 | 30948 | 66.2 | ACGGCCTAGAGTTCGTGGAC | 35 | 26 | 20 | 10 34 | 0 |
| 8825 | 4192 | 4185 | 30950 | 65.4 | ACGGCCTACCTATCCCTGTC | 35 | 26 | 26 | 28 9 | 0 |
| 8826 | 4193 | 4186 | 22328 | 66.2 | ACGGGATGAATCCCATAGGA | 35 | 27 | 4 | 15 25 | 0 |
| 8827 | 4194 | 4187 | 12121 | 67.1 | ACGGGATGCCATCGAATTAG | 35 | 27 | 15 | 16 3 | 0 |
| 8828 | 4195 | 4188 | 41207 | 68.6 | ACGGGATGATCGGAGTCGTT | 35 | 27 | 24 | 20 12 | 0 |
| 8829 | 4196 | 4189 | 41208 | 67.4 | ACGGGATGCCTAAGTGCTTG | 35 | 27 | 26 | 22 11 | 0 |
| 8830 | 4197 | 4190 | 12129 | 68.7 | ACGGGATGGGACCACGATAC | 35 | 27 | 34 | 30 5 | 0 |
| 8831 | 4198 | 4191 | 12131 | 77.7 | ACGGGATGAGCCGTGCACGG | 35 | 27 | 36 | 33 35 | 0 |
| 8832 | 4199 | 4192 | 16741 | 70.6 | ACGGTCCCTTGACGTTGCAA | 35 | 28 | 1 | 12 21 | 1 |
| 8833 | 4200 | 4193 | 30952 | 71.3 | ACGGTCCCCTCAAATCACGG | 35 | 28 | 13 | 4 35 | 1 |
| 8834 | 4201 | 4194 | 41214 | 70.2 | ACGGTCCCCATACCTGACC | 35 | 28 | 15 | 23 32 | 1 |
| 8835 | 4202 | 4195 | 30953 | 70.8 | ACGGTCCCAGTGTGTCTGCG | 35 | 28 | 22 | 9 29 | 1 |
| 8836 | 4203 | 4196 | 12142 | 71.1 | ACGGTCCCATCGGCTTGTCT | 35 | 28 | 24 | 17 19 | 1 |
| 8837 | 4204 | 4197 | 12143 | 68.9 | ACGGTCCCCCTATCGTGATG | 35 | 28 | 26 | 10 27 | 1 |
| 8838 | 4205 | 4198 | 12144 | 66.4 | TCCCGATGTGATTTAGCACG | 28 | 27 | 2 | 3 30 | 0 |
| 8839 | 4206 | 4199 | 30954 | 68.9 | TGCGTTGAATACAGCCGACC | 29 | 1 | 5 | 36 32 | 0 |
| 8840 | 4207 | 4200 | 16745 | 65.3 | ACGGTGCGTGATAGGATCTG | 35 | 29 | 2 | 25 8 | 0 |
| 8841 | 4208 | 4201 | 16746 | 71.6 | ACGGTGCGTTAGGGACGACC | 35 | 29 | 3 | 34 32 | 0 |
| 8842 | 4209 | 4202 | 41217 | 67.1 | TGCGATACAATCATCGCGTT | 29 | 5 | 4 | 24 12 | 0 |
| 8843 | 4210 | 4203 | 41218 | 68.5 | ACGGTGCGTACACGTTGGAC | 35 | 29 | 7 | 12 34 | 0 |
| 8844 | 4211 | 4204 | 12150 | 72.6 | ACGGTGCGCTTGCCTAAGGA | 35 | 29 | 11 | 26 25 | 0 |
| 8845 | 4212 | 4205 | 12152 | 70.2 | ACGGTGCGCCATATACGACC | 35 | 29 | 15 | 5 32 | 0 |
| 8846 | 4213 | 4206 | 30955 | 72.5 | TGCGAGTGCTGTCAGCCAGC | 29 | 22 | 14 | 31 31 | 0 |
| 8847 | 4214 | 4207 | 12153 | 69 | TGCGAGGACTCAGATGCAGC | 29 | 25 | 13 | 27 31 | 0 |
| 8848 | 4215 | 4208 | 12154 | 76.7 | ACGGTGCGTGCGCACGAATC | 35 | 29 | 29 | 30 4 | 0 |
| 8849 | 4216 | 4209 | 12155 | 78.3 | ACGGTGCGCACGGTGCCTGT | 35 | 29 | 30 | 33 14 | 0 |
| 8850 | 4217 | 4210 | 30957 | 75.3 | ACGGTGCGCAGCACCTCCAT | 35 | 29 | 31 | 23 15 | 0 |
| 8851 | 4218 | 4211 | 12156 | 75.5 | ACGGTGCGGTGCGAGTGCTT | 35 | 29 | 33 | 20 17 | 0 |
| 8852 | 4219 | 4212 | 12157 | 76.4 | ACGGTGCGGGACCAGCACCT | 35 | 29 | 34 | 31 23 | 0 |
| 8853 | 4220 | 4213 | 12158 | 73.6 | ACGGTGCGAGCCCTTGGAGT | 35 | 29 | 36 | 11 20 | 0 |
| 8854 | 4221 | 4214 | 12159 | 67.2 | ACGGCACGTTGAGGACTGAT | 35 | 30 | 1 | 34 2 | 0 |
| 8855 | 4222 | 4215 | 41220 | 68 | ACGGCACGTGATACGGTGAT | 35 | 30 | 2 | 35 2 | 0 |
| 8856 | 4223 | 4216 | 41221 | 65.6 | ACGGCACGTTAGAGTGATCG | 35 | 30 | 3 | 22 24 | 0 |
| 8857 | 4224 | 4217 | 41222 | 70.4 | ACGGCACGAATCCAGCTCTG | 35 | 30 | 4 | 31 8 | 0 |

FIG. 29KKKK

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 8858 | 4225 | 4218 | 30958 | 69.7 | ACGGCACGTACATGATTGCG | 35 | 30 | 7 | 2 | 29 | 0 |
| 8859 | 4226 | 4219 | 12162 | 71.3 | ACGGCACGTCTGCTCAATCG | 35 | 30 | 8 | 13 | 24 | 0 |
| 8860 | 4227 | 4220 | 12164 | 74.1 | ACGGCACGTCGTGCTTCGAA | 35 | 30 | 10 | 17 | 16 | 0 |
| 8861 | 4228 | 4221 | 30959 | 70.2 | ACGGCACGGAGTCTCACAGC | 35 | 30 | 20 | 13 | 31 | 0 |
| 8862 | 4229 | 4222 | 12168 | 70.3 | ACGGCACGACCTCGAATCTG | 35 | 30 | 23 | 16 | 8 | 0 |
| 8863 | 4230 | 4223 | 16748 | 73.5 | ACGGCACGCAGCTGATGGAC | 35 | 30 | 31 | 2 | 34 | 0 |
| 8864 | 4231 | 4224 | 12172 | 77.1 | ACGGCACGGGACGGACGGTA | 35 | 30 | 34 | 34 | 18 | 0 |
| 8865 | 4232 | 4225 | 12173 | 72.9 | ACGGCACGACGGTCGTGAGT | 35 | 30 | 35 | 10 | 20 | 0 |
| 8866 | 4233 | 4226 | 16749 | 66.6 | ACGGCAGCTTAGAAAGCCAT | 35 | 31 | 3 | 6 | 15 | 0 |
| 8867 | 4234 | 4227 | 16750 | 67.3 | ACGGCAGCTGTCCGAAATAC | 35 | 31 | 9 | 16 | 5 | 0 |
| 8868 | 4235 | 4228 | 12179 | 70.6 | ACGGCAGCCTTGCTCAGATG | 35 | 31 | 11 | 13 | 27 | 0 |
| 8869 | 4236 | 4229 | 22350 | 69.8 | ACGGCAGCCTGTTTAGACGG | 35 | 31 | 14 | 3 | 35 | 0 |
| 8870 | 4237 | 4230 | 12181 | 72.5 | ACGGCAGCCCATAATCCACG | 35 | 31 | 15 | 4 | 30 | 0 |
| 8871 | 4238 | 4231 | 12182 | 72.3 | ACGGCAGCCGAACTGTTCGT | 35 | 31 | 16 | 14 | 10 | 0 |
| 8872 | 4239 | 4232 | 12183 | 70.3 | ACGGCAGCGCTTGAGTGAGT | 35 | 31 | 17 | 20 | 20 | 0 |
| 8873 | 4240 | 4233 | 22351 | 68.4 | ACGGCAGCGGTACACGTTAG | 35 | 31 | 18 | 30 | 3 | 0 |
| 8874 | 4241 | 4234 | 12188 | 69.7 | ACGGCAGCAGGAGTCTACGG | 35 | 31 | 25 | 19 | 35 | 0 |
| 8875 | 4242 | 4235 | 12190 | 75.5 | ACGGCAGCCACGAGGAGCAA | 35 | 31 | 30 | 25 | 21 | 0 |
| 8876 | 4243 | 4236 | 12191 | 75.5 | ACGGCAGCCAGCCTGTCGAA | 35 | 31 | 31 | 14 | 16 | 0 |
| 8877 | 4244 | 4237 | 12193 | 76.1 | ACGGCAGCGTGCCCTATCCC | 35 | 31 | 33 | 26 | 28 | 0 |
| 8878 | 4245 | 4238 | 12194 | 75.6 | ACGGCAGCACGGTCGTGACC | 35 | 31 | 35 | 10 | 32 | 0 |
| 8879 | 4246 | 4239 | 12195 | 66.3 | ACGGGACCTTGATTGACGTT | 35 | 32 | 1 | 1 | 12 | 0 |
| 8880 | 4247 | 4240 | 16752 | 68.7 | ACGGGACCAATCACCTGACC | 35 | 32 | 4 | 23 | 32 | 0 |
| 8881 | 4248 | 4241 | 16753 | 66.9 | ACGGGACCAAAGAATCGATG | 35 | 32 | 6 | 4 | 27 | 0 |
| 8882 | 4249 | 4242 | 12199 | 70.8 | ACGGGACCTACACAGCGCAA | 35 | 32 | 7 | 31 | 21 | 0 |
| 8883 | 4250 | 4243 | 12201 | 71 | ACGGGACCCGTTGTCTTCGT | 35 | 32 | 12 | 19 | 10 | 0 |
| 8884 | 4251 | 4244 | 30960 | 72.3 | ACGGGACCCCTCAGTGCGATG | 35 | 32 | 13 | 33 | 27 | 0 |
| 8885 | 4252 | 4245 | 30961 | 70.9 | ACGGGACCCCATACCTCGAA | 35 | 32 | 15 | 23 | 16 | 0 |
| 8886 | 4253 | 4246 | 12202 | 68.8 | ACGGGACCCGAACTCATGTC | 35 | 32 | 16 | 13 | 9 | 0 |
| 8887 | 4254 | 4247 | 16754 | 68.4 | ACGGGACCGCTTAATCCCTA | 35 | 32 | 17 | 4 | 26 | 0 |
| 8888 | 4255 | 4248 | 12206 | 72.9 | ACGGGACCATCGTCCCACCT | 35 | 32 | 24 | 28 | 23 | 0 |
| 8889 | 4256 | 4249 | 12208 | 74.6 | ACGGGACCGATGGATGCAGC | 35 | 32 | 27 | 27 | 31 | 0 |
| 8890 | 4257 | 4250 | 12209 | 73 | ACGGGACCTCCCATCGGGTA | 35 | 32 | 28 | 24 | 18 | 0 |
| 8891 | 4258 | 4251 | 16755 | 73.4 | ACGGGACCCAGCCGAACCTA | 35 | 32 | 31 | 16 | 26 | 0 |
| 8892 | 4259 | 4252 | 12212 | 71.8 | ACGGGACCGTGCGGACTTAG | 35 | 32 | 33 | 34 | 3 | 0 |
| 8893 | 4260 | 4253 | 41229 | 66.4 | ACGGGTGCTTGAGTCTAGCC | 35 | 33 | 1 | 19 | 36 | 0 |
| 8894 | 4261 | 4254 | 30963 | 67.9 | ACGGGTGCTGATTTGAATCG | 35 | 33 | 2 | 1 | 24 | 0 |
| 8895 | 4262 | 4255 | 30964 | 66.2 | ACGGGTGCTTAGTCTGGCTT | 35 | 33 | 3 | 8 | 17 | 0 |
| 8896 | 4263 | 4256 | 41230 | 70.5 | ACGGGTGCAATCGCTTCTTG | 35 | 33 | 4 | 17 | 11 | 0 |
| 8897 | 4264 | 4257 | 41231 | 67.3 | ACGGGTGCATACACCTGACC | 35 | 33 | 5 | 23 | 32 | 0 |
| 8898 | 4265 | 4258 | 16757 | 70.1 | ACGGGTGCTGTCGGACTCTG | 35 | 33 | 9 | 34 | 8 | 0 |
| 8899 | 4266 | 4259 | 12216 | 67.4 | ACGGGTGCCTCACTGTTGTC | 35 | 33 | 13 | 14 | 9 | 0 |
| 8900 | 4267 | 4260 | 12217 | 73.4 | ACGGGTGCCGAAGACCCCTA | 35 | 33 | 16 | 32 | 26 | 0 |
| 8901 | 4268 | 4261 | 12218 | 73.4 | ACGGGTGCGCTTGCTTTTGA | 35 | 33 | 17 | 17 | 1 | 0 |
| 8902 | 4269 | 4262 | 30965 | 71.8 | ACGGGTGCGTCTCCTAACGG | 35 | 33 | 19 | 26 | 35 | 0 |
| 8903 | 4270 | 4263 | 12220 | 73.1 | ACGGGTGCGCAACAGCTGAT | 35 | 33 | 21 | 31 | 2 | 0 |
| 8904 | 4271 | 4264 | 12221 | 75.3 | ACGGGTGCAGTGGACCACGG | 35 | 33 | 22 | 32 | 35 | 0 |
| 8905 | 4272 | 4265 | 22367 | 71.4 | ACGGGTGCACCTGCAACTCA | 35 | 33 | 23 | 21 | 13 | 0 |

FIG. 29LLLL

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 8906 | 4273 | 4266 | 12223 | 69.5 | ACGGGTGCTGCGAGGAATAC | 35 | 33 | 29 | 25 | 5 | 0 |
| 8907 | 4274 | 4267 | 12224 | 74.9 | ACGGGTGCGACCATCGGGTA | 35 | 33 | 32 | 24 | 18 | 0 |
| 8908 | 4275 | 4268 | 12225 | 77 | ACGGGTGCGGACCACGGGTA | 35 | 33 | 34 | 30 | 18 | 0 |
| 8909 | 4276 | 4269 | 12226 | 64.3 | ACGGGGACTTGAAAAGTTGA | 35 | 34 | 1 | 6 | 1 | 1 |
| 8910 | 4277 | 4270 | 41232 | 72.3 | ACGGGGACTTAGTGCGGCAA | 35 | 34 | 3 | 29 | 21 | 0 |
| 8911 | 4278 | 4271 | 30966 | 70.4 | ACGGGGACTACAACGGGGAC | 35 | 34 | 7 | 35 | 34 | 0 |
| 8912 | 4279 | 4272 | 30967 | 71.8 | ACGGGGACCTTGACGGTTGA | 35 | 34 | 11 | 35 | 1 | 1 |
| 8913 | 4280 | 4273 | 41234 | 74.3 | ACGGGGACCGTTATCGCGAA | 35 | 34 | 12 | 24 | 16 | 0 |
| 8914 | 4281 | 4274 | 30968 | 67.6 | ACGGGGACGGTAAGGAAATC | 35 | 34 | 18 | 25 | 4 | 0 |
| 8915 | 4282 | 4275 | 12237 | 74.2 | ACGGGGACGCAAAGTGCCAT | 35 | 34 | 21 | 22 | 15 | 0 |
| 8916 | 4283 | 4276 | 22374 | 70.3 | ACGGGGACACCTGAGTTCCC | 35 | 34 | 23 | 20 | 28 | 0 |
| 8917 | 4284 | 4277 | 12238 | 74.3 | ACGGGGACATCGTCCCATCG | 35 | 34 | 24 | 28 | 24 | 0 |
| 8918 | 4285 | 4278 | 12239 | 74.2 | ACGGGGACTCCCGATGCTCA | 35 | 34 | 28 | 27 | 13 | 0 |
| 8919 | 4286 | 4279 | 12240 | 74.6 | ACGGGGACTGCGCTGTGCTT | 35 | 34 | 29 | 14 | 17 | 0 |
| 8920 | 4287 | 4280 | 12241 | 75.2 | ACGGGGACGTGCGCAACCTA | 35 | 34 | 33 | 21 | 26 | 0 |
| 8921 | 4288 | 4281 | 12243 | 67.7 | ACGGACGGTTGAGGTACACG | 35 | 35 | 1 | 18 | 30 | 1 |
| 8922 | 4289 | 4282 | 41238 | 67.8 | ACGGACGGTACACGAACAGC | 35 | 35 | 7 | 16 | 31 | 0 |
| 8923 | 4290 | 4283 | 41239 | 67.8 | ACGGTCTGAATCACCTTGCG | 35 | 8 | 4 | 23 | 29 | 0 |
| 8924 | 4291 | 4284 | 41241 | 69 | ACGGACGGTCGTGGTAGACC | 35 | 35 | 10 | 18 | 32 | 0 |
| 8925 | 4292 | 4285 | 30970 | 70.8 | ACGGACGGCTCAGTCTTCCC | 35 | 35 | 13 | 19 | 28 | 0 |
| 8926 | 4293 | 4286 | 30971 | 67.4 | ACGGGAGTTCGTAATCTGCG | 35 | 20 | 10 | 4 | 29 | 0 |
| 8927 | 4294 | 4287 | 12249 | 74.8 | ACGGACGGGCAATCGTCAGC | 35 | 35 | 21 | 10 | 31 | 0 |
| 8928 | 4295 | 4288 | 12251 | 69.2 | ACGGACGGACCTGGTAGTGC | 35 | 35 | 23 | 18 | 33 | 0 |
| 8929 | 4296 | 4289 | 12253 | 71.3 | ACGGACGGGATGTCCCAAAG | 35 | 35 | 27 | 28 | 6 | 0 |
| 8930 | 4297 | 4290 | 12254 | 70.9 | ACGGACGGTCCCTCTGGGTA | 35 | 35 | 28 | 8 | 18 | 1 |
| 8931 | 4298 | 4291 | 12256 | 73.3 | ACGGACGGCAGCTTGACGAA | 35 | 35 | 31 | 1 | 16 | 0 |
| 8932 | 4299 | 4292 | 12258 | 75.1 | ACGGACGGGTGCCTGTCGAA | 35 | 35 | 33 | 14 | 16 | 0 |
| 8933 | 4300 | 4293 | 12259 | 73.7 | ACGGACGGAGCCGCTTGTCT | 35 | 35 | 36 | 17 | 19 | 0 |
| 8934 | 4301 | 4294 | 16761 | 68.1 | ACGGAGCCTTAGCTTGGACC | 35 | 36 | 3 | 11 | 32 | 0 |
| 8935 | 4302 | 4295 | 12262 | 67.9 | AGCCAATCGTCTATCGGCAA | 36 | 4 | 19 | 24 | 21 | 0 |
| 8936 | 4303 | 4296 | 22383 | 72.4 | ACGGAGCCTGTCCGAAGCAA | 35 | 36 | 9 | 16 | 21 | 0 |
| 8937 | 4304 | 4297 | 12265 | 66.4 | ACGGAGCCTCGTGGTATGAT | 35 | 36 | 10 | 18 | 2 | 0 |
| 8938 | 4305 | 4298 | 12268 | 70.6 | ACGGAGCCCTGTTCCCAATC | 35 | 36 | 14 | 28 | 4 | 0 |
| 8939 | 4306 | 4299 | 41247 | 71.2 | ACGGAGCCCGAAGATGGGTA | 35 | 36 | 16 | 27 | 18 | 0 |
| 8940 | 4307 | 4300 | 12270 | 69 | ACGGAGCCAGTGGGACTGTC | 35 | 36 | 22 | 34 | 9 | 0 |
| 8941 | 4308 | 4301 | 41251 | 67.6 | ACGGAGCCCCTATACATCCC | 35 | 36 | 26 | 7 | 28 | 0 |
| 8942 | 4309 | 4302 | 12274 | 69.7 | ACGGAGCCGATGAATCAGGA | 35 | 36 | 27 | 4 | 25 | 0 |
| 8943 | 4310 | 4303 | 12275 | 73.7 | ACGGAGCCTCCCGCAAGGTA | 35 | 36 | 28 | 21 | 18 | 0 |
| 8944 | 4311 | 4304 | 12277 | 73 | ACGGAGCCCAGCGATGTTGA | 35 | 36 | 31 | 27 | 1 | 0 |
| 8945 | 4312 | 4305 | 12278 | 71.5 | AGCCGACCCCTATGTCCACG | 36 | 32 | 26 | 9 | 30 | 0 |
| 8946 | 4313 | 4306 | 12279 | 74.4 | ACGGAGCCGGACGATGCTGT | 35 | 36 | 34 | 27 | 14 | 0 |
| 8947 | 4314 | 4307 | 12280 | 72 | ACGGAGCCACGGTTGACGTT | 35 | 36 | 35 | 1 | 12 | 1 |
| 8948 | 4315 | 4308 | 22393 | 70.6 | AGCCTTGAAAAGTGCGCGAA | 36 | 1 | 6 | 29 | 16 | 0 |
| 8949 | 4316 | 4309 | 41252 | 69.2 | TTGATCGTGCTTGCAAAGCC | 1 | 10 | 17 | 21 | 36 | 0 |
| 8950 | 4317 | 4310 | 30972 | 68.9 | TTGACGTTCTCAAGCCCACG | 1 | 12 | 13 | 36 | 30 | 0 |
| 8951 | 4318 | 4311 | 41253 | 71.1 | TTGAGCTTGTGCACGGGACC | 1 | 17 | 33 | 35 | 32 | 0 |
| 8952 | 4319 | 4312 | 30973 | 67.9 | TTGAGCAATGTCGATGCGAA | 1 | 21 | 9 | 27 | 16 | 0 |
| 8953 | 4320 | 4313 | 41254 | 67.4 | TTGAAGGAACCTGGACCGAA | 1 | 25 | 23 | 34 | 16 | 0 |

FIG. 29MMMM

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 8954 | 4321 | 4314 | 12288 | 71.7 | TTGAGATGTGCGACGGCGTT | 1 | 27 | 29 | 35 12 | 0 |
| 8955 | 4322 | 4315 | 12293 | 70 | TTGAGGACGCAACTTGTGCG | 1 | 34 | 21 | 11 29 | 0 |
| 8956 | 4323 | 4316 | 30974 | 67.4 | TGATGCTTACGGTGTCTGCG | 2 | 17 | 35 | 9 29 | 0 |
| 8957 | 4324 | 4318 | 12308 | 67.1 | AGCCTTAGGCTTCAGCGATG | 36 | 3 | 17 | 31 27 | 0 |
| 8958 | 4325 | 4319 | 12315 | 68.1 | AGCCTTAGCAGCATCGCTTG | 36 | 3 | 31 | 24 11 | 0 |
| 8959 | 4326 | 4320 | 30976 | 70.3 | AGCCAATCCGTTTGTCGTGC | 36 | 4 | 12 | 9 33 | 0 |
| 8960 | 4327 | 4321 | 41261 | 67.5 | AGCCAATCGCAAGAGTACGG | 36 | 4 | 21 | 20 35 | 0 |
| 8961 | 4328 | 4322 | 12327 | 70.3 | AGCCAATCAGTGAGCCACGG | 36 | 4 | 22 | 36 35 | 0 |
| 8962 | 4329 | 4323 | 30977 | 71.5 | AGCCAATCAGGATGCGGCTT | 36 | 4 | 25 | 29 17 | 0 |
| 8963 | 4330 | 4324 | 30978 | 65.9 | AATCCCTATGTCTCCCCACG | 4 | 26 | 9 | 28 30 | 0 |
| 8964 | 4331 | 4325 | 12329 | 68.2 | AGCCAATCGATGAAAGTGCG | 36 | 4 | 27 | 6 29 | 0 |
| 8965 | 4332 | 4326 | 22403 | 65.4 | AGCCAATCGGACTACACACG | 36 | 4 | 34 | 7 30 | 0 |
| 8966 | 4333 | 4327 | 12332 | 69.5 | AGCCAATCAGCCCTGTACGG | 36 | 4 | 36 | 14 35 | 0 |
| 8967 | 4334 | 4328 | 41263 | 64.6 | AGCCATACCGTTACGGTGTC | 36 | 5 | 12 | 35 9 | 0 |
| 8968 | 4335 | 4329 | 16784 | 65.2 | AGCCATACGCTTCTCAATCG | 36 | 5 | 17 | 13 24 | 0 |
| 8969 | 4336 | 4330 | 12342 | 66.1 | AGCCATACACCTGGACCCAT | 36 | 5 | 23 | 34 15 | 0 |
| 8970 | 4337 | 4331 | 12343 | 69.2 | AGCCATACAGGATCCCGTGC | 36 | 5 | 25 | 28 33 | 0 |
| 8971 | 4338 | 4332 | 12346 | 71.7 | AGCCATACCAGCGACCGGAC | 36 | 5 | 31 | 32 34 | 0 |
| 8972 | 4339 | 4333 | 30979 | 71.3 | AGCCATACGTGCCTCATGCG | 36 | 5 | 33 | 13 29 | 0 |
| 8973 | 4340 | 4334 | 12351 | 68.5 | AGCCAAAGTGATTCCCGACC | 36 | 6 | 2 | 28 32 | 0 |
| 8974 | 4341 | 4335 | 22406 | 68 | AAAGTCTGGCAAGCTTTGCG | 6 | 8 | 21 | 17 29 | 0 |
| 8975 | 4342 | 4336 | 16789 | 67.3 | AGCCAAAGGCAAGGACAGTG | 36 | 6 | 21 | 34 22 | 0 |
| 8976 | 4343 | 4337 | 12357 | 71.3 | AAAGAGTGGTGCGTGCACGG | 6 | 22 | 33 | 33 35 | 0 |
| 8977 | 4344 | 4338 | 12358 | 64.4 | AGCCAAAGAGGACTCACGAA | 36 | 6 | 25 | 13 16 | 0 |
| 8978 | 4345 | 4339 | 41267 | 65.8 | AGCCAAAGCCTATGATTCCC | 36 | 6 | 26 | 2 28 | 0 |
| 8979 | 4346 | 4340 | 30980 | 67.1 | AGCCAAAGGACCTTGACACG | 36 | 6 | 32 | 1 30 | 0 |
| 8980 | 4347 | 4341 | 41271 | 67.1 | TACATGCGATACTGCGCCAT | 7 | 29 | 5 | 29 15 | 0 |
| 8981 | 4348 | 4342 | 30981 | 68.3 | TCTGCTTGTTGACACGCACG | 8 | 11 | 1 | 30 30 | 1 |
| 8982 | 4349 | 4343 | 41272 | 70.1 | TCTGCTCAGACCGGACGCTT | 8 | 13 | 32 | 34 17 | 0 |
| 8983 | 4350 | 4344 | 12372 | 68.2 | AGCCTCTGCTGTATCGCGAA | 36 | 8 | 14 | 24 16 | 0 |
| 8984 | 4351 | 4345 | 12374 | 70.1 | AGCCTCTGGAGTCACGCGAA | 36 | 8 | 20 | 30 16 | 0 |
| 8985 | 4352 | 4346 | 12378 | 65.7 | TCTGGATGAAAGGATGGCAA | 8 | 27 | 6 | 27 21 | 0 |
| 8986 | 4353 | 4347 | 30982 | 70.8 | AGCCTCTGGGACATCGAGCC | 36 | 8 | 34 | 24 36 | 0 |
| 8987 | 4354 | 4349 | 12392 | 68.9 | AGCCTGTCTGCGCGAATACA | 36 | 9 | 29 | 16 7 | 0 |
| 8988 | 4355 | 4350 | 16797 | 70 | AGCCTGTCCAGCAAAGCAGC | 36 | 9 | 31 | 6 31 | 0 |
| 8989 | 4356 | 4351 | 30983 | 67 | AGCCTCGTTTGATGTCGCTT | 36 | 10 | 1 | 9 17 | 0 |
| 8990 | 4357 | 4353 | 12398 | 66.1 | TCGTTGTCTACATGCGGACC | 10 | 9 | 7 | 29 32 | 0 |
| 8991 | 4358 | 4354 | 12403 | 69.3 | AGCCTCGTGAGTGGACAGCC | 36 | 10 | 20 | 34 36 | 0 |
| 8992 | 4359 | 4355 | 30984 | 71.3 | AGCCTCGTGCAACGAAGCAA | 36 | 10 | 21 | 16 21 | 0 |
| 8993 | 4360 | 4356 | 30985 | 68.3 | AGCCTCGTACCTCGAAAGCC | 36 | 10 | 23 | 16 36 | 0 |
| 8994 | 4361 | 4357 | 16802 | 73.1 | AGCCTCGTTCCCGACCCTTG | 36 | 10 | 28 | 32 11 | 0 |
| 8995 | 4362 | 4358 | 12406 | 68.1 | TCGTTGCGATACTCGTTCCC | 10 | 29 | 5 | 10 28 | 0 |
| 8996 | 4363 | 4359 | 12410 | 68.1 | AGCCCTTGTTGAGCTTGCAA | 36 | 11 | 1 | 17 21 | 1 |
| 8997 | 4364 | 4360 | 41284 | 66.9 | AGCCCTTGCTCAAGGATTGA | 36 | 11 | 13 | 25 1 | 0 |
| 8998 | 4365 | 4361 | 30986 | 66.7 | AGCCCTTGCTGTACCTACGG | 36 | 11 | 14 | 23 35 | 0 |
| 8999 | 4366 | 4362 | 41286 | 66.7 | AGCCCTTGGTCTATCGCTTG | 36 | 11 | 19 | 24 11 | 0 |
| 9000 | 4367 | 4363 | 30987 | 71.2 | AGCCCTTGGCAAAGCCTGTC | 36 | 11 | 21 | 36 9 | 0 |
| 9001 | 4368 | 4364 | 41287 | 69.2 | AGCCCTTGAGTGATCGCGTT | 36 | 11 | 22 | 24 12 | 0 |

FIG. 29NNNN

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 9002 | 4369 | 4365 | 30989 | 65.4 | AGCCCTTGCCTAGTCTAGCC | 36 11 | 26 | 19 | 36 | 0 |
| 9003 | 4370 | 4366 | 30990 | 72.1 | AGCCCTTGGACCGAGTTCCC | 36 11 | 32 | 20 | 28 | 0 |
| 9004 | 4371 | 4367 | 12422 | 68.4 | AGCCCTTGGGACTGTCCTTG | 36 11 | 34 | 9 | 11 | 0 |
| 9005 | 4372 | 4368 | 30991 | 68.8 | AGCCCTTGAGCCAAAGGATG | 36 11 | 36 | 6 | 27 | 0 |
| 9006 | 4373 | 4369 | 30992 | 70.2 | AGCCCGTTAATCGTGCGGTA | 36 12 | 4 | 33 | 18 | 0 |
| 9007 | 4374 | 4370 | 41290 | 66.3 | AGCCCGTTTACAAATCCGTT | 36 12 | 7 | 4 | 12 | 0 |
| 9008 | 4375 | 4371 | 30994 | 65.3 | AGCCCGTTGGTACGAATACA | 36 12 | 18 | 16 | 7 | 0 |
| 9009 | 4376 | 4372 | 30995 | 66.6 | AGCCCGTTGAGTAAAGCGTT | 36 12 | 20 | 6 | 12 | 0 |
| 9010 | 4377 | 4373 | 41293 | 66.7 | AGCCCGTTAGTGAAAGACGG | 36 12 | 22 | 6 | 35 | 0 |
| 9011 | 4378 | 4374 | 12439 | 70.5 | AGCCCGTTATCGTGATTGCG | 36 12 | 24 | 2 | 29 | 0 |
| 9012 | 4379 | 4375 | 12441 | 75.4 | AGCCCGTTTCCCGATGCCAT | 36 12 | 28 | 27 | 15 | 1 |
| 9013 | 4380 | 4376 | 12442 | 75.6 | AGCCCGTTTGCGCGTTCTCA | 36 12 | 29 | 12 | 13 | 0 |
| 9014 | 4381 | 4377 | 12444 | 70.4 | AGCCCGTTGACCATACTGCG | 36 12 | 32 | 5 | 29 | 0 |
| 9015 | 4382 | 4378 | 12445 | 68.2 | AGCCCGTTGTGCTACAATCG | 36 12 | 33 | 7 | 24 | 0 |
| 9016 | 4383 | 4379 | 41295 | 67.9 | AGCCCTCATTGATGTCTGCG | 36 13 | 1 | 9 | 29 | 0 |
| 9017 | 4384 | 4380 | 12447 | 70.2 | AGCCCTCATGATCCATTGCG | 36 13 | 2 | 15 | 29 | 0 |
| 9018 | 4385 | 4381 | 30996 | 69.6 | AGCCCTCAAAAGGCAAGCAA | 36 13 | 6 | 21 | 21 | 0 |
| 9019 | 4386 | 4382 | 41296 | 69.7 | AGCCCTCACTTGGAGTTGCG | 36 13 | 11 | 20 | 29 | 0 |
| 9020 | 4387 | 4383 | 12453 | 71.2 | AGCCCTCACCATGGACGCTT | 36 13 | 15 | 34 | 17 | 0 |
| 9021 | 4388 | 4384 | 30997 | 66 | AGCCCTGTTGATATCGGACC | 36 14 | 2 | 24 | 32 | 0 |
| 9022 | 4389 | 4385 | 12467 | 65.4 | AGCCCTGTTGTCATACGTGC | 36 14 | 9 | 5 | 33 | 0 |
| 9023 | 4390 | 4386 | 30998 | 70.2 | AGCCCTGTCCATGCAAGTGC | 36 14 | 15 | 21 | 33 | 0 |
| 9024 | 4391 | 4387 | 41303 | 70.5 | AGCCCTGTGCTTTCGTCACG | 36 14 | 17 | 10 | 30 | 0 |
| 9025 | 4392 | 4388 | 41304 | 68.9 | AGCCCTGTGGTAGCAAAGCC | 36 14 | 18 | 21 | 36 | 0 |
| 9026 | 4393 | 4389 | 16828 | 70.3 | AGCCCTGTACCTCAGCGCAA | 36 14 | 23 | 31 | 21 | 0 |
| 9027 | 4394 | 4390 | 12474 | 69 | AGCCCTGTATCGCCTAACGG | 36 14 | 24 | 26 | 35 | 0 |
| 9028 | 4395 | 4391 | 41306 | 74.3 | AGCCCTGTCACGGTGCCGTT | 36 14 | 30 | 33 | 12 | 0 |
| 9029 | 4396 | 4392 | 31000 | 68.4 | AGCCCTGTAGCCCTTGGGTA | 36 14 | 36 | 11 | 18 | 0 |
| 9030 | 4397 | 4393 | 41308 | 66.3 | AGCCCATTTGATTAGCGTT | 36 15 | 1 | 3 | 12 | 0 |
| 9031 | 4398 | 4394 | 41310 | 68.7 | AGCCCATAATCCGAAGTGC | 36 15 | 4 | 16 | 33 | 0 |
| 9032 | 4399 | 4395 | 31001 | 68.6 | AGCCCATAAAGTCCCGATG | 36 15 | 6 | 28 | 27 | 1 |
| 9033 | 4400 | 4396 | 16834 | 66.7 | AGCCCATTACATCGTGACC | 36 15 | 7 | 10 | 32 | 0 |
| 9034 | 4401 | 4397 | 16835 | 69.4 | AGCCCATTGTCGTCTACGG | 36 15 | 9 | 19 | 35 | 0 |
| 9035 | 4402 | 4398 | 12485 | 66.8 | AGCCCATTCGTCTCAGATG | 36 15 | 10 | 13 | 27 | 0 |
| 9036 | 4403 | 4399 | 12486 | 68 | AGCCCATCTCAGATGGGAC | 36 15 | 13 | 27 | 34 | 0 |
| 9037 | 4404 | 4400 | 16836 | 71.1 | AGCCCATCGAACACGGTCT | 36 15 | 16 | 30 | 19 | 0 |
| 9038 | 4405 | 4401 | 31002 | 68.7 | AGCCCATCAGCCCATAAAG | 36 15 | 31 | 15 | 6 | 0 |
| 9039 | 4406 | 4402 | 31004 | 71.5 | AGCCCATACGGCCTACGAA | 36 15 | 35 | 26 | 16 | 0 |
| 9040 | 4407 | 4403 | 41314 | 68.3 | AGCCCGAATTGAACCTCGTT | 36 16 | 1 | 23 | 12 | 0 |
| 9041 | 4408 | 4404 | 12497 | 66.7 | AGCCCGAAATACCGAACTTG | 36 16 | 5 | 16 | 11 | 0 |
| 9042 | 4409 | 4405 | 16840 | 63.7 | CGAAAAAGATACGTCTTGCG | 16 6 | 5 | 19 | 29 | 0 |
| 9043 | 4410 | 4406 | 41315 | 66.1 | AGCCCGAATACACTTGGGAC | 36 16 | 7 | 11 | 34 | 0 |
| 9044 | 4411 | 4407 | 12501 | 73.5 | AGCCCGAATCGTGTGCATCG | 36 16 | 10 | 33 | 24 | 0 |
| 9045 | 4412 | 4408 | 31005 | 71.9 | AGCCCGAACTTGGGTATGCG | 36 16 | 11 | 18 | 29 | 0 |
| 9046 | 4413 | 4409 | 31006 | 66.5 | AGCCCGAACTCAGTCTACGG | 36 16 | 13 | 19 | 35 | 0 |
| 9047 | 4414 | 4410 | 12503 | 67.3 | AGCCCGAACGAACTGTTCTG | 36 16 | 16 | 14 | 8 | 0 |
| 9048 | 4415 | 4411 | 41317 | 69.1 | AGCCCGAAGCTTACGGAGTG | 36 16 | 17 | 35 | 22 | 0 |
| 9049 | 4416 | 4412 | 31007 | 67.7 | AGCCCGAAGAGTGTCTGCAA | 36 16 | 20 | 19 | 21 | 0 |

FIG. 29OOOO

| SEQ ID NO: | ZIP ID# | 4,633 ID# | HEX ID# | Tm | ZIPCODE (NH2 -> CONH2) | TETRAMER NUMBERS | | | | "UNALLOWED DIMERS" |
|---|---|---|---|---|---|---|---|---|---|---|
| 9050 | 4417 | 4413 | 12509 | 71.3 | AGCCCGAAATCGCTGTAGCC | 36 | 16 | 24 | 14 36 | 0 |
| 9051 | 4418 | 4414 | 31008 | 70.9 | AGCCCGAAAGGATCTGACGG | 36 | 16 | 25 | 8 35 | 0 |
| 9052 | 4419 | 4415 | 16843 | 73.8 | AGCCCGAATGCGCGTTACCT | 36 | 16 | 29 | 12 23 | 0 |
| 9053 | 4420 | 4416 | 12513 | 71.7 | AGCCCGAACACGTCCCAAAG | 36 | 16 | 30 | 28 6 | 0 |
| 9054 | 4421 | 4417 | 12515 | 68.5 | AGCCCGAAGGACGGTATGTC | 36 | 16 | 34 | 18 9 | 0 |
| 9055 | 4422 | 4418 | 12516 | 73.1 | AGCCCGAAACGGGACTCTG | 36 | 16 | 35 | 34 8 | 0 |
| 9056 | 4423 | 4419 | 41319 | 64.5 | AGCCGCTTTGATAGGAAGTG | 36 | 17 | 2 | 25 22 | 0 |
| 9057 | 4424 | 4420 | 31009 | 66.8 | AGCCGCTTTTAGGGTACGAA | 36 | 17 | 3 | 18 16 | 0 |
| 9058 | 4425 | 4421 | 16846 | 64.6 | AGCCGCTTATACTGTCAGCC | 36 | 17 | 5 | 9 36 | 0 |
| 9059 | 4426 | 4422 | 12523 | 70.5 | AGCCGCTTTGTCGCTTGGTA | 36 | 17 | 9 | 17 18 | 0 |
| 9060 | 4427 | 4423 | 31010 | 68.8 | AGCCGCTTCTTGTGATGCAA | 36 | 17 | 11 | 2 21 | 0 |
| 9061 | 4428 | 4424 | 31011 | 68.2 | AGCCGCTTCTGTTCGTGATG | 36 | 17 | 14 | 10 27 | 0 |
| 9062 | 4429 | 4425 | 31012 | 68.8 | AGCCGCTTCCATTTGAGACC | 36 | 17 | 15 | 1 32 | 0 |
| 9063 | 4430 | 4426 | 31013 | 68.5 | AGCCGCTTGGTAGGACGTCT | 36 | 17 | 18 | 34 19 | 0 |
| 9064 | 4431 | 4427 | 12533 | 77.4 | AGCCGCTTTGCGCTCAACGG | 36 | 17 | 29 | 13 35 | 0 |
| 9065 | 4432 | 4428 | 12534 | 72.4 | AGCCGCTTCAGCGAGTACGG | 36 | 17 | 31 | 20 35 | 0 |
| 9066 | 4433 | 4429 | 12536 | 77 | AGCCGCTTGTGCCACGTCCC | 36 | 17 | 33 | 30 28 | 0 |
| 9067 | 4434 | 4430 | 41324 | 68.8 | AGCCGGTATTGATCCCCTCA | 36 | 18 | 1 | 28 13 | 0 |
| 9068 | 4435 | 4431 | 31014 | 67.2 | AGCCGGTAAATCACCTGTGC | 36 | 18 | 4 | 23 33 | 0 |
| 9069 | 4436 | 4432 | 41325 | 69.2 | AGCCGGTAAAAGGTCTTGCG | 36 | 18 | 6 | 19 29 | 0 |
| 9070 | 4437 | 4433 | 16852 | 67.3 | AGCCGGTATCTGCCATCTTG | 36 | 18 | 8 | 15 11 | 0 |
| 9071 | 4438 | 4434 | 12542 | 66.9 | AGCCGGTATCGTTTGACGTT | 36 | 18 | 10 | 1 12 | 0 |
| 9072 | 4439 | 4435 | 22438 | 70.9 | AGCCGGTACTGTTCCCAGCC | 36 | 18 | 14 | 28 36 | 0 |
| 9073 | 4440 | 4436 | 22439 | 63.7 | AGCCGGTAGGTACCATAGGA | 36 | 18 | 18 | 15 25 | 0 |
| 9074 | 4441 | 4437 | 31015 | 67.4 | AGCCGGTAGAGTCAGCATCG | 36 | 18 | 20 | 31 24 | 0 |
| 9075 | 4442 | 4438 | 16861 | 70.3 | AGCCGGTATCCCCTTGTCGT | 36 | 18 | 28 | 11 10 | 0 |
| 9076 | 4443 | 4439 | 12559 | 68.1 | AGCCGTCTAATCGGACCCAT | 36 | 19 | 4 | 34 15 | 0 |
| 9077 | 4444 | 4440 | 12561 | 65 | AGCCGTCTTACAATCGATCG | 36 | 19 | 7 | 24 24 | 0 |
| 9078 | 4445 | 4441 | 16866 | 66 | AGCCGTCTACCTTCGTAGCC | 36 | 19 | 23 | 10 36 | 0 |
| 9079 | 4446 | 4442 | 12572 | 67.5 | AGCCGTCTGATGTCGTGCTT | 36 | 19 | 27 | 10 17 | 0 |
| 9080 | 4447 | 4443 | 12574 | 67.6 | AGCCGTCTCACGATCGTGTC | 36 | 19 | 30 | 24 9 | 0 |
| 9081 | 4448 | 4444 | 31017 | 73 | AGCCGTCTCAGCACGGCTTG | 36 | 19 | 31 | 35 11 | 0 |
| 9082 | 4449 | 4445 | 12576 | 69.2 | AGCCGTCTGACCGAGTGACC | 36 | 19 | 32 | 20 32 | 0 |
| 9083 | 4450 | 4447 | 31018 | 68.9 | AGCCGTCTAGCCAATCGCTT | 36 | 19 | 36 | 4 17 | 0 |
| 9084 | 4451 | 4449 | 41333 | 72.1 | AGCCGAGTTGTCCACGCCAT | 36 | 20 | 9 | 30 15 | 0 |
| 9085 | 4452 | 4450 | 12582 | 66.6 | AGCCGAGTTCGTGAGTAGCC | 36 | 20 | 10 | 20 36 | 0 |
| 9086 | 4453 | 4451 | 12586 | 65.8 | AGCCGAGTGTCTTACATGCG | 36 | 20 | 19 | 7 29 | 0 |
| 9087 | 4454 | 4452 | 31019 | 69.4 | AGCCGAGTATCGCAGCCTGT | 36 | 20 | 24 | 31 14 | 0 |
| 9088 | 4455 | 4453 | 31020 | 65.3 | AGCCGAGTCCTATTGATCCC | 36 | 20 | 26 | 1 28 | 0 |
| 9089 | 4456 | 4454 | 41335 | 68.7 | AGCCGAGTGATGTCCCGAGT | 36 | 20 | 27 | 28 20 | 0 |
| 9090 | 4457 | 4455 | 22446 | 67.7 | AGCCGAGTGCGTTGACTGT | 36 | 20 | 29 | 1 14 | 0 |
| 9091 | 4458 | 4456 | 16874 | 71.7 | AGCCGAGTAGCCCAGCCTCA | 36 | 20 | 36 | 31 13 | 0 |
| 9092 | 4459 | 4457 | 41337 | 70.4 | AGCCGCAATTGAAGGAGCAA | 36 | 21 | 1 | 25 21 | 0 |
| 9093 | 4460 | 4458 | 31021 | 67 | AGCCGCAATGATAGCCTGAT | 36 | 21 | 2 | 36 2 | 0 |
| 9094 | 4461 | 4459 | 12596 | 73.2 | AGCCGCAATTAGCGAATGCG | 36 | 21 | 3 | 16 29 | 0 |
| 9095 | 4462 | 4460 | 31022 | 67.2 | AGCCGCAATACAAGTGTCCC | 36 | 21 | 7 | 22 28 | 1 |
| 9096 | 4463 | 4461 | 41338 | 68.7 | AGCCGCAATCTGGGTAGGAC | 36 | 21 | 8 | 18 34 | 0 |
| 9097 | 4464 | 4462 | 41339 | 73.3 | AGCCGCAACGTTTGCGTGAT | 36 | 21 | 12 | 29 2 | 0 |

FIG. 29PPPP

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 9098 | 4465 | 4463 | 31023 | 71.3 | AGCCGCAACTCAAGGAAGCC | 36 | 21 | 13 | 25 | 36 | 0 |
| 9099 | 4466 | 4464 | 12602 | 70 | AGCCGCAACGAAGGTAATCG | 36 | 21 | 16 | 18 | 24 | 0 |
| 9100 | 4467 | 4465 | 12603 | 70.9 | AGCCGCAAGCTTGAGTCACG | 36 | 21 | 17 | 20 | 30 | 0 |
| 9101 | 4468 | 4466 | 41340 | 74.2 | AGCCGCAAGCAATCCCCTTG | 36 | 21 | 21 | 28 | 11 | 0 |
| 9102 | 4469 | 4467 | 12608 | 73.8 | AGCCGCAAATCGGCAAACCT | 36 | 21 | 24 | 21 | 23 | 0 |
| 9103 | 4470 | 4468 | 12609 | 71.8 | AGCCGCAAAGGAGCAACGTT | 36 | 21 | 25 | 21 | 12 | 0 |
| 9104 | 4471 | 4469 | 12610 | 71.9 | AGCCGCAATCCCGGTAAGTG | 36 | 21 | 28 | 18 | 22 | 0 |
| 9105 | 4472 | 4470 | 12611 | 76.5 | AGCCGCAATGCGATCGCTCA | 36 | 21 | 29 | 24 | 13 | 0 |
| 9106 | 4473 | 4471 | 31024 | 74.6 | AGCCGCAACACGCTGTGTGC | 36 | 21 | 30 | 14 | 33 | 0 |
| 9107 | 4474 | 4472 | 41342 | 71.4 | AGCCGCAAGTGCATACACGG | 36 | 21 | 33 | 5 | 35 | 0 |
| 9108 | 4475 | 4473 | 12615 | 73.3 | AGCCGCAAACGGCCTAGCTT | 36 | 21 | 35 | 26 | 17 | 0 |
| 9109 | 4476 | 4474 | 12616 | 72.2 | AGCCGCAAAGCCCTGTCTTG | 36 | 21 | 36 | 14 | 11 | 0 |
| 9110 | 4477 | 4475 | 41343 | 69 | AGCCAGTGTCGTATCGCACG | 36 | 22 | 10 | 24 | 30 | 0 |
| 9111 | 4478 | 4476 | 16878 | 66.9 | AGCCAGTGCTTGAGTGGGAC | 36 | 22 | 11 | 22 | 34 | 0 |
| 9112 | 4479 | 4477 | 31025 | 68.6 | AGCCAGTGCTGTGATGACGG | 36 | 22 | 14 | 27 | 35 | 0 |
| 9113 | 4480 | 4478 | 41345 | 69.5 | AGCCAGTGGGTACAGCAGCC | 36 | 22 | 18 | 31 | 36 | 0 |
| 9114 | 4481 | 4479 | 12622 | 68.6 | AGCCAGTGACCTGCTTTCCC | 36 | 22 | 23 | 17 | 28 | 0 |
| 9115 | 4482 | 4480 | 12623 | 67.2 | AGTGATCGGAGTACGGCAGC | 22 | 24 | 20 | 35 | 31 | 0 |
| 9116 | 4483 | 4481 | 16881 | 68.8 | AGCCAGTGTGCGATACCACG | 36 | 22 | 29 | 5 | 30 | 0 |
| 9117 | 4484 | 4482 | 12629 | 69.8 | AGCCAGTGGACCAGGAGCAA | 36 | 22 | 32 | 25 | 21 | 0 |
| 9118 | 4485 | 4483 | 31027 | 68.1 | ACCTTGTCAGGACACGGCAA | 23 | 9 | 25 | 30 | 21 | 0 |
| 9119 | 4486 | 4484 | 41346 | 66.3 | AGCCACCTTCGTAAAGCCAT | 36 | 23 | 10 | 6 | 15 | 0 |
| 9120 | 4487 | 4485 | 31028 | 67.6 | ACCTCGAATGTCCTTGCGAA | 23 | 16 | 9 | 11 | 16 | 0 |
| 9121 | 4488 | 4486 | 12643 | 64.9 | ACCTATCGACCTGATGGCAA | 23 | 24 | 23 | 27 | 21 | 0 |
| 9122 | 4489 | 4487 | 12644 | 64.9 | ACCTAGGAAGTGCTCATGCG | 23 | 25 | 22 | 13 | 29 | 0 |
| 9123 | 4490 | 4488 | 12646 | 68.3 | AGCCACCTCACGAATCTCCC | 36 | 23 | 30 | 4 | 28 | 0 |
| 9124 | 4491 | 4489 | 12656 | 69.5 | AGCCATCGCGAATTGAGGAC | 36 | 24 | 16 | 1 | 34 | 0 |
| 9125 | 4492 | 4490 | 12661 | 71.9 | AGCCATCGGCAAAATCCAGC | 36 | 24 | 21 | 4 | 31 | 0 |
| 9126 | 4493 | 4491 | 31030 | 66.1 | AGCCATCGCCTAATACCCAT | 36 | 24 | 26 | 5 | 15 | 0 |
| 9127 | 4494 | 4492 | 12667 | 66.5 | AGGAATACGGTATCCCTGCG | 25 | 5 | 18 | 28 | 29 | 0 |
| 9128 | 4495 | 4493 | 16892 | 65.7 | AGGAAAAGTTGACACGTGCG | 25 | 6 | 1 | 30 | 29 | 1 |
| 9129 | 4496 | 4494 | 12669 | 68.6 | AGCCAGGATACATGCGCTCA | 36 | 25 | 7 | 29 | 13 | 0 |
| 9130 | 4497 | 4495 | 12670 | 70 | AGCCAGGATCTGCACGCTGT | 36 | 25 | 8 | 30 | 14 | 0 |
| 9131 | 4498 | 4496 | 41354 | 68.4 | AGCCAGGACGTTTGTCTCCC | 36 | 25 | 12 | 9 | 28 | 0 |
| 9132 | 4499 | 4497 | 12671 | 68.3 | AGCCAGGACTCAAGCCGAGT | 36 | 25 | 13 | 36 | 20 | 0 |
| 9133 | 4500 | 4498 | 16893 | 66.9 | AGCCAGGACCATTTGAGTGC | 36 | 25 | 15 | 1 | 33 | 0 |
| 9134 | 4501 | 4499 | 12677 | 65 | AGCCAGGAGCAAATACGATG | 36 | 25 | 21 | 5 | 27 | 0 |
| 9135 | 4502 | 4500 | 16895 | 72.5 | AGCCAGGATGCGCGAAGGTA | 36 | 25 | 29 | 16 | 18 | 0 |
| 9136 | 4503 | 4501 | 12681 | 67 | AGGACAGCCTTGAATCACGG | 25 | 31 | 11 | 4 | 35 | 0 |
| 9137 | 4504 | 4502 | 12682 | 66.4 | AGCCAGGAGACCTCGTCTCA | 36 | 25 | 32 | 10 | 13 | 0 |
| 9138 | 4505 | 4503 | 31031 | 68.6 | AGCCAGGAGGACAAAGGTGC | 36 | 25 | 34 | 6 | 33 | 0 |
| 9139 | 4506 | 4504 | 31032 | 70.1 | AGGAACGGCCATAATCGCAA | 25 | 35 | 15 | 4 | 21 | 0 |
| 9140 | 4507 | 4505 | 31033 | 66.5 | AGCCCCTATGATAGCCGATG | 36 | 26 | 2 | 36 | 27 | 0 |
| 9141 | 4508 | 4506 | 31034 | 71.7 | AGCCCCTATGTCAGCCCACG | 36 | 26 | 9 | 36 | 30 | 0 |
| 9142 | 4509 | 4507 | 41356 | 65.6 | AGCCCCTACTTGAGGACAGC | 36 | 26 | 11 | 25 | 31 | 0 |
| 9143 | 4510 | 4508 | 41357 | 63.9 | AGCCCCTACTCACTCAATCG | 36 | 26 | 13 | 13 | 24 | 0 |
| 9144 | 4511 | 4509 | 16902 | 69.9 | AGCCCCTAGAGTGCAATGCG | 36 | 26 | 20 | 21 | 29 | 0 |
| 9145 | 4512 | 4510 | 41358 | 69.5 | AGCCCCTAGCAACCATGTGC | 36 | 26 | 21 | 15 | 33 | 0 |

FIG. 29QQQQ

| SEQ ID NO: | ZIP ID# | 4,633 ID# | HEX ID# Tm | ZIPCODE (NH2 -> CONH2) | TETRAMER NUMBERS | | | | | "UNALLOWED DIMERS" |
|---|---|---|---|---|---|---|---|---|---|---|
| 9146 | 4513 | 4511 | 31035 67 | AGCCCCTAACCTTCTGGCTT | 36 | 26 | 23 | 8 | 17 | 0 |
| 9147 | 4514 | 4512 | 12695 68.3 | AGCCCCTAGATGGCAATCGT | 36 | 26 | 27 | 21 | 10 | 0 |
| 9148 | 4515 | 4513 | 12697 63.8 | AGCCCCTACACGAATCAATC | 36 | 26 | 30 | 4 | 4 | 0 |
| 9149 | 4516 | 4514 | 12699 73.7 | AGCCCCTAACGGCACGCTGT | 36 | 26 | 35 | 30 | 14 | 0 |
| 9150 | 4517 | 4515 | 12700 65.3 | AGCCGATGTGATCTTGATCG | 36 | 27 | 2 | 11 | 24 | 0 |
| 9151 | 4518 | 4516 | 12701 65.9 | AGCCGATGTTAGTTGATGCG | 36 | 27 | 3 | 1 | 29 | 0 |
| 9152 | 4519 | 4517 | 12703 65.1 | AGCCGATGTACATGTCGACC | 36 | 27 | 7 | 9 | 32 | 0 |
| 9153 | 4520 | 4518 | 12704 68.5 | AGCCGATGTCTGAATCGCAA | 36 | 27 | 8 | 4 | 21 | 0 |
| 9154 | 4521 | 4519 | 31036 73.7 | AGCCGATGTGTCAGCCTGCG | 36 | 27 | 9 | 36 | 29 | 0 |
| 9155 | 4522 | 4520 | 41363 69.4 | AGCCGATGCTCAACCTGCTT | 36 | 27 | 13 | 23 | 17 | 0 |
| 9156 | 4523 | 4521 | 22465 66.5 | AGCCGATGGCTTAGCCTTAG | 36 | 27 | 17 | 36 | 3 | 0 |
| 9157 | 4524 | 4522 | 16908 69.1 | AGCCGATGACCTCAGCCCTA | 36 | 27 | 23 | 31 | 26 | 0 |
| 9158 | 4525 | 4523 | 41364 70.3 | AGCCGATGCCTACCATGTGC | 36 | 27 | 26 | 15 | 33 | 0 |
| 9159 | 4526 | 4524 | 31038 69.2 | AGCCTCCCTTGAACCTTCCC | 36 | 28 | 1 | 23 | 28 | 1 |
| 9160 | 4527 | 4525 | 31039 70.2 | AGCCTCCCATACTGCGCTCA | 36 | 28 | 5 | 29 | 13 | 0 |
| 9161 | 4528 | 4526 | 41367 69 | AGCCTCCCTACAACCTTGCG | 36 | 28 | 7 | 23 | 29 | 0 |
| 9162 | 4529 | 4527 | 16911 68.6 | AGCCTCCCTGTCAAAGGTGC | 36 | 28 | 9 | 6 | 33 | 0 |
| 9163 | 4530 | 4528 | 12724 70.5 | AGCCTCCCTCGTACGGGGTA | 36 | 28 | 10 | 35 | 18 | 0 |
| 9164 | 4531 | 4529 | 12725 67.7 | TCCCCTTGTTGAAGTGACGG | 28 | 11 | 1 | 22 | 35 | 1 |
| 9165 | 4532 | 4530 | 22467 68.9 | AGCCTCCCCATCCTAGGAC | 36 | 28 | 15 | 26 | 34 | 0 |
| 9166 | 4533 | 4531 | 31040 73 | AGCCTCCCCGAATCTGGTGC | 36 | 28 | 16 | 8 | 33 | 0 |
| 9167 | 4534 | 4532 | 41368 69.1 | TCCCGTCTGGTAGGACGCTT | 28 | 19 | 18 | 34 | 17 | 0 |
| 9168 | 4535 | 4533 | 31041 69.1 | AGCCTCCCGAGTCCTATCCC | 36 | 28 | 20 | 26 | 28 | 0 |
| 9169 | 4536 | 4534 | 16914 70.2 | TCCCAGTGCTTGCTTGGACC | 28 | 22 | 11 | 11 | 32 | 0 |
| 9170 | 4537 | 4535 | 12733 67.5 | TCCCATCGTTGAAATCGGAC | 28 | 24 | 1 | 4 | 34 | 0 |
| 9171 | 4538 | 4536 | 22471 67.3 | TCCCAGGACCTATCGTCGAA | 28 | 25 | 26 | 10 | 16 | 0 |
| 9172 | 4539 | 4537 | 22472 65.6 | AGCCTCCCCCTACTGTCTCA | 36 | 28 | 26 | 14 | 13 | 0 |
| 9173 | 4540 | 4538 | 12734 74.2 | AGCCTCCCGATGGATGGCAA | 36 | 28 | 27 | 27 | 21 | 0 |
| 9174 | 4541 | 4539 | 12735 74.1 | AGCCTCCCTCCCGCAAACCT | 36 | 28 | 28 | 21 | 23 | 0 |
| 9175 | 4542 | 4540 | 12736 73 | AGCCTCCCGTGCATCGTTGA | 36 | 28 | 33 | 24 | 1 | 0 |
| 9176 | 4543 | 4541 | 12737 73.7 | TCCCACGGCCATGAGTCGAA | 28 | 35 | 15 | 20 | 16 | 0 |
| 9177 | 4544 | 4542 | 12738 70.6 | AGCCTCCCAGCCAAAGTCGT | 36 | 28 | 36 | 6 | 10 | 0 |
| 9178 | 4545 | 4543 | 12739 68.8 | TGCGAATCGGTAAGTGCGTT | 29 | 4 | 18 | 22 | 12 | 0 |
| 9179 | 4546 | 4544 | 31042 68.8 | AGCCTGCGAAAGTCTGTCCC | 36 | 29 | 6 | 8 | 28 | 0 |
| 9180 | 4547 | 4546 | 22477 73.6 | AGCCTGCGCTCACTTGGCAA | 36 | 29 | 13 | 11 | 21 | 0 |
| 9181 | 4548 | 4547 | 12745 70.3 | TGCGCTGTGTCTTGTCCGAA | 29 | 14 | 19 | 9 | 16 | 0 |
| 9182 | 4549 | 4548 | 12748 70 | AGCCTGCGGAGTGATGCTGT | 36 | 29 | 20 | 27 | 14 | 0 |
| 9183 | 4550 | 4549 | 31043 71 | TGCGAGTGGAGTTCCCATCG | 29 | 22 | 20 | 28 | 24 | 0 |
| 9184 | 4551 | 4550 | 31044 68.9 | AGCCTGCGAGGAGCTTCCTA | 36 | 29 | 25 | 17 | 26 | 0 |
| 9185 | 4552 | 4551 | 12751 72.9 | AGCCTGCGTGCGAAAGCCTA | 36 | 29 | 29 | 6 | 26 | 0 |
| 9186 | 4553 | 4552 | 12752 75.9 | TGCGCACGCTCATCTGCAGC | 29 | 30 | 13 | 8 | 31 | 0 |
| 9187 | 4554 | 4553 | 12753 77.3 | AGCCTGCGGTGCGATGAGCC | 36 | 29 | 33 | 27 | 36 | 0 |
| 9188 | 4555 | 4554 | 31045 72.1 | AGCCCACGAATCGACCGGTA | 36 | 30 | 4 | 32 | 18 | 0 |
| 9189 | 4556 | 4555 | 41379 65.4 | AGCCCACGTACACTCAATCG | 36 | 30 | 7 | 13 | 24 | 0 |
| 9190 | 4557 | 4556 | 12760 72.4 | AGCCCACGCTTGGCAAGGTA | 36 | 30 | 11 | 21 | 18 | 0 |
| 9191 | 4558 | 4557 | 22487 65.9 | AGCCCACGGTCTAGGAGGTA | 36 | 30 | 19 | 25 | 18 | 0 |
| 9192 | 4559 | 4558 | 16921 73.3 | AGCCCACGACCTTCCCCTCA | 36 | 30 | 23 | 28 | 13 | 1 |
| 9193 | 4560 | 4559 | 31047 71.7 | AGCCCACGCCTACGTTGCTT | 36 | 30 | 26 | 12 | 17 | 0 |

FIG. 29RRRR

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 9194 | 4561 | 4560 | 12769 | 75.5 | AGCCCACGCAGCGGACTTGA | 36 | 30 | 31 | 34 | 1 | 0 |
| 9195 | 4562 | 4561 | 12770 | 77.5 | AGCCCACGGACCGCTTGCAA | 36 | 30 | 32 | 17 | 21 | 0 |
| 9196 | 4563 | 4562 | 12772 | 74.5 | AGCCCACGACGGCTCAAGGA | 36 | 30 | 35 | 13 | 25 | 0 |
| 9197 | 4564 | 4563 | 41381 | 65.8 | CAGCTGATCCTAGACCGCAA | 31 | 2 | 26 | 32 | 21 | 0 |
| 9198 | 4565 | 4564 | 22490 | 67 | AGCCCAGCTTAGAGTGCAGC | 36 | 31 | 3 | 22 | 31 | 0 |
| 9199 | 4566 | 4565 | 31048 | 69.5 | AGCCCAGCAAAGGACCAGTG | 36 | 31 | 6 | 32 | 22 | 0 |
| 9200 | 4567 | 4566 | 31049 | 66.1 | AGCCCAGCTACAGATGTCCC | 36 | 31 | 7 | 27 | 28 | 0 |
| 9201 | 4568 | 4567 | 16923 | 71.9 | AGCCCAGCTCGTGCTTGCTT | 36 | 31 | 10 | 17 | 17 | 0 |
| 9202 | 4569 | 4568 | 12780 | 71.3 | AGCCCAGCCCATTTGAAGGA | 36 | 31 | 15 | 1 | 25 | 0 |
| 9203 | 4570 | 4569 | 12781 | 69.3 | AGCCCAGCGCTTACCTATCG | 36 | 31 | 17 | 23 | 24 | 0 |
| 9204 | 4571 | 4570 | 31050 | 66.7 | AGCCCAGCGTCTATACCAGC | 36 | 31 | 19 | 5 | 31 | 0 |
| 9205 | 4572 | 4571 | 31051 | 70.8 | AGCCCAGCAGGACTGTTCCC | 36 | 31 | 25 | 14 | 28 | 0 |
| 9206 | 4573 | 4572 | 12787 | 72.7 | AGCCCAGCGACCCTCAACCT | 36 | 31 | 32 | 13 | 23 | 0 |
| 9207 | 4574 | 4573 | 12789 | 73.6 | AGCCCAGCAGCCCCATCCTA | 36 | 31 | 36 | 15 | 26 | 0 |
| 9208 | 4575 | 4574 | 22495 | 66.9 | AGCCGACCTTGAGGTACAA | 36 | 32 | 1 | 18 | 16 | 0 |
| 9209 | 4576 | 4575 | 41384 | 73 | AGCCGACCTGATGGACGCAA | 36 | 32 | 2 | 34 | 21 | 0 |
| 9210 | 4577 | 4576 | 12794 | 73.4 | AGCCGACCAAAGCAGCTCCC | 36 | 32 | 6 | 31 | 28 | 0 |
| 9211 | 4578 | 4577 | 12796 | 68.5 | AGCCGACCCTTGAAAGCTGT | 36 | 32 | 11 | 6 | 14 | 0 |
| 9212 | 4579 | 4578 | 12798 | 67.6 | AGCCGACCCTCACCTAGGAC | 36 | 32 | 13 | 26 | 34 | 0 |
| 9213 | 4580 | 4579 | 41385 | 71.4 | AGCCGACCGTCTGATGTCCC | 36 | 32 | 19 | 27 | 28 | 0 |
| 9214 | 4581 | 4580 | 12801 | 69.6 | AGCCGACCGCAACTCAAATC | 36 | 32 | 21 | 13 | 4 | 0 |
| 9215 | 4582 | 4581 | 12802 | 67.1 | AGCCGACCAGTGTTAGGTGC | 36 | 32 | 22 | 3 | 33 | 0 |
| 9216 | 4583 | 4582 | 31052 | 73 | AGCCGACCATCGTCTGGCAA | 36 | 32 | 24 | 8 | 21 | 0 |
| 9217 | 4584 | 4583 | 16926 | 71.5 | AGCCGACCAGGAAGTGCGTT | 36 | 32 | 25 | 22 | 12 | 0 |
| 9218 | 4585 | 4584 | 12807 | 72.1 | AGCCGACCCACGAGTGCTGT | 36 | 32 | 30 | 22 | 14 | 0 |
| 9219 | 4586 | 4585 | 12809 | 72.8 | AGCCGACCGTGCATCGAAAG | 36 | 32 | 33 | 24 | 6 | 0 |
| 9220 | 4587 | 4587 | 31053 | 71.8 | AGCCGTGCAATCTCGTTCCC | 36 | 33 | 4 | 10 | 28 | 0 |
| 9221 | 4588 | 4588 | 31054 | 67.4 | AGCCGTGCATACCCTACAGC | 36 | 33 | 5 | 26 | 31 | 0 |
| 9222 | 4589 | 4589 | 12814 | 70 | AGCCGTGCTCTGAGTGCCAT | 36 | 33 | 8 | 22 | 15 | 0 |
| 9223 | 4590 | 4590 | 12816 | 70.1 | AGCCGTGCTCGTTCGTGTCT | 36 | 33 | 10 | 10 | 19 | 0 |
| 9224 | 4591 | 4591 | 12817 | 73.3 | AGCCGTGCCTTGGAGTGCAA | 36 | 33 | 11 | 20 | 21 | 0 |
| 9225 | 4592 | 4592 | 12818 | 72.8 | AGCCGTGCCGAAGCAATGTC | 36 | 33 | 16 | 21 | 9 | 0 |
| 9226 | 4593 | 4593 | 12819 | 75.7 | AGCCGTGCGCTTGTGCTCGT | 36 | 33 | 17 | 33 | 10 | 0 |
| 9227 | 4594 | 4594 | 31055 | 74.2 | AGCCGTGCGTCTGCTTTCCC | 36 | 33 | 19 | 17 | 28 | 0 |
| 9228 | 4595 | 4595 | 12821 | 73.1 | AGCCGTGCATCGGCAACTGT | 36 | 33 | 24 | 21 | 14 | 0 |
| 9229 | 4596 | 4596 | 12824 | 74.5 | AGCCGTGCGGACCTTGTCGT | 36 | 33 | 34 | 11 | 10 | 0 |
| 9230 | 4597 | 4597 | 31056 | 63.7 | AGCCGGACTTAGTACAAGCC | 36 | 34 | 3 | 7 | 36 | 0 |
| 9231 | 4598 | 4598 | 12830 | 67.4 | AGCCGGACTGTCTCGTGGTA | 36 | 34 | 9 | 10 | 18 | 0 |
| 9232 | 4599 | 4599 | 12831 | 73.8 | AGCCGGACCGTTTGTCGACC | 36 | 34 | 12 | 9 | 32 | 0 |
| 9233 | 4600 | 4600 | 12833 | 73.5 | AGCCGGACCCATCAGCGAGT | 36 | 34 | 15 | 31 | 20 | 0 |
| 9234 | 4601 | 4601 | 16931 | 72.7 | AGCCGGACGCTTCTTGCTCA | 36 | 34 | 17 | 11 | 13 | 0 |
| 9235 | 4602 | 4602 | 12836 | 68 | AGCCGGACACCTCTTGACCT | 36 | 34 | 23 | 11 | 23 | 0 |
| 9236 | 4603 | 4603 | 12837 | 72.8 | AGCCGGACATCGCGTTTCTG | 36 | 34 | 24 | 12 | 8 | 0 |
| 9237 | 4604 | 4604 | 22502 | 68.6 | AGCCGGACAGGACCTACAGC | 36 | 34 | 25 | 26 | 31 | 0 |
| 9238 | 4605 | 4605 | 12840 | 69.4 | AGCCGGACTCCCTACACACG | 36 | 34 | 28 | 7 | 30 | 0 |
| 9239 | 4606 | 4606 | 12842 | 74.9 | AGCCGGACGTGCGAGTGACC | 36 | 34 | 33 | 20 | 32 | 0 |
| 9240 | 4607 | 4607 | 12843 | 78.2 | AGCCGGACGGACGACCCAGC | 36 | 34 | 34 | 32 | 31 | 0 |
| 9241 | 4608 | 4608 | 12846 | 66.7 | AGCCACGGAATCTGATGCTT | 36 | 35 | 4 | 2 | 17 | 0 |

FIG. 29SSSS

| SEQ ID NO: | ZIP ID# | 4,633 ID# | HEX ID# | Tm | ZIPCODE (NH2 -> CONH2) | TETRAMER NUMBERS | | | | | "UNALLOWED DIMERS" |
|---|---|---|---|---|---|---|---|---|---|---|---|
| 9242 | 4609 | 4609 | 12847 | 69.1 | AGCCACGGATACCAGCTCGT | 36 | 35 | 5 | 31 | 10 | 0 |
| 9243 | 4610 | 4610 | 41393 | 66.5 | AGCCACGGAAAGAAAGGATG | 36 | 35 | 6 | 6 | 27 | 0 |
| 9244 | 4611 | 4611 | 31057 | 66 | AGCCACGGTACACCTATCCC | 36 | 35 | 7 | 26 | 28 | 0 |
| 9245 | 4612 | 4612 | 12849 | 72.1 | AGCCACGGTCTGGATGCGTT | 36 | 35 | 8 | 27 | 12 | 0 |
| 9246 | 4613 | 4613 | 31058 | 73.2 | AGCCACGGTGTCGGACATCG | 36 | 35 | 9 | 34 | 24 | 0 |
| 9247 | 4614 | 4614 | 31059 | 75.1 | AGCCACGGGCTTGCTTCACG | 36 | 35 | 17 | 17 | 30 | 0 |
| 9248 | 4615 | 4615 | 31060 | 70.8 | ACGGGTCTGTCTGTGCCACG | 35 | 19 | 19 | 33 | 30 | 0 |
| 9249 | 4616 | 4616 | 12856 | 73.7 | AGCCACGGATCGGCTTTCGT | 36 | 35 | 24 | 17 | 10 | 0 |
| 9250 | 4617 | 4617 | 12859 | 73.5 | AGCCACGGGACCAGTGGACC | 36 | 35 | 32 | 22 | 32 | 0 |
| 9251 | 4618 | 4618 | 12860 | 70.2 | ACGGGTGCTACAGGACGTGC | 35 | 33 | 7 | 34 | 33 | 0 |
| 9252 | 4619 | 4619 | 16934 | 71.9 | AGCCACGGACGGCCTAAGTG | 36 | 35 | 35 | 26 | 22 | 0 |
| 9253 | 4620 | 4620 | 31061 | 65.9 | AGCCAGCCTGATACCTAGCC | 36 | 36 | 2 | 23 | 36 | 0 |
| 9254 | 4621 | 4621 | 41394 | 69 | AGCCAGCCAAAGACCTACGG | 36 | 36 | 6 | 23 | 35 | 0 |
| 9255 | 4622 | 4622 | 12866 | 71.3 | AGCCAGCCTCTGGACCAGGA | 36 | 36 | 8 | 32 | 25 | 0 |
| 9256 | 4623 | 4623 | 41395 | 66.9 | AGCCAGCCTCGTAGTGGGTA | 36 | 36 | 10 | 22 | 18 | 0 |
| 9257 | 4624 | 4624 | 12867 | 72.2 | AGCCAGCCCTTGTGTCCGAA | 36 | 36 | 11 | 9 | 16 | 0 |
| 9258 | 4625 | 4625 | 12868 | 73.7 | AGCCAGCCCGTTCGTTTCGT | 36 | 36 | 12 | 12 | 10 | 0 |
| 9259 | 4626 | 4626 | 16936 | 69.1 | AGCCAGCCCTCAGCTTCTTG | 36 | 36 | 13 | 17 | 11 | 0 |
| 9260 | 4627 | 4627 | 12870 | 72.5 | AGCCAGCCGCTTAGTGCAGC | 36 | 36 | 17 | 22 | 31 | 0 |
| 9261 | 4628 | 4628 | 12872 | 68.8 | AGCCAGCCGTCTTTGAGGAC | 36 | 36 | 19 | 1 | 34 | 0 |
| 9262 | 4629 | 4629 | 12874 | 68.5 | AGCCAGCCATCGTGATGATG | 36 | 36 | 24 | 2 | 27 | 0 |
| 9263 | 4630 | 4630 | 12876 | 76.3 | AGCCAGCCTCCCCAGCGATG | 36 | 36 | 28 | 31 | 27 | 0 |
| 9264 | 4631 | 4631 | 12878 | 78.3 | AGCCAGCCCACGCCATGCAA | 36 | 36 | 30 | 15 | 21 | 0 |
| 9265 | 4632 | 4632 | 12879 | 76.7 | AGCCAGCCGACCCAGCAGGA | 36 | 36 | 32 | 31 | 25 | 0 |
| 9266 | 4633 | 4633 | 12880 | 74.1 | AGCCAGCCGGACGGTAATCG | 36 | 36 | 34 | 18 | 24 | 0 |

FIG. 35A

```
/* ANSI C code for ZIP-HYB3

The program compiled with this code must be copied
    into the same directory as the the input files.
    A minor inconvenience, but it avoids headaches.
    This is part of making the program "platform-
    independent." It should be possible to compile it
    with any ANSI C compiler.
*/ include <stdio.h>
include <stdlib.h>
#include <conio.h>
#include <ctype.h>
#include <math.h>
include <string.h> define FMax 60
define NMax 20
#define LMax 40
#define MisMax 10
/*
    FMax: maximum length of input and output file names
    NMax: maximum length of a sequence name (no spaces allowed)
    LMax: maximum length of a sequence (in nucleotides)
    MisMax: maximum number of mismatches allowed
*/

FILE *ifl1;   /* input file #1 (not the name!) */
FILE *ifl2;   /* input file #2 (not the name!) */
FILE *ofl;    /* output file (not the name!)   */

/* start global variables */
int badval;   /* general use for variable checking */
int check;    /* general use boolean character */
long tval;    /* general use for assignment of variable values */
char keychar; /* general use for keyboard character checking */
```

FIG. 35B

```
char filechar;    /* general use for reading file characters */
char strng[10];   /* general use for variable checking */
char inm1[FMax];  /* input file #1 name; maximum of FMax characters */
char inm2[FMax];  /* input file #2 name; maximum of Fmax characters */
char onm[FMax];   /* output file name; maximum of Fmax characters */

/*
        Note: sequences (and their names) will not all be stored
        in memory. This allows for "unlimited" file sizes.
    */ char seqname[2][NMax]; /* name of current sequence from input files */
char sequence[2][LMax]; /* actual current sequence from input files */ int mmax=24;  /* Setting the maximum threshold for a match to 24 */
int Nmatch=6; /* Number of sites that must match; default=6 */
long Totalcomp=0; /* Number of comparisons made */
long Totalmatch=0; /* Number of comparisons meeting match criteria */
int nmax=NMax; /* setting value of nmax for functions */
int lmax=Lmax; /* setting value of lmax for functions */
int Nmisallow=0; /* setting default value for number of misses allowed */
int mismax=MisMax; /* setting max number of mismatches allowed/*
int Nmatcharray[LMax][MisMax+1]; /* records number of matches of each
length */ char seqbase[16]={'A','G','C','T','U','R','Y','M',
                  'K','S','W','H','B','V','D','N'};
    /* array of allowable base characters
        (arranged in the most efficient order for basechecking loops):
        seqbase[0] = A
                1 = G
                2 = C
                3 = T
                4 = U
                5 = R (A or G)
                6 = Y (C, T or U)
                7 = M (A or C)
                8 = K (G, T or U)
```

REPLACEMENT SHEET    Title: Method of Designing Addressable Array...
                     Inventor: Francis Barany et al.
                     Serial No.: 10/257,158

/*A G C T U R Y M K S W H B V D N*/
int basematch[16][16]={1,0,0,0,0,1,0,1,0,0,1,1,0,1,1,1,
                       0,1,0,0,0,1,0,0,1,1,0,0,1,1,1,1,
                       0,0,1,0,0,0,1,1,0,1,0,1,1,1,0,1,
                       0,0,0,1,1,0,1,0,1,0,1,1,1,0,1,1,
                       0,0,0,1,1,0,1,0,1,0,1,1,1,0,1,1,
                       1,1,0,0,0,1,0,1,1,1,1,1,1,1,1,1,
                       0,0,1,1,1,0,1,1,1,1,1,1,1,1,1,1,
                       1,0,1,0,0,1,1,1,0,1,1,1,1,1,1,1,
                       0,1,0,1,1,1,1,0,1,1,1,1,1,1,1,1,
                       0,1,1,0,0,1,1,1,1,0,1,1,1,1,1,1,
                       1,0,0,1,1,1,1,1,1,0,1,1,1,1,1,1,
                       1,0,1,1,1,1,1,1,1,1,1,1,1,1,1,1,
                       0,1,1,1,1,1,1,1,1,1,1,1,1,1,1,1,
                       1,1,1,0,0,1,1,1,1,1,1,1,1,1,1,1,
                       1,1,0,1,1,1,1,1,1,1,1,1,1,1,1,1,
                       1,1,1,1,1,1,1,1,1,1,1,1,1,1,1,1};
  /*
        This 16 x 16 array includes all possible comparisons.
        T and U are treated as if they are the same base
  */

/* end global variables */

/* start prototypes */
void GIVEUP(void);  /* called when user decides to quit */
void INTCHK(void);  /* called to see that keyboard input is a valid
integer */
void INFILE1(void); /* called to get name of input file #1 */
```

FIG. 35D

```
void INFILE2(void);  /* called to get name of input file #2 */
void OUTFILE(void);  /* called to get name of output file */
void NOTICE(void);   /* provides some warning to the user */
void START(void);    /* first segment of program; user enters various stuff
*/
void COMPARE(void);  /* second segment of program; compares the sequences
*/
void FINISH(void);   /* final segment of program; doesn't do much */
/* end prototypes */ void GIVEUP(void)
{    printf("ZIP-HYB4 halted.\n"); exit(0); } void INTCHK(void)
{
    int i;
    badval=0;
    if(strng[0]!='\0')
    {
        for(i=0;strng[i]!='\0';i++)
            if(isdigit(strng[i])==0) { badval=1; break; }
    }
    else badval=1;
} void INFILE1(void)
{
    check=0;
    while(!check) /* loops until a valid file name is given or user quits */
    {
        printf("Name of input file #1: ");
        gets(inm1);     /* gets file #1 name from keyboard */
        ifl1=fopen(inm1,"r"); /* attempts to open file #1 as "read-only" */
        if(ifl1==NULL) /* means no file could be opened with that name
*/
        {
```

FIG. 35E

```
                printf("\aPROBLEM OPENING THE FILE %s.\n",inm1);
                printf("THE FILE MAY NOT EXIST.\n");
                printf("TYPE ""Q"" TO QUIT.\n");
                printf("OR TYPE ANY OTHER KEY TO CONTINUE");
                keychar=toupper(getch()); printf("\n\n");
                if(keychar=='Q') GIVEUP();  /* if "Q" is typed, program
ends */
                check=0; /* loop not allowed to end if "Q" is not typed */
            }
            else  /* means file #1 could be opened; loop can now end */
            {
                fclose(ifl1); check=1;
            }
        }
} void INFILE2(void)  /* see INFILE1() above for notes */
{
    check=0;
    while(!check)
    {
        printf("Name of input file #2: "); gets(inm2);
ifl2=fopen(inm2,'r');
        if(ifl2==NULL)
        {
            printf("\aPROBLEM OPENING THE FILE %s.\n",inm2);
            printf("THE FILE MAY NOT EXIST.\n");
            printf("TYPE ""Q"" TO QUIT.\n");
            printf("OR TYPE ANY OTHER KEY TO CONTINUE");
            keychar=toupper(getch()); printf("\n\n");
            if(keychar=='Q') GIVEUP(); check=0;
        }
        else { fclose(ifl2); check=1; }
    }
} void OUTFILE(void)
{
```

FIG. 35F

```
    check=0;
    while(!check) /* loops until an unused file name is given */
    {
        printf("Name of output file: ");
        gets(onm);       /* gets output file name from keyboard */
        ofl=fopen(onm,"r"); /* attempts to open output file as "read-
only" */
        if(ofl) /* means there was already a file with that name */
        {
            printf("\aTHE FILE %s ALREADY EXISTS.  Try
again.\a\n\n",onm);
            fclose(ofl);
        }
        else check=1; /* means file name was not used, so loop can end
*/
    }
} void NOTICE(void)
{
    int noticecont=1;

printf("This program is used to compare sequences from one\n");
    printf("file to sequences from another.  There are two
parameters:\n");
    printf("  (1) minimum number of matches (M) and\n");
    printf("  (2) maximum number of mismatches (X).\n\n");
    printf("The output shows all comparisons that satisfy the\n");
    printf("conditions of a positive match -- i.e., at least\n");
    printf("M out of M+X bases matching.\n\n");
    printf("This is an important warning!\n");
    printf("  If you set X to a value other than 0, you may\n");
    printf("  miss some \"perfect\" matches.  For example, a\n");
    printf("  \"6 out of 6\" match may be reported as a \"7 out of
8\"\n");
    printf("  match if you allow 1 or more mismatches.  For this
reason\n");
    printf("  it is suggested that analyses be performed with
```

FIG. 35G

```
varying\n");
    printf("  stringency.\n\n");
    printf("*****************************************\n");
    printf("* TYPE 'S' TO START THE ANALYSIS,  *\n");
    printf("*     TYPE 'Q' TO QUIT,            *\n");
    printf("* OR TYPE ANY OTHER KEY TO CONTINUE *\n");
    printf("*     WITH THE INTRODUCTION.       *\n");
    printf("*****************************************\n");
    keychar=toupper(getch());
    if(keychar=='S') noticecont=0;
    if(keychar=='Q') GIVEUP();
    if(noticecont)
    {
        printf("\n\nThe input files should have the following format:\n");
        printf("(1) There should be no empty lines;\n");
        printf("(2) Each line should begin with a sequence name;\n");
        printf("(3) Each sequence name should be followed by a\n");
        printf("    single space, followed immediately by the sequence.\n");
        printf("    A \'*\' symbol should be typed at the end of each\n");
        printf("    sequence, followed by a hard return.\n");
        printf("(4) The final line of each input file should be a\n");
        printf("    single \'#\' sign, followed ideally by a hard return.\n\n");

printf("*************************************************\n");
        printf("*       TYPE 'Q' TO QUIT              *\n");
        printf("* OR TYPE ANY OTHER KEY TO START THE ANALYSIS. *\n");

printf("*************************************************\n");
        keychar=toupper(getch()); if(keychar=='Q') GIVEUP();
    }
} void START(void)
{
```

*FIG. 35H*

```
    int StepM=0;  /* boolean: change number of sites to match;
default=false */
    int StepX=0;  /* boolean: change number of mismatches allowed;
def=false*/
    int StepI1=1; /* boolean: change choice of input file #1;
default=true */
    int StepI2=1; /* boolean: change choice of input file #2;
default=true */
    int StepO=1;  /* boolean: change name of output file; default=true
*/
    char chng;    /* keyboard character read at prompt */

/*
        Entire function is a 'do while' menu loop. Loop ends when the
        user types "G" for "Go!" Otherwise, some of the program
settings
        can be changed.
    */ printf("ZIP-HYB3 by RM Kliman and R Favis (1999)\n\n");
    do
    {
        if(StepI1) { StepI1=0; INFILE1(); } /* choose new input file #1
*/ if(StepI2) { StepI2=0; INFILE2(); } /* choose new input file #2
*/ if(StepO) { StepO=0; OUTFILE(); }   /* rename the output file
*/ while(StepM)  /* if this value is to be changed, loop
continues
                                    until a valid value is entered */
        {
            printf("\nNumber of sites that must match [2-%i]:
",MMax);
            gets(strng); /* gets keyboard input */
            INTCHK();    /* checks to see if keyboard input is an
integer */
```

FIG. 35I

```
        if(!badval) /* if keyboard input is good, it is used
                              and StepS is set to "false" */
        {
                tval=atol(strng); /* conversion from string to
integer */
                if(tval>1 && tval<MMax+1) /* makes sure value is in
range */
                {
                        StepM=0;       /* if value is in range, loop
can end */
                        Nmatch=(int)tval; /* if value is in range,
assign value */
                }
        }
        if(StepM) printf("\a\n\Bad value.  Try again.\n");
    } while(StepX)   /* if this value is to be changed, loop
continues
                           until a valid value is entered */
    {
        printf("\nNumber of mismatches allowed [0-%i]:
",mismax);
        gets(strng);
        INTCHK();
        if(!badval)
        {
                tval=atol(strng); /* conversion from string to
integer */
                if(tval<mismax+1) /* makes sure value is in range
*/
                {
                        StepX=0;       /* if value is in range, loop
can end */
                        Nmisallow=(int)tval; /* if value is in range,
assign value */
                }
        }
```

FIG. 35J

```c
            if(StepX) printf("\a\n\Bad value.  Try again.\n");
        } printf("\n1 Input file 1: %s\n",inm1);
        printf("2 Input file 2: %s\n",inm2);
        printf("O Output file: %s\n",onm);
        printf("M Number of sites that must match: %i\n",Nmatch);
        printf("X Number of mismatches allowed:
%i\n\n",Nmisallow);
        printf("Type the letter or number associated with the\n");
        printf("menu item you wish to change.\n");
        printf("Type \'G\' to run the simulation.\n");
        check=0;
        while(!check) /* seeing if a valid menu choice is made */
        {
            chng=toupper(getch());
            switch(chng)
            {
                case '1': case '2': case 'O': case 'M': case 'X':
                case 'G':
                {check=1; break;}
                default:
                    printf("\a");
            }
        }

/*
        If one of the menu choices is made, loop repeats and the
        boolean value for the choice is set to 1 (i.e., true)
        */
        if(chng=='1') StepI1=1; if(chng=='2') StepI2=1;
        if(chng=='O') StepO=1;   if(chng=='M') StepM=1;
        if(chng=='X') StepX=1;
    }
    while(chng!='G');
} void COMPARE(void)
```

FIG. 35K

```c
{
    int a,b,c,d,n;
    int compsize; /* size of region compared in a given loop */
    int mismatchcount; /* number of mismatches occuring in loop */
    int Nmismatch; /* number of mismatches in a comparison */
    int stopcompare=0; /* boolean: end compare loop when '#' found in both */
    int endfile2; /* boolean: end inner loop when '#' found in file #2 */
    int spacepos; /* position of space b/n seqname and sequence */
    int file1cont,file2cont; /* boolean: keeps file reads going */
    int Matchcheck; /* boolean: did the comparison find a match? */
    int Matchsize; /* size of longest match */
    int Matchstart[2]; /* start of match in each sequence */
    int Matchdiff; /* difference in start positions of match */
    int foundmatch; /* boolean: 1 if at least 1 match is found */
    int seqsize[2]; /* lengths of two sequences being compared */
    int seqnamesize[2]; /* lengths of names of the sequences being compared */
    int matcharray[LMax]; /* used to identify mismatches in matched region */
    int nuc[2]; /* holds seqbase values of nucleotides being compared */
    char buffer[2][NMax+LMax+2]; /* allowed to read a line from each input file */
    int thismismatch; /* used in summary output */ for(a=0;a<LMax;a++) for(b=0;b<MisMax;b++)
        Nmatcharray[a][b]=0; /* initializes array */
    foundmatch=0; /* initially no matches are found */
    ofl=fopen(onm,'w'); /* open output file as "read-write" */
    fprintf(ofl,"Output from ZIP-HYB3 Beta version (RM Kliman & R Favis, 1999)\n\n");
    fprintf(ofl,"Input file 1: %s\n",inm1);
    fprintf(ofl,"Input file 2: %s\n",inm2);
    fprintf(ofl,"Minimum number of sites that must match: %i\n",Nmatch);
    fprintf(ofl,"Maximum number of mismatches allowed: %i\n\n",Nmisallow);
```

FIG. 35L

```
ifl1=fopen(inm1,"r"); /* open input file #1 as "read-only" */

/* start of comparison loop */
while(!stopcompare)
{
    file1cont=1;
    for(a=0;a<NMax;a++) seqname[0][a]=' ';
    for(a=0;a<LMax;a++) sequence[0][a]=' ';
    a=0;
    fgets(buffer[0],NMax+LMax+2,ifl1);
    if(buffer[0][0]=='#')
    {
        stopcompare=1;
        file1cont=0;
    }
    filechar='.'; /* just to make certain it's not a space */
    a=0;
    if(file1cont)
    {
        seqnamesize[0]=0;
        while(filechar!=' ') /* this is why filechar was set to
'.' */
        {
            filechar=buffer[0][a];
            if(filechar!=' ')
            {
                seqname[0][a]=filechar;
                seqnamesize[0]++;
            }
            a++;
        }
        seqname[0][a-1]='\0';

spacepos=a; seqsize[0]=0;
        while(!isalpha(filechar))
        {
            filechar=buffer[0][a];
            if(!isalpha(filechar)) a++;
```

FIG. 35M

```
}
while(isalpha(filechar))
{
    filechar=buffer[0][a];
    if(isalpha(filechar))
    {
        sequence[0][a-spacepos]=filechar;
        seqsize[0]++;
        a++;
    }
}
sequence[0][a-spacepos]='\0';

ifl2=fopen(inm2,"r"); /* re-open input file #2 as "read-only" */
endfile2=0;
file2cont=1;
while(!endfile2)
{
    for(b=0;b<NMax;b++) seqname[1][b]=' ';
    for(b=0;b<LMax;b++) sequence[1][b]=' ';
    b=0;
    fgets(buffer[1],NMax+LMax+2,ifl2);
    if(buffer[1][0]=='#')
    {
        endfile2=1;
        file2cont=0;
    }
    if(file2cont==1)
    {
        seqnamesize[1]=0;
        while(filechar!=' ')
        {
            filechar=buffer[1][b];
            if(filechar!=' ')
            {
                seqname[1][b]=filechar;
```

FIG. 35N

```
                        seqnamesize[1]++;
                }
                b++;
        } spacepos=b; seqsize[1]=0;
        while(!isalpha(filechar))
        {
                filechar=buffer[1][b];
                if(filechar!='*')
                {
                        sequence[1][b-spacepos]=filechar;
                        seqsize[1]++;
                }
                b++;
        }

/* start of comparison algorithm */
        Totalcomp++;
        Matchsize=0;

for(compsize=Nmatch+Nmisallow;compsize<=seqsize[1];compsize++)
        {
                for(b=0;b<1+seqsize[0]-compsize;b++)
                /* b is comparison start position in sequence[0] */
                {
                        for(c=0;c<1+seqsize[1]-compsize;c++)
                        /* c is comparison start position in sequence[1] */
                        {
                                mismatchcount=0;
                                for(d=0;d<compsize;d++)
                                {
                                        Matchcheck=1;

/* identify the
```

FIG. 35O

```
          sequence characters */ if(toupper(sequence[1][c+d])

==seqbase[n])

break;

if(!basematch[nuc[0]][nuc[1]])

if(mismatchcount>Nmisallow | d==0)

mismatch is at the 5' end sequence, the loop is automatically halted.

Matchcheck=0;

Nmismatch=mismatchcount;
Nmismatch;
```

```
                    for(n=0;n<16;n++)

{
                              nuc[1]=n;
                         }

/* check for mismatch */

{
                              mismatchcount++;

/*    if the
                               of the

*/
                         { break;
                         }
                    }
               }
               if(Matchcheck)
               {

Matchsize=compsize-
```

*FIG. 35P*

```
                                Matchstart[0]=b;
                                Matchstart[1]=c;
                            }
                        }
                    }
                    if(Matchsize+Nmismatch<compsize)
break;
                }
                if(Matchsize)
                {
                    if(Nmismatch)
                    /*
                        this loop decreases the size of the
matched
                        region if the downstream bases do
not match.
                        Both the size of the matched region
and the
                        number of mismatches are
decremented.
                    */
                    {
                        check=1;
                        while(check)
                        {
                            for(b=0;b<2;b++)
for(n=0;n<16;n++)

if(toupper(sequence[b][Matchstart[b]

+Matchsize+Nmismatch-1])
                                        ==seqbase[n])
                                {
                                    nuc[b]=n; break;
                                }
                            if(Nmismatch &&
!basematch[nuc[0]][nuc[1]])
```

*FIG. 35Q*

```
                                    Nmismatch--;
                        else check=0;
                }
        }

Nmatcharray[Matchsize-1][Nmismatch]++;
        foundmatch=1;
        if(Matchstart[0]>Matchstart[1])
                Matchdiff=Matchstart[0]-
Matchstart[1];
        else Matchdiff=Matchstart[1]-
Matchstart[0];

for(b=0;b<Matchsize+Nmismatch;b++)
        {
                for(c=0;c<2;c++) for(n=0;n<16;n++)
        if(toupper(sequence[c][b+Matchstart[c]])
                                ==seqbase[n])
                        {
                                nuc[c]=n; break;
                        }
                if(basematch[nuc[0]][nuc[1]])
matcharray[b]=1;
                else matcharray[b]=0;
        }
        /*if(Matchsize<10) fprintf(ofl," ");*/
        fprintf(ofl,"%2i out of ",Matchsize);
        /*if(Matchsize+Nmismatch<10)
fprintf(ofl," ");*/
        fprintf(ofl,"%2i
",Matchsize+Nmismatch);
        for(b=0;b<2;b++)
        {
                if(b) fprintf(ofl,"              ");
                for(c=0;c<seqnamesize[b];c++)
```

REPLACEMENT SHEET   Title: Method of Designing Addressable Array...
Inventor: Francis Barany et al.
Serial No.: 10/257,158

250/253                                   FIG. 35R

```
    fprintf(ofl,"%c",seqname[b][c]);
                            for(c=0;c<(nmax-
seqnamesize[b]);c++)
                                fprintf(ofl," ");
                            if((Matchstart[0]>Matchstart[1]
&& b)
                                |
(Matchstart[1]>Matchstart[0] && !b))
                                for(c=0;c<Matchdiff;c++)
fprintf(ofl," ");

for(c=0;c<seqsize[b];c++)
                            {
                                filechar=sequence[b][c];
                                if(c==Matchstart[b])
fprintf(ofl,"(");
                                if(c>=Matchstart[b]
                                    &&
c<Matchstart[b]+Matchsize+Nmismatch
                                    && matcharray[c-
Matchstart[b]])

fprintf(ofl,"%c",toupper(filechar));
                                else
fprintf(ofl,"%c",tolower(filechar));

if(c==Matchstart[b]+Matchsize+Nmismatch-1)
                                    fprintf(ofl,")");
                            }
                            fprintf(ofl,"\n");
                        }
                        fprintf(ofl,"\n");
                    }
                    /* end of comparison algorithm */
                }
            }
            /* end of reading file #2 */
            fclose(if12);
```

FIG. 35S

```
        }
}
/* end of comparison loop */
fprintf(ofl,"SUMMARY OF ANALYSIS\n");
printf    ("\nSUMMARY OF ANALYSIS\n");
if(!foundmatch)
{
    fprintf(ofl,"No matches found.");
    printf      ("No matches found.");
}
else
{
    for(b=0;b<=Nmisallow;b++)
    {
        thismismatch=1;
        for(a=LMax-1;a>=0;a--) if(Nmatcharray[a][b])
        {
            Totalmatch+=Nmatcharray[a][b];
            if(thismismatch)
            {
                thismismatch=0;
                fprintf(ofl,"\nComparisons with %i ",b);
                printf    ("\nComparisons with %i ",b);
                if(b==1)
                {
                    fprintf(ofl,"mismatch\n");
                    printf    ("mismatch\n");
                }
                else
                {
                    fprintf(ofl,"mismatches\n");
                    printf    ("mismatches\n");
                }
            }
            /*if(a<9) fprintf(ofl," ");*/
            fprintf(ofl," %2i out of ",a+1);
            printf    (" %2i out of ",a+1);
            /*if(a+b<9) fprintf(ofl," ");*/
```

*FIG. 35T*

```
                fprintf(ofl,"%2i bases matching: %i\n",
                    a+1+b,Nmatcharray[a][b]);
                printf   ("%2i bases matching: %i\n",
                    a+1+b,Nmatcharray[a][b]);
            }
        }
    }
    fprintf(ofl,"\nA total of %li out of ",Totalmatch);
    printf   ("\nA total of %li out of ",Totalmatch);
    fprintf(ofl,"%li sequence comparisons ",Totalcomp);
    printf   ("%li sequence comparisons ",Totalcomp);
    fprintf(ofl,"met the match criteria.");
    printf   ("met the match criteria.");
    fclose(ofl); fclose(ifl1); fclose(ifl2);
} void FINISH(void)
{
    printf("\n\nZIP-HYB3 done.\n"); /* writes to the screen that
program's done */
    printf("See file \"%s\" for details.\n",onm);
}

/* start main function */
int main()
{
    NOTICE();
    START();
    COMPARE();
    FINISH();
    return 0;
}
/* finish main function */
```

METHOD OF DESIGNING ADDRESSABLE ARRAY FOR DETECTION OF NUCLEIC ACID SEQUENCE DIFFERENCES USING LIGASE DETECTION REACTION

This application is a national stage entry of PCT/US01/10958, filed 4 Apr. 2001, which claims benefit of U.S. Provisional Application No. 60/197,271, filed 14 Apr. 2000.

This invention was developed with government funding under National Institutes of Health Grant Nos. GM-41337-06, GM43552-05, GM-42722-07, and GM-51628-02. The U.S. Government may have certain rights.

FIELD OF THE INVENTION

The present invention is directed to a method of designing a plurality of capture oligonucleotide probes for use on a support to which complementary oligonucleotide probes will hybridize with little mismatch, where the plural capture oligonucleotide probes have melting temperatures within a narrow range. Other aspects of the present invention relate to a support with the plurality of oligonucleotide probes immobilized on the support, a method of using the support to detect single-base changes, insertions, deletions, or translocations in a plurality of target nucleotide sequences, and a kit for such detection, which includes the support on which the oligonucleotides have been immobilized.

BACKGROUND OF THE INVENTION

Detection of Sequence Differences

Large-scale multiplex analysis of highly polymorphic loci is needed for practical identification of individuals, e.g., for paternity testing and in forensic science (Reynolds et al., *Anal. Chem.*, 63:2-15 (1991)), for organ-transplant donor-recipient matching (Buyse et al., *Tissue Antigens*, 41:1-14 (1993) and Gyllensten et al., *PCR Meth. Appl*, 1:91-98 (1991)), for genetic disease diagnosis, prognosis, and pre-natal counseling (Chamberlain et al., *Nucleic Acids Res.*, 16:11141-11156 (1988) and L. C. Tsui, *Human Mutat.*, 1:197-203 (1992)), and the study of oncogenic mutations (Hollstein et al., *Science*, 253:49-53 (1991)). In addition, the cost-effectiveness of infectious disease diagnosis by nucleic acid analysis varies directly with the multiplex scale in panel testing. Many of these applications depend on the discrimination of single-base differences at a multiplicity of sometimes closely space loci.

A variety of DNA hybridization techniques are available for detecting the presence of one or more selected polynucleotide sequences in a sample containing a large number of sequence regions. In a simple method, which relies on fragment capture and labeling, a fragment containing a selected sequence is captured by hybridization to an immobilized probe. The captured fragment can be labeled by hybridization to a second probe which contains a detectable reporter moiety.

Another widely used method is Southern blotting. In this method, a mixture of DNA fragments in a sample are fractionated by gel electrophoresis, then fixed on a nitrocellulose filter. By reacting the filter with one or more labeled probes under hybridization conditions, the presence of bands containing the probe sequence can be identified. The method is especially useful for identifying fragments in a restriction-enzyme DNA digest which contain a given probe sequence, and for analyzing restriction-fragment length polymorphisms ("RFLPs").

Another approach to detecting the presence of a given sequence or sequences in a polynucleotide sample involves selective amplification of the sequence(s) by polymerase chain reaction. U.S. Pat. No. 4,683,202 to Mullis, et al. and R. K. Saiki, et al., *Science* 230:1350 (1985). In this method, primers complementary to opposite end portions of the selected sequence(s) are used to promote, in conjunction with thermal cycling, successive rounds of primer-initiated replication. The amplified sequence may be readily identified by a variety of techniques. This approach is particularly useful for detecting the presence of low-copy sequences in a polynucleotide-containing sample, e.g., for detecting pathogen sequences in a body-fluid sample.

More recently, methods of identifying known target sequences by probe ligation methods have been reported. U.S. Pat. No. 4,883,750 to N. M. Whiteley, et al., D. Y. Wu, et al., *Genomics* 4:560 (1989), U. Landegren, et al., *Science* 241:1077 (1988), and E. Winn-Deen, et al., *Clin. Chem.* 37:1522 (1991). In one approach, known as oligonucleotide ligation assay ("OLA"), two probes or probe elements which span a target region of interest are hybridized with the target region. Where the probe elements match (basepair with) adjacent target bases at the confronting ends of the probe elements, the two elements can be joined by ligation, e.g., by treatment with ligase. The ligated probe element is then assayed, evidencing the presence of the target sequence.

In a modification of this approach, the ligated probe elements act as a template for a pair of complementary probe elements. With continued cycles of denaturation, hybridization, and ligation in the presence of the two complementary pairs of probe elements, the target sequence is amplified exponentially, i.e., exponentially allowing very small amounts of target sequence to be detected and/or amplified. This approach is referred to as ligase chain reaction ("LCR"). F. Barany, "Genetic Disease Detection and DNA Amplification Using Cloned Thermostable Ligase," *Proc. Nat'l Acad. Sci. USA*, 88:189-93 (1991) and F. Barany, "The Ligase Chain Reaction (LCR) in a PCR World," *PCR Methods and Applications*, 1:5-16 (1991).

Another scheme for multiplex detection of nucleic acid sequence differences is disclosed in U.S. Pat. No. 5,470,705 to Grossman et. al. where sequence-specific probes, having a detectable label and a distinctive ratio of charge/translational frictional drag, can be hybridized to a target and ligated together. This technique was used in Grossman, et. al., "High-density Multiplex Detection of Nucleic Acid Sequences: Oligonucleotide Ligation Assay and Sequence-coded Separation," *Nucl. Acids Res.* 22(21):4527-34 (1994) for the large scale multiplex analysis of the cystic fibrosis transmembrane regulator gene.

Jou, et. al., "Deletion Detection in Dystrophin Gene by Multiplex Gap Ligase Chain Reaction and Immunochromatographic Strip Technology," *Human Mutation* 5:86-93 (1995) relates to the use of a so called "gap ligase chain reaction" process to amplify simultaneously selected regions of multiple exons with the amplified products being read on an immunochromatographic strip having antibodies specific to the different haptens on the probes for each exon.

There is a growing need, e.g., in the field of genetic screening, for methods useful in detecting the presence or absence of each of a large number of sequences in a target polynucleotide. For example, as many as 400 different mutations have been associated with cystic fibrosis. In screening for genetic predisposition to this disease, it is optimal to test all of the possible different gene sequence mutations in the subject's genomic DNA, in order to make a positive identification of "cystic fibrosis". It would be ideal to test for the presence or absence of all of the possible mutation sites in a single assay. However, the prior-art methods described above are not readily adaptable for use in detecting multiple selected sequences in a convenient, automated single-assay format.

Solid-phase hybridization assays require multiple liquid-handling steps, and some incubation and wash temperatures must be carefully controlled to keep the stringency needed for single-nucleotide mismatch discrimination. Multiplexing of this approach has proven difficult as optimal hybridization conditions vary greatly among probe sequences.

Allele-specific PCR products generally have the same size, and a given amplification tube is scored by the presence or absence of the product band in the gel lane associated with each reaction tube. Gibbs et al., *Nucleic Acids Res.*, 17:2437-2448 (1989). This approach requires splitting the test sample among multiple reaction tubes with different primer combinations, multiplying assay cost. PCR has also discriminated alleles by attaching different fluorescent dyes to competing allelic primers in a single reaction tube (F. F. Chehab, et al., *Proc. Natl. Acad. Sci. USA*, 86:9178-9182 (1989)), but this route to multiplex analysis is limited in scale by the relatively few dyes which can be spectrally resolved in an economical manner with existing instrumentation and dye chemistry. The incorporation of bases modified with bulky side chains can be used to differentiate allelic PCR products by their electrophoretic mobility, but this method is limited by the successful incorporation of these modified bases by polymerase, and by the ability of electrophoresis to resolve relatively large PCR products which differ in size by only one of these groups. Livak et al., *Nucleic Acids Res.*, 20:4831-4837 (1989). Each PCR product is used to look for only a single mutation, making multiplexing difficult.

Ligation of allele-specific probes generally has used solid-phase capture (U. Landegren et al., *Science*, 241:1077-1080 (1988); Nickerson et al., *Proc. Natl. Acad. Sci. USA*, 87:8923-8927 (1990)) or size-dependent separation (D. Y. Wu, et al., *Genomics*, 4:560-569 (1989) and F. Barany, *Proc. Natl. Acad. Sci.*, 88:189-193 (1991)) to resolve the allelic signals, the latter method being limited in multiplex scale by the narrow size range of ligation probes. The gap ligase chain reaction process requires an additional step—polymerase extension. The use of probes with distinctive ratios of charge/translational frictional drag technique to a more complex multiplex will either require longer electrophoresis times or the use of an alternate form of detection.

The need thus remains for a rapid single assay format to detect the presence or absence of multiple selected sequences in a polynucleotide sample.

Use of Oligonucleotide Arrays for Nucleic Acid Analysis

Ordered arrays of oligonucleotides immobilized on a solid support have been proposed for sequencing, sorting, isolating, and manipulating DNA. It has been recognized that hybridization of a cloned single-stranded DNA molecule to all possible oligonucleotide probes of a given length can theoretically identify the corresponding complementary DNA segments present in the molecule. In such an array, each oligonucleotide probe is immobilized on a solid support at a different predetermined position. All the oligonucleotide segments in a DNA molecule can be surveyed with such an array.

One example of a procedure for sequencing DNA molecules using arrays of oligonucleotides is disclosed in U.S. Pat. No. 5,202,231 to Drmanac, et. al. This involves application of target DNA to a solid support to which a plurality of oligonucleotides are attached. Sequences are read by hybridization of segments of the target DNA to the oligonucleotides and assembly of overlapping segments of hybridized oligonucleotides. The array utilizes all possible oligonucleotides of a certain length between 11 and 20 nucleotides, but there is little information about how this array is constructed. See also A. B. Chetverin, et. al., "Sequencing of Pools of Nucleic Acids on Oligonucleotide Arrays," *BioSystems* 30:215-31 (1993); WO 92/16655 to Khrapko et. al.; Kuznetsova, et. al., "DNA Sequencing by Hybridization with Oligonucleotides Immobilized in Gel. Chemical Ligation as a Method of Expanding the Prospects for the Method," *Mol. Biol.* 28(20): 290-99(1994); M. A. Livits, et. al., "Dissociation of Duplexes Formed by Hybridization of DNA with Gel-Immobilized Oligonucleotides," *J. Biomolec. Struct. & Dynam.* 11(4):783-812 (1994).

WO 89/10977 to Southern discloses the use of a support carrying an array of oligonucleotides capable of undergoing a hybridization reaction for use in analyzing a nucleic acid sample for known point mutations, genomic fingerprinting, linkage analysis, and sequence determination. The matrix is formed by laying nucleotide bases in a selected pattern on the support. This reference indicates that a hydroxyl linker group can be applied to the support with the oligonucleotides being assembled by a pen plotter or by masking.

WO 94/11530 to Cantor also relates to the use of an oligonucleotide array to carry out a process of sequencing by hybridization. The oligonucleotides are duplexes having overhanging ends to which target nucleic acids bind and are then ligated to the non-overhanging portion of the duplex. The array is constructed by using streptavidin-coated filter paper which captures biotinylated oligonucleotides assembled before attachment.

WO 93/17126 to Chetverin uses sectioned, binary oligonucleotide arrays to sort and survey nucleic acids. These arrays have a constant nucleotide sequence attached to an adjacent variable nucleotide sequence, both bound to a solid support by a covalent linking moiety. The constant nucleotide sequence has a priming region to permit amplification by PCR of hybridized stands. Sorting is then carried out by hybridization to the variable region. Sequencing, isolating, sorting, and manipulating fragmented nucleic acids on these binary arrays are also disclosed. In one embodiment with enhanced sensitivity, the immobilized oligonucleotide has a shorter complementary region hybridized to it, leaving part of the oligonucleotide uncovered. The array is then subjected to hybridization conditions so that a complementary nucleic acid anneals to the immobilized oligonucleotide. DNA ligase is then used to join the shorter complementary region and the complementary nucleic acid on the array. There is little disclosure of how to prepare the arrays of oligonucleotides.

WO 92/10588 to Fodor et. al., discloses a process for sequencing, fingerprinting, and mapping nucleic acids by hybridization to an array of oligonucleotides. The array of oligonucleotides is prepared by a very large scale immobilized polymer synthesis which permits the synthesis of large, different oligonucleotides. In this procedure, the substrate surface is functionalized and provided with a linker group by which oligonucleotides are assembled on the substrate. The regions where oligonucleotides are attached have protective groups (on the substrate or individual nucleotide subunits) which are selectively activated. Generally, this involves imaging the array with light using a mask of varying configuration so that areas exposed are deprotected. Areas which have been deprotected undergo a chemical reaction with a protected nucleotide to extend the oligonucleotide sequence where imaged. A binary masking strategy can be used to build two or more arrays at a given time. Detection involves positional localization of the region where hybridization has taken place. See also U.S. Pat. Nos. 5,324,633 and 5,424,186 to Fodor et. al., U.S. Pat. Nos. 5,143,854 and 5,405,783 to Pirrung, et. al., WO 90/15070 to Pirrung, et. al., A. C. Pease, et. al., "Light-generated Oligonucleotide Arrays for Rapid DNA Sequence Analysis", *Proc. Natl. Acad. Sci USA* 91:5022-26 (1994). K. L. Beattie, et. al., "Advances in Genosensor Research," *Clin. Chem.* 41(5):700-09 (1995) discloses attachment of previously assembled oligonucleotide probes to a solid support.

There are many drawbacks to the procedures for sequencing by hybridization to such arrays. Firstly, a very large number of oligonucleotides must be synthesized. Secondly, there is poor discrimination between correctly hybridized, properly matched duplexes and those which are mismatched. Finally, certain oligonucleotides will be difficult to hybridize to under standard conditions, with such oligonucleotides being capable of identification only through extensive hybridization studies.

The present invention is directed toward overcoming these deficiencies in the art.

SUMMARY OF THE INVENTION

The present invention is directed to a method of designing a plurality of capture oligonucleotide probes for use on a support to which complementary oligonucleotide probes will hybridize with little mismatch, where the plural capture oligonucleotide probes have melting temperatures within a narrow range. The first step of the method involves providing a first set of a plurality of tetramers of four nucleotides linked together, where (1) each tetramer within the set differs from all other tetramers in the set by at least two nucleotide bases, (2) no two tetramers within a set are complementary to one another, (3) no tetramers within a set are palindromic or dinucleotide repeats, and (4) no tetramer within a set has one or less or three or more G or C nucleotides. Groups of 2 to 4 of the tetramers from the first set are linked together to form a collection of multimer units. From the collection of multimer units, all multimer units formed from the same tetramer and all multimer units having a melting temperature in ° C. of less than 4 times the number of tetramers forming a multimer unit are removed to form a modified collection of multimer units. The modified collection of multimer units is arranged in a list in order of melting temperature. The order of the modified collection of multimer units is randomized in 2° C. increments of melting temperature. Alternating multimer units in the list are then divided into first and second subcollections, each arranged in order of melting temperature. After the order of the second subcollection is inverted, the first collection is linked in order to the inverted second collection to form a collection of double multimer units. From the collection of double multimer units those units (1) having a melting temperature in ° C. less than 11 times the number of tetramers and more than 15 times the number of tetramers, (2) double multimer units with the same 3 tetramers linked together, and (3) double multimer units with the same 4 tetramers linked together with or without interruption are removed, to form a modified collection of double multimer units.

Another aspect of the present invention relates to an oligonucleotide array which includes a support and a collection of double multimer unit oligonucleotides at different positions on the support so that complementary oligonucleotides to be immobilized on the solid support can be captured at the different positions. The complementary oligonucleotides will hybridize, within a narrow temperature range of greater than 24° C. with little mismatch, to members of the collection of double multimer unit oligonucleotides, the double multimer unit oligonucleotides are formed from sets of tetramers where (1) each tetramer within the set differs from all other tetramers in the set by at least two nucleotide bases, (2) no two tetramers within a set are complementary to one another, and (3) no tetramers within a set are palindromic or dinucleotide repeats, and the collection of double multimer unit oligonucleotides has had the following oligonucleotides removed from it: (1) oligonucleotides having a melting temperature in ° C. less than 12.5 times the number of tetramers and more than 14 times the number of tetramers, (2) double multimer units with the same 3 tetramers linked together, and (3) multimer units with the same 4 tetramers linked together with or without interruption.

Yet another aspect of the present invention relates to a method for identifying one or more of a plurality of sequences differing by one or more single-base changes, insertions, deletions, or translocations in a plurality of target nucleotide sequences. This method involves providing a sample potentially containing one or more target nucleotide sequences with a plurality of sequence differences. A plurality of oligonucleotide probe sets are also provided with each set characterized by (a) a first oligonucleotide probe, having a target-specific portion and an addressable array-specific portion, and (b) a second oligonucleotide probe, having a target-specific portion and a detectable reporter label. The oligonucleotide probes in a particular set are suitable for ligation together when hybridized adjacent to one another on a corresponding target nucleotide sequence, but have a mismatch which interferes with such ligation when hybridized to any other nucleotide sequence present in the sample. A ligase is also provided with the sample, the plurality of oligonucleotide probe sets, and the ligase being blended to form a mixture. The mixture is subjected to one or more ligase detection reaction cycles comprising a denaturation treatment, where any hybridized oligonucleotides are separated from the target nucleotide sequences, and a hybridization treatment, where the oligonucleotide probe sets hybridize at adjacent positions in a base-specific manner to their respective target nucleotide sequences, if present in the sample, and ligate to one another to form a ligated product sequence containing (a) the addressable array-specific portion, (b) the target-specific portions connected together, and (c) the detectable reporter label. The oligonucleotide probe sets may hybridize to nucleotide sequences in the sample other than their respective target nucleotide sequences but do not ligate together due to a presence of one or more mismatches and individually separate during the denaturation treatment. A support is provided with different capture oligonucleotides immobilized at different positions, where the capture oligonucleotides have nucleotide sequences complementary to the addressable array-specific portions and are formed from a collection of double multimer unit oligonucleotides. The oligonucleotide with addressable array-specific portions will hybridize, within a narrow temperature range of more than 4 times the number of tetramers in the multimer unit with little mismatch, to members of the capture oligonuncleotides. The double multimer unit oligonucleotides are formed from sets of tetramers where (1) each tetramer within the set differs from all other tetramers in the set by at least two nucleotide bases, (2) no two tetramers within a set are complementary to one another, and (3) no tetramers within a set are palindromic or dinucleotide repeats. The collection of double multimer unit oligonucleotides has had the following oligonucleotides removed from it: (1) oligonucleotides having a melting temperature in ° C. of less than 11 times the number of tetramers and more than 15 times the number of tetramers, (2) double multimer units with the same 3 tetramers linked together, and (3) double multimer units with the same 4 tetramers linked together with or without interruption, to form a modified collection of double multimer units. After subjecting the mixture to one or more ligase detection reaction cycles, the mixture is contacted with the support under conditions effective to hybridize the addressable array-specific portions to the capture oligonucleotides in a base-specific manner, thereby capturing the addressable array-specific portions on the support at the site with the complementary capture oligonucleotide. The reporter labels of ligated product sequences captured on the support at particular sites are detected, indicating the presence of one or more target nucleotide sequences in the sample.

Another aspect of the present invention is directed to a kit for identifying one or more of a plurality of sequences differing by single-base changes, insertions, deletions, or translocations in a plurality of target nucleotide sequences. In addition, to a ligase, the kit includes a plurality oligonucleotide probe sets, each characterized by (a) a first oligonucleotide probe, having a target sequence-specific portion and an addressable array-specific portion, and (b) a second oligonucleotide probe, having a target sequence-specific portion and detectable reporter label, wherein the oligonucleotide probes in a particular set are suitable for ligation together when hybridized adjacent to one another on a respective target nucleotide sequence, but have a mismatch which interferes with such ligation when hybridized to any other nucleotide sequence, present in the sample. Also found in the kit is a support with different capture oligonucleotides immobilized at different positions, where the capture oligonucleotides have nucleotide sequences complementary to the addressable array-specific portions and are formed from a collection of double multimer unit oligonucleotides. The oligonucleotide with addressable array-specific portions will hybridize, within a narrow temperature range of greater than 4 times the number of tetramers in the multimer unit with little mismatch, to members of the capture oligonuncleotides. The double multimer unit oligonucleotides are formed from sets of tetramers where (1) each tetramer within the set differs from all other tetramers in the set by at least two nucleotide bases, (2) no two tetramers within a set are complementary to one another, and (3) no tetramers within a set are palindromic or dinucleotide repeats. The collection of double multimer unit oligonucleotides has had the following oligonucleotides removed from it: (1) oligonucleotides having a melting temperature in ° C. of less than 11 times the number of tetramers and more than 15 times then number of tetramers, (2) double multimer units with the same 3 tetramers linked together, and (3) double multimer units with the same 4 tetramers linked together with or without interruption, where the capture oligonucleotides have nucleotide sequences complementary to the addressable array-specific portions.

Another aspect of the present invention relates to a method to avoid synthesizing ligase detection reaction oligonucleotides that will inappropriately cross-hybridize to capture oligonucleotides on a solid support. This method includes comparing the ligase detection reaction oligonucleotides with the capture oligonucleotides and identifying any capture oligonucleotides likely to cross-hybridize to the ligase detection reaction oligonucleotides.

BRIEF DESCRIPTION OF THE DRAWINGS

FIG. 3 is a schematic diagram depicting a PCR/LDR process, according to the present invention, using addresses on the allele-specific probes for detecting homo- or heterozygosity at two polymorphisms (i.e. allele differences) on the same gene.

FIG. 5 is a schematic diagram depicting a PCR/LDR process, according to the present invention, using addresses on the allele-specific probes which distinguishes all possible bases at a given site.

FIG. 7 is a schematic diagram depicting a PCR/LDR process, according to the present invention, using addresses on the allele-specific probes for detecting the presence of any possible base at two nearby sites.

FIG. 9 is a schematic diagram of a PCR/LDR process, according to the present invention, using addresses on the allele-specific probes for distinguishing insertions and deletions.

FIG. 10 is a schematic diagram of a PCR/LDR process, according to the present invention, using addresses on the common probes for distinguishing insertions and deletions.

FIG. 11 is a schematic diagram of a PCR/LDR process, in accordance with the present invention, using addresses on the allele-specific probes to detect a low abundance mutation (within a codon) in the presence of an excess of normal sequence.

FIG. 12 is a schematic diagram of a PCR/LDR process, in accordance with the present invention, using addresses on the common probes to detect a low abundance mutation (within a codon) in the presence of an excess of normal sequence.

FIG. 13 is a schematic diagram of a PCR/LDR process, in accordance with the present invention, where the address is placed on the common probe and the allele differences are distinguished by different fluorescent signals F1, F2, F3, and F4.

FIG. 14 is a schematic diagram of a PCR/LDR process, in accordance with the present invention, where both adjacent and nearby alleles are detected.

FIG. 15 is a schematic diagram of a PCR/LDR process, in accordance with the present invention, where all possible single-base mutations for a single codon are detected.

FIGS. 17A-C show two alternative formats for oligonucleotide probe capture. In FIG. 17B, the addressable array-specific portions are on the allele-specific probe. Alleles are distinguished by capture of fluorescent signals on addresses Z1 and Z2, respectively. In FIG. 17C, the addressable array-specific portions are on the common probe and alleles are distinguished by capture of fluorescent signals F1 and F2, which correspond to the two alleles, respectively.

FIG. 18 shows the chemical reactions for covalent modifications, grafting, oligomer attachments to solid supports.

FIG. 19 shows a design in accordance with the present invention using 36 tetramers differing by at least 2 bases, which can be used to create a series of unique 24-mers.

FIG. 20 shows an outline of the PCR/PCR/LDR method for detection of mutations in BRCA1 and BRCA2.

FIG. 22 shows an outline of multiplex LDR detection of 3 specific mutations in BRCA1 and BRCA2 using an universal DNA microarray.

FIG. 23A-H show the LDR detection of 3 specific mutations in BRCA1 and BRCA2 on an addressable universal microarray.

FIGS. 25A-25MMMM show a list of 4633 capture oligonucleotides (SEQ ID NOS: 1-4633) produced in accordance with the present invention. One of ordinary skill in the art can readily envision the complementary oligonucleotides corresponding to the capture oligonucleotides listed in FIGS. 25A-25MMMM.

FIGS. 26A-26J show a list of 465 capture oligonucleotides (SEQ ID NOS: 1-465) produced in accordance with the present invention. One of ordinary skill in the art can readily envision the complementary oligonucleotides corresponding to the capture oligonucleotides listed in FIGS. 26A-26J.

FIGS. 27A-27B show a list of 96 capture oligonucleotides (SEQ ID NOS: 1-96) produced in accordance with the present invention. One of ordinary skill in the art can readily envision the complementary oligonucleotides corresponding to the capture oligonucleotides listed in FIGS. 27A-27B.

FIGS. 28A-28B show a list of 65 capture oligonucleotides (SEQ ID NOS: 1-65) produced in accordance with the present invention. One of ordinary skill in the art can readily envision the complementary oligonucleotides corresponding to the capture oligonucleotides listed in FIGS. 28A-28B.

FIGS. 29A-29SSSS show a list of 4633 capture oligonucleotides (SEQ ID NOS: 4634-9266) (in the form of 20 mer PNAs) produced in accordance with the present invention.

FIG. 35 sets forth a computer program for comparing a target sequence with an array capture probe to insure that the latter will be designed not to hybridize to the former.

DETAILED DESCRIPTION OF THE INVENTION AND DRAWINGS

Figure 1:
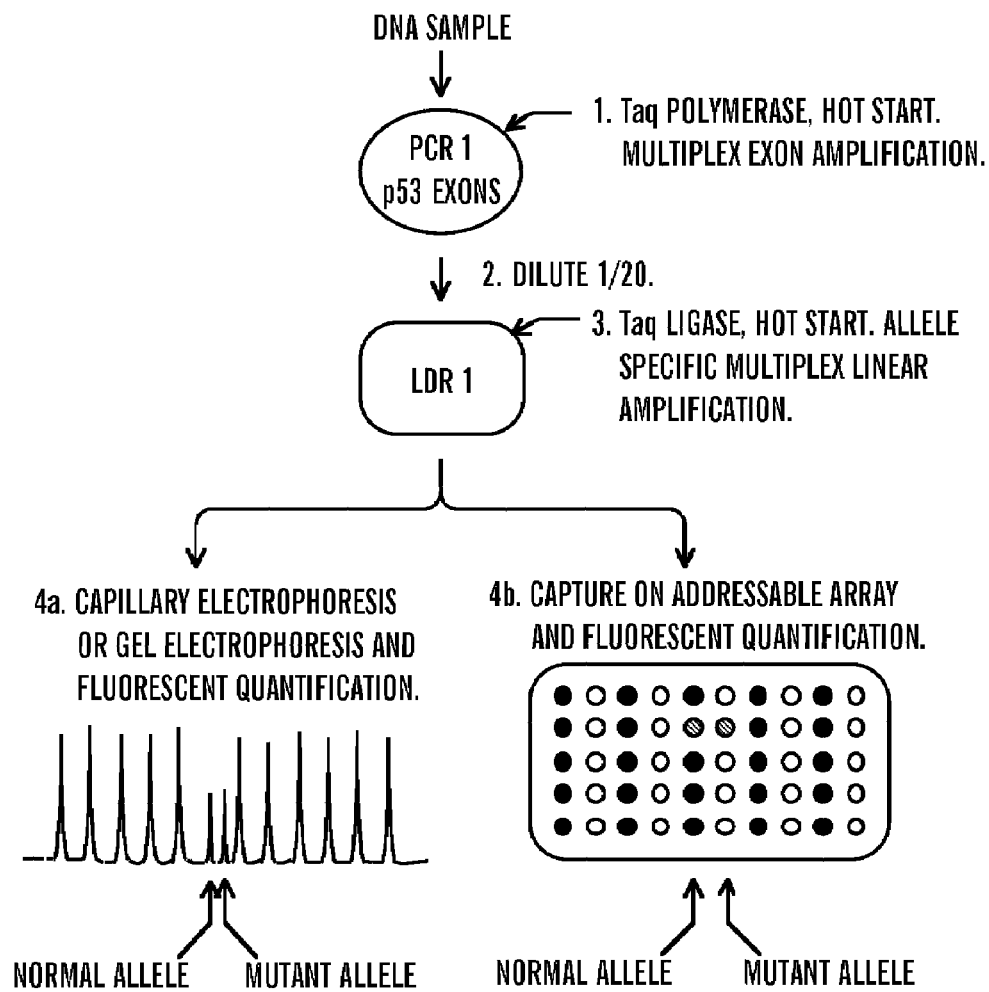
FIG. 1 is a flow diagram depicting polymerase chain reaction ("PCR")/ligase detection reaction ("LDR") processes, according to the prior art and the present invention, for detection of germline mutations, such as point mutations.

The present invention is directed to a method of designing a plurality of capture oligonucleotide probes for use on a support to which complementary oligonucleotide probes will hybridize with little mismatch, where the plural capture oligonucleotide probes have melting temperatures within a narrow range. The first step of the method involves providing a first set of a plurality of tetramers of four nucleotides linked together, where (1) each tetramer within the set differs from all other tetramers in the set by at least two nucleotide bases, (2) no two tetramers within a set are complementary to one another, (3) no tetramers within a set are palindromic or dinucleotide repeats, and (4) no tetramer within a set has one or less or three or more G or C nucleotides. Groups of 2 to 4 of the tetramers from the first set are linked together to form a collection of multimer units. From the collection of multimer units, all multimer units formed from the same tetramer and all multimer units having a melting temperature in ° C. of less than 4 times the number of tetramers forming a multimer unit are removed to form a modified collection of multimer units. The modified collection of multimer units is arranged in a list in order of melting temperature. The order of the modified collection of multimer units is randomized in 2° C. increments of melting temperature. Alternating multimer units in the list are then divided into first and second subcollections, each arranged in order of melting temperature. After the order of the second subcollection is inverted, the first collection is linked in order to the inverted second collection to form a collection of double multimer units. From the collection of double multimer units, those units (1) having a melting temperature in ° C. less than 11 times the number of tetramers and more than 15 times the number of tetramers, (2) double multimer units with the same 3 tetramers linked together, and (3) double multimer units with the same 4 tetramers linked together with or without interruption are removed, to form a modified collection of double multimer units.

Another aspect of the present invention relates to an oligonucleotide array which includes a support and a collection of double multimer unit oligonucleotides at different positions on the support so that complementary oligonucleotides to be immobilized on the solid support can be captured at the different positions. The complementary oligonucleotides will hybridize, within a narrow temperature range of greater than 24° C. with little mismatch, to members of the collection of double multimer unit oligonucleotides, the double multimer unit oligonucleotides are formed from sets of tetramers where (1) each tetramer within the set differs from all other tetramers in the set by at least two nucleotide bases, (2) no two tetramers within a set are complementary to one another, and (3) no tetramers within a set are palindromic or dinucleotide repeats, and the collection of double multimer unit oligonucleotides has had the following oligonucleotides removed from it: (1) oligonucleotides having a melting temperature in ° C. less than 12.5 times the number of tetramers and more than 14 times the number of tetramers, (2) double multimer units with the same 3 tetramers linked together, and (3) multimer units with the same 4 tetramers linked together with or without interruption.

Yet another aspect of the present invention relates to a method for identifying one or more of a plurality of sequences differing by one or more single-base changes, insertions, deletions, or translocations in a plurality of target nucleotide sequences. This method involves providing a sample potentially containing one or more target nucleotide sequences with a plurality of sequence differences. A plurality of oligonucleotide probe sets are also provided with each set characterized by (a) a first oligonucleotide probe, having a target-specific portion and an addressable array-specific portion, and (b) a second oligonucleotide probe, having a target-specific portion and a detectable reporter label. The oligonucleotide probes in a particular set are suitable for ligation together when hybridized adjacent to one another on a corresponding target nucleotide sequence, but have a mismatch which interferes with such ligation when hybridized to any other nucleotide sequence present in the sample. A ligase is also provided with the sample, the plurality of oligonucleotide probe sets, and the ligase being blended to form a mixture. The mixture is subjected to one or more ligase detection reaction cycles comprising a denaturation treatment, where any hybridized oligonucleotides are separated from the target nucleotide sequences, and a hybridization treatment, where the oligonucleotide probe sets hybridize at adjacent positions in a base-specific manner to their respective target nucleotide sequences, if present in the sample, and ligate to one another to form a ligated product sequence containing (a) the addressable array-specific portion, (b) the target-specific portions connected together, and (c) the detectable reporter label. The oligonucleotide probe sets may hybridize to nucleotide sequences in the sample other than their respective target nucleotide sequences but do not ligate together due to a presence of one or more mismatches and individually separate during the denaturation treatment. A support is provided with capture oligonucleotides immobilized at different positions, where the capture oligonucleotides have nucleotide sequences complementary to the addressable array-specific portions and are formed from a collection of double multimer unit oligonucleotides. The oligonucleotide with addressable array-specific portions will hybridize, within a narrow temperature range of more than 4 times the number of tetramers in the multimer unit with little mismatch, to members of the capture oligonuncleotides. The double multimer unit oligonucleotides are formed from sets of tetramers where (1) each tetramer within the set differs from all other tetramers in the set by at least two nucleotide bases, (2) no two tetramers within a set are complementary to one another, and (3) no tetramers within a set are palindromic or dinucleotide repeats. The collection of double multimer unit oligonucleotides has had the following oligonucleotides removed from it: (1) oligonucleotides having a melting temperature in ° C. of less than 11 times the number of tetramers and more than 15 times the number of tetramers, (2) double multimer units with the same 3 tetramers linked together, and (3) double multimer units with the same 4 tetramers linked together with or without interruption, to form a modified collection of double multimer units. After subjecting the mixture to one or more ligase detection reaction cycles, the mixture is contacted with the support under conditions effective to hybridize the addressable array-specific portions to the capture oligonucleotides in a base-specific manner, thereby capturing the addressable array-specific portions on the support at the site with the complementary capture oligonucleotide. The reporter labels of ligated product sequences captured on the support at particular sites are detected, indicating the presence of one or more target nucleotide sequences in the sample.

Another aspect of the present invention is directed to a kit for identifying one or more of a plurality of sequences differing by single-base changes, insertions, deletions, or translocations in a plurality of target nucleotide sequences. In addition, to a ligase, the kit includes a plurality oligonucleotide probe sets, each characterized by (a) a first oligonucleotide probe, having a target sequence-specific portion and an addressable array-specific portion, and (b) a second oligonucleotide probe, having a target sequence-specific portion and detectable reporter label, wherein the oligonucleotide probes in a particular set are suitable for ligation together when hybridized adjacent to one another on a respective target nucleotide sequence, but have a mismatch which interferes with such ligation when hybridized to any other nucleotide sequence, present in the sample. Also found in the kit is a support with different capture oligonucleotides immobilized at different positions, where the capture oligonucleotides have nucleotide sequences complementary to the addressable array-specific portions and are formed from a collection of double multimer unit oligonucleotides. The oligonucleotide with addressable array-specific portions will hybridize, within a narrow temperature range of greater than 4 times the number of tetramers in the multimer unit with little mismatch, to members of the capture oligonuncleotides. The double multimer unit oligonucleotides are formed from sets of tetramers where (1) each tetramer within the set differs from all other tetramers in the set by at least two nucleotide bases, (2) no two tetramers within a set are complementary to one another, and (3) no tetramers within a set are palindromic or dinucleotide repeats. The collection of double multimer unit oligonucleotides has had the following oligonucleotides removed from it: (1) oligonucleotides having a melting temperature in ° C. of less than 11 times the number of tetramers and more than 15 times then number of tetramers, (2) double multimer units with the same 3 tetramers linked together, and (3) double multimer units with the same 4 tetramers linked together with or without interruption, where the capture oligonucleotides have nucleotide sequences complementary to the addressable array-specific portions.

Often, a number of different single-base mutations, insertions, or deletions may occur at the same nucleotide position of the sequence of interest. The method provides for having an oligonucleotide set, where the second oligonucleotide probe is common and contains the detectable label, and the first oligonucleotide probe has different addressable array-specific portions and target-specific portions. The first oligonucleotide probe is suitable for ligation to a second adjacent oligonucleotide probe at a first ligation junction, when hybridized without mismatch, to the sequence in question. Different first adjacent oligonucleotide probes would contain different discriminating base(s) at the junction where only a hybridization without mismatch at the junction would allow for ligation. Each first adjacent oligonucleotide would contain a different addressable array-specific portion, and, thus, specific base changes would be distinguished by capture at different addresses. In this scheme, a plurality of different capture oligonucleotides are attached at different locations on the solid support for multiplex detection of additional nucleic acid sequences differing from other nucleic acids by at least a single base. Alternatively, the first oligonucleotide probe contains common addressable array-specific portions, and the second oligonucleotide probes have different detectable labels and target-specific portions.

Such arrangements permit multiplex detection of additional nucleic acid sequences differing from other nucleic acids by at least a single base. The nucleic acids sequences can be on the same or different alleles when carrying out such multiplex detection.

The present invention also relates to a kit for carrying out the method of the present invention which includes the ligase, the plurality of different oligonucleotide probe sets, and the solid support with immobilized capture oligonucleotides. Primers for preliminary amplification of the target nucleotide sequences may also be included in the kit. If amplification is by polymerase chain reaction, polymerase may also be included in the kit.

Figure 2:
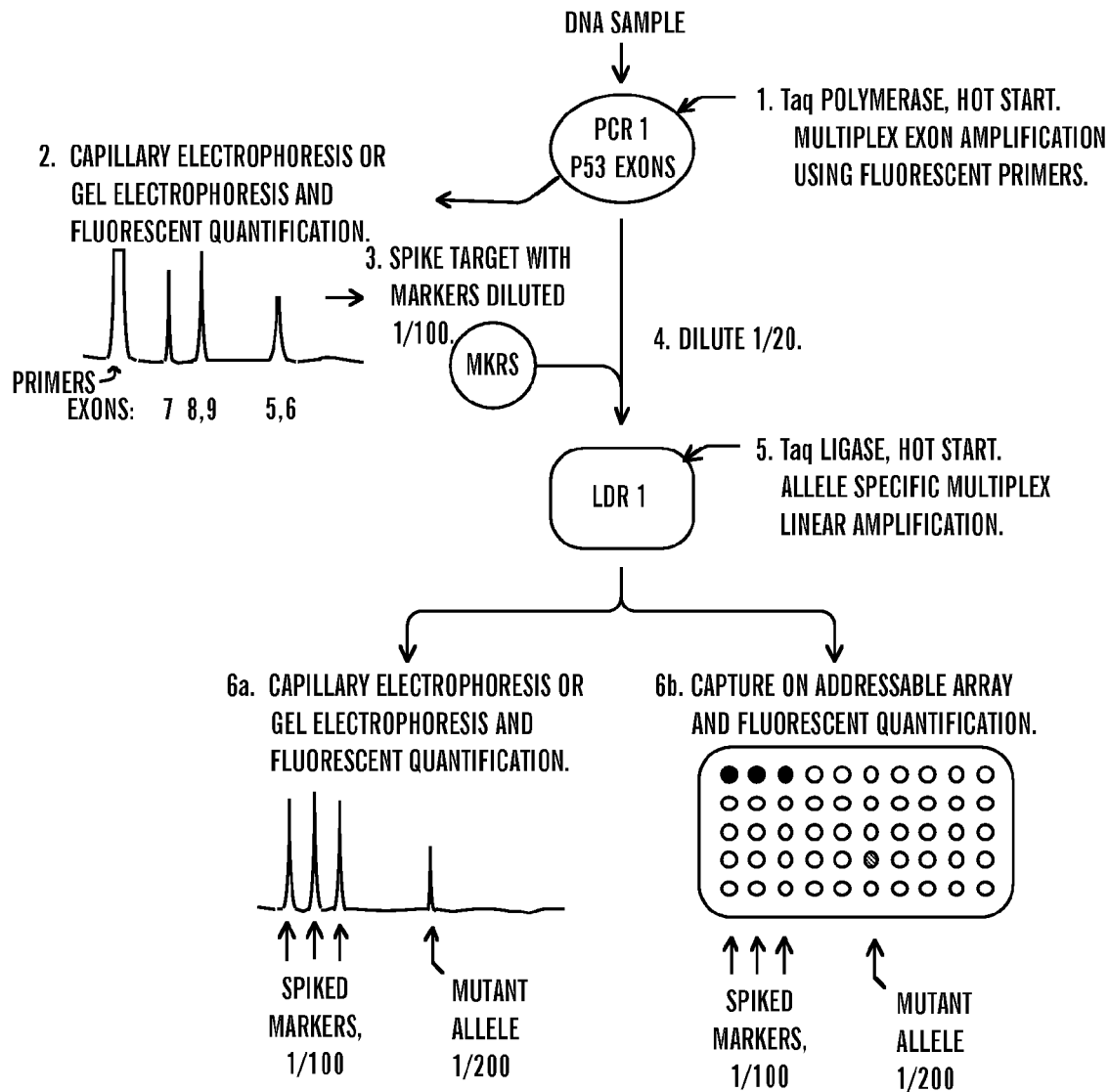
FIG. 2 is a flow diagram depicting PCR/LDR processes, according to the prior art and the present invention, for detection of cancer-associated mutations.

FIGS. 1 and 2 show flow diagrams of the process of the present invention compared to a prior art ligase detection reaction utilizing capillary or gel electrophoresis/fluorescent quantification. FIG. 1 relates to detection of a germline mutation detection, while FIG. 2 shows the detection of cancer.

FIG. 1 depicts the detection of a germline point mutation, such as the p53 mutations responsible for Li-Fraumeni syndrome. In step 1, after DNA sample preparation, exons 5-8 are PCR amplified using Taq (i.e. *Thermus aquaticus*) polymerase under hot start conditions. At the end of the reaction, Taq polymerase is degraded by treatment with Proteinase K. Products are diluted 20-fold in step 2 into fresh LDR buffer containing allele-specific and common LDR probes. A tube generally contains about 500 fmoles of each primer. In step 3, the ligase detection reaction is initiated by addition of Taq ligase under hot start conditions. The LDR probes ligate to their adjacent probes only in the presence of target sequence which gives perfect complementarity at the junction site. The products may be detected in two different formats. In the first format 4a., used in the prior art, fluorescently-labeled LDR probes contain different length poly A or hexaethylene oxide tails. Thus, each LDR product, resulting from ligation to normal DNA with a slightly different mobility, yields a ladder of peaks. A germline mutation would generate a new peak on the electrophorogram. The size of the new peak will approximate the amount of the mutation present in the original sample; 0% for homozygous normal, 50% for heterozygous carrier, or 100% for homozygous mutant. In the second format 4b., in accordance with the present invention, each allele-specific probe contains e.g., 24 additional nucleotide bases on their 5' ends. These sequences are unique addressable sequences which will specifically hybridize to their complementary address sequences on an addressable array. In the LDR reaction, each allele-specific probe can ligate to its adjacent fluorescently labeled common probe in the presence of the corresponding target sequence. Wild type and mutant alleles are captured on adjacent addresses on the array. Unreacted probes are washed away. The black dots indicate 100% signal for the wild type allele. The white dots indicate 0% signal for the mutant alleles. The shaded dots indicate the one position of germline mutation, 50% signal for each allele.

FIG. 2 depicts detection of somatic cell mutations in the p53 tumor suppressor gene but is general for all low sensitivity mutation detection. In step 1, DNA samples are prepared and exons 5-9 are PCR amplified as three fragments using fluorescent PCR primers. This allows for fluorescent quantification of PCR products in step 2 using capillary or gel electrophoresis. In step 3, the products are spiked with a 1/100 dilution of marker DNA (for each of the three fragments). This DNA is homologous to wild type DNA, except it contains a mutation which is not observed in cancer cells, but which may be readily detected with the appropriate LDR probes. The mixed DNA products in step 4 are diluted 20-fold into buffer containing all the LDR probes which are specific only to mutant or marker alleles. In step 5, the ligase detection reaction is initiated by addition of Taq ligase under hot start conditions. The LDR probes ligate to their adjacent probes only in the presence of target sequences which give perfect complementarity at the junction site. The products may be detected in the same two formats described in FIG. 1. In the format of step 6a, which is used in the prior art, products are separated by capillary or gel electrophoresis, and fluorescent signals are quantified. Ratios of mutant peaks to marker peaks give approximate amount of cancer mutations present in the original sample divided by 100. In the format of step 6b, in accordance with the present invention, products are detected by specific hybridization to complementary sequences on an addressable array. Ratios of fluorescent signals in mutant dots to marker dots give the approximate amount of cancer mutations present in the original sample divided by 100.

The ligase detection reaction process, in accordance with the present invention, is best understood by referring to FIGS. 3-15. It is described generally in WO 90/17239 to Barany et al., F. Barany et al., "Cloning, Overexpression and Nucleotide Sequence of a Thermostable DNA Ligase-encoding Gene," *Gene,* 109:1-11 (1991), and F. Barany, "Genetic Disease Detection and DNA Amplification Using Cloned Thermostable Ligase," *Proc. Natl. Acad. Sci. USA,* 88:189-193 (1991), the disclosures of which are hereby incorporated by reference. In accordance with the present invention, the ligase detection reaction can use 2 sets of complementary oligonucleotides. This is known as the ligase chain reaction which is described in the 3 immediately preceding references, which are hereby incorporated by reference. Alternatively, the ligase detection reaction can involve a single cycle which is known as the oligonucleotide ligation assay. See Landegren, et al., "A Ligase-Mediated Gene Detection Technique," *Science* 241:1077-80 (1988); Landegren, et al., "DNA Diagnostics— Molecular Techniques and Automation," *Science* 242:229-37 (1988); and U.S. Pat. No. 4,988,617 to Landegren, et al.

During the ligase detection reaction phase of the process, the denaturation treatment is carried out at a temperature of 80-105° C., while hybridization takes place at 50-85° C. Each cycle comprises a denaturation treatment and a thermal hybridization treatment which in total is from about one to five minutes long. Typically, the ligation detection reaction involves repeatedly denaturing and hybridizing for 2 to 50 cycles. The total time for the ligase detection reaction phase of the process is 1 to 250 minutes.

The oligonucleotide probe sets can be in the form of ribonucleotides, deoxynucleotides, modified ribonucleotides, modified deoxyribonucleotides, peptide nucleotide analogues, modified peptide nucleotide analogues, modified phosphate-sugar-backbone oligonucleotides, nucleotide analogs, and mixtures thereof.

In one variation, the oligonucleotides of the oligonucleotide probe sets each have a hybridization or melting temperature (i.e. $T_m$) of 66-70° C. These oligonucleotides are 20-28 nucleotides long.

It may be desirable to destroy chemically or enzymatically unconverted LDR oligonucleotide probes that contain addressable nucleotide array-specific portions prior to capture of the ligation products on a DNA array. Such unconverted probes will otherwise compete with ligation products for binding at the addresses on the array of the solid support which contain complementary sequences. Destruction can be accomplished by utilizing an exonuclease, such as exonuclease III (L-H Guo and R. Wu, *Methods in Enzymology* 100:60-96 (1985), which is hereby incorporated by reference) in combination with LDR probes that are blocked at the ends and not involved with ligation of probes to one another. The blocking moiety could be a reporter group or a phosphorothioate group. T. T. Nikiforow, et al., "The Use of Phosphorothioate Primers and Exonuclease Hydrolysis for the Preparation of Single-stranded PCR Products and their Detection by Solid-phase Hybridization," *PCR Methods and Applications,* 3:p. 285-291 (1994), which is hereby incorporated by reference. After the LDR process, unligated probes are selectively destroyed by incubation of the reaction mixture with the exonuclease. The ligated probes are protected due to the elimination of free 3' ends which are required for initiation of the exonuclease reaction. This approach results in an increase in the signal-to-noise ratio, especially where the LDR reaction forms only a small amount of product. Since unligated oligonucleotides compete for capture by the capture oligonucleotide, such competition with the ligated oligonucleotides lowers the signal. An additional advantage of this approach is that unhybridized label-containing sequences are degraded and, therefore, are less able to cause a target-independent background signal, because they can be removed more easily from the DNA array by washing.

The oligonucleotide probe sets, as noted above, have a reporter label suitable for detection. Useful labels include chromophores, fluorescent moieties, enzymes, antigens, heavy metals, magnetic probes, dyes, phosphorescent groups, radioactive materials, chemiluminescent moieties, and electrochemical detecting moieties. The capture oligonucleotides can be in the form of ribonucleotides, deoxyribonucleotides, modified ribonucleotides, modified deoxyribonucleotides, peptide nucleotide analogues, modified peptide nucleotide analogues, modified phosphate-sugar backbone oligonucleotides, nucleotide analogues, and mixtures thereof. Where the process of the present invention involves use of a plurality of oligonucleotide sets, the second oligonucleotide probes can be the same, while the addressable array-specific portions of the first oligonucleotide probes differ. Alternatively, the addressable array-specific portions of the first oligonucleotide probes may be the same, while the reporter labels of the second oligonucleotide probes are different.

Prior to the ligation detection reaction phase of the present invention, the sample is preferably amplified by an initial target nucleic acid amplification procedure. This increases the quantity of the target nucleotide sequence in the sample. For example, the initial target nucleic acid amplification may be accomplished using the polymerase chain reaction process, self-sustained sequence replication, or Q-β replicase-mediated RNA amplification. The polymerase chain reaction process is the preferred amplification procedure and is fully described in H. Erlich, et. al., "Recent Advances in the Polymerase Chain Reaction," *Science* 252:1643-50 (1991); M. Innis, et. al., *PCR Protocols: A Guide to Methods and Applications*, Academic Press: New York (1990); and R. Saiki, et. al., "Primer-directed Enzymatic Amplification of DNA with a Thermostable DNA Polymerase," *Science* 239:487-91 (1988), which are hereby incorporated by reference. J. Guatelli, et. al., "Isothermal, in vitro Amplification of Nucleic Acids by a Multienzyme Reaction Modeled After Retroviral Replication," *Proc. Natl. Acad. Sci. USA* 87:1874-78 (1990), which is hereby incorporated by reference, describes the self-sustained sequence replication process. The Q-β replicase-mediated RNA amplification is disclosed in F. Kramer, et. al., "Replicatable RNA Reporters," *Nature* 339:401-02 (1989), which is hereby incorporated by reference.

The use of the polymerase chain reaction process and then the ligase detection process, in accordance with the present invention, is shown in FIG. 3. Here, homo- or heterozygosity at two polymorphisms (i.e. allele differences) are on the same gene. Such allele differences can alternatively be on different genes.

As shown in FIG. 3, the target nucleic acid, when present in the form of a double stranded DNA molecule is denatured to separate the strands. This is achieved by heating to a temperature of 80-105° C. Polymerase chain reaction primers are then added and allowed to hybridize to the strands, typically at a temperature of 20-85° C. A thermostable polymerase (e.g., *Thermus aquaticus* polymerase) is also added, and the temperature is then adjusted to 50-85° C. to extend the primer along the length of the nucleic acid to which the primer is hybridized. After the extension phase of the polymerase chain reaction, the resulting double stranded molecule is heated to a temperature of 80-105° C. to denature the molecule and to separate the strands. These hybridization, extension, and denaturation steps may be repeated a number of times to amplify the target to an appropriate level.

Once the polymerase chain reaction phase of the process is completed, the ligation detection reaction phase begins, as shown in FIG. 3. After denaturation of the target nucleic acid, if present as a double stranded DNA molecule, at a temperature of 80-105° C., preferably 94° C., ligation detection reaction oligonucleotide probes for one strand of the target nucleotide sequence are added along with a ligase (for example, as shown in FIG. 3, a thermostable ligase like *Thermus aquaticus* ligase). The oligonucleotide probes are then allowed to hybridize to the target nucleic acid molecule and ligate together, typically, at a temperature of 45-85° C., preferably, 65° C. When there is perfect complementarity at the ligation junction, the oligonucleotides can be ligated together. Where the variable nucleotide is T or A, the presence of T in the target nucleotide sequence will cause the oligonucleotide probe with the addressable array-specific portion Z1 to ligate to the oligonucleotide probe with the reporter label F, and the presence of A in the target nucleotide sequence will cause the oligonucleotide probe with the addressable array-specific portion Z2 to ligate to the oligonucleotide probe with reporter label F. Similarly, where the variable nucleotide is A or G, the presence of T in the target nucleotide sequence will cause the oligonucleotide probe with addressable array-specific portion Z4 to ligate to the oligonucleotide probe with the reporter label F, and the presence of C in the target nucleotide sequence will cause the oligonucleotide probe with the addressable array-specific portion Z3 to ligate to the oligonucleotide probe with reporter label F. Following ligation, the material is again subjected to denaturation to separate the hybridized strands. The hybridization/ligation and denaturation steps can be carried through one or more cycles (e.g., 1 to 50 cycles) to amplify the target signal. Fluorescent ligation products (as well as unligated oligonucleotide probes having an addressable array-specific portion) are captured by hybridization to capture probes complementary to portions Z1, Z2, Z3, and Z4 at particular addresses on the addressable arrays. The presence of ligated oligonucleotides is then detected by virtue of the label F originally on one of the oligonucleotides. In FIG. 3, ligated product sequences hybridize to the array at addresses with capture oligonucleotides complementary to addressable array-specific portions Z1 and Z3, while unligated oligonucleotide probes with addressable array-specific portions Z2 and Z4 hybridize to their complementary capture oligonucleotides. However, since only the ligated product sequences have label F, only their presence is detected.

Figure 4:
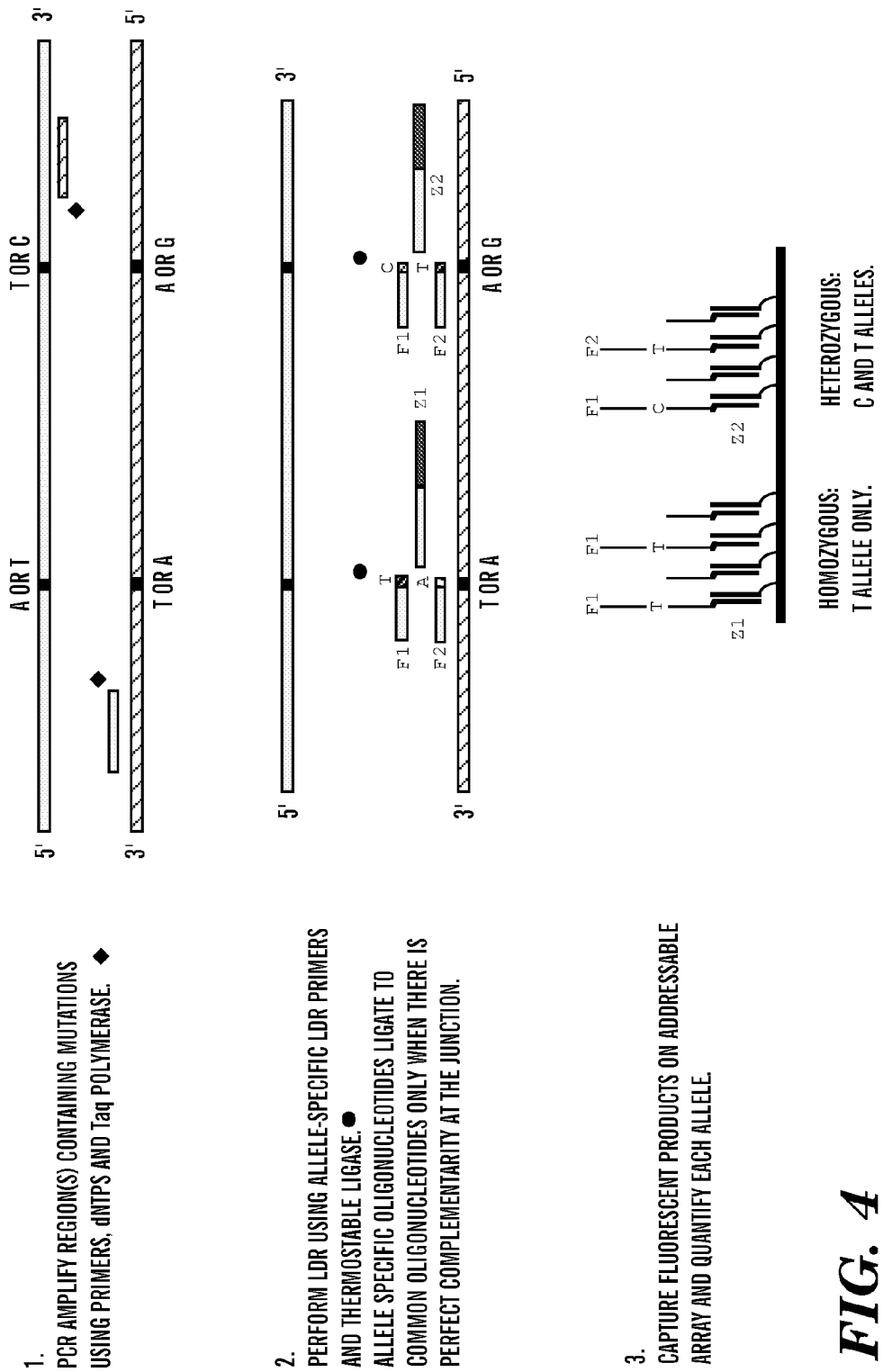
FIG. 4 is a schematic diagram depicting a PCR/LDR process according to the present invention, using addresses on common probes for detecting homo- or heterozygosity at two polymorphisms (i.e. allele differences) on the same gene.

FIG. 4 is similar to FIG. 3 except that in FIG. 4, the common oligonucleotide probe has an address-specific portion, while the allele-specific probes have different labels.

FIG. 5 is a flow diagram of a PCR/LDR process, in accordance with the present invention, which distinguishes any possible base at a given site. Appearance of fluorescent signal at the addresses complementary to addressable array-specific portions Z1, Z2, Z3, and Z4 indicates the presence of A, G, C, and T alleles in the target nucleotide sequence, respectively. Here, the presence of the A and C alleles in the target nucleotide sequences is indicated due to the fluorescence at the addresses on the solid support with capture oligonucleotide probes complementary to portions Z1 and Z3, respectively. Note that in FIG. 5 the addressable array-specific portions are on the discriminating oligonucleotide probes, and the discriminating base is on the 3' end of these probes.

Figure 6:
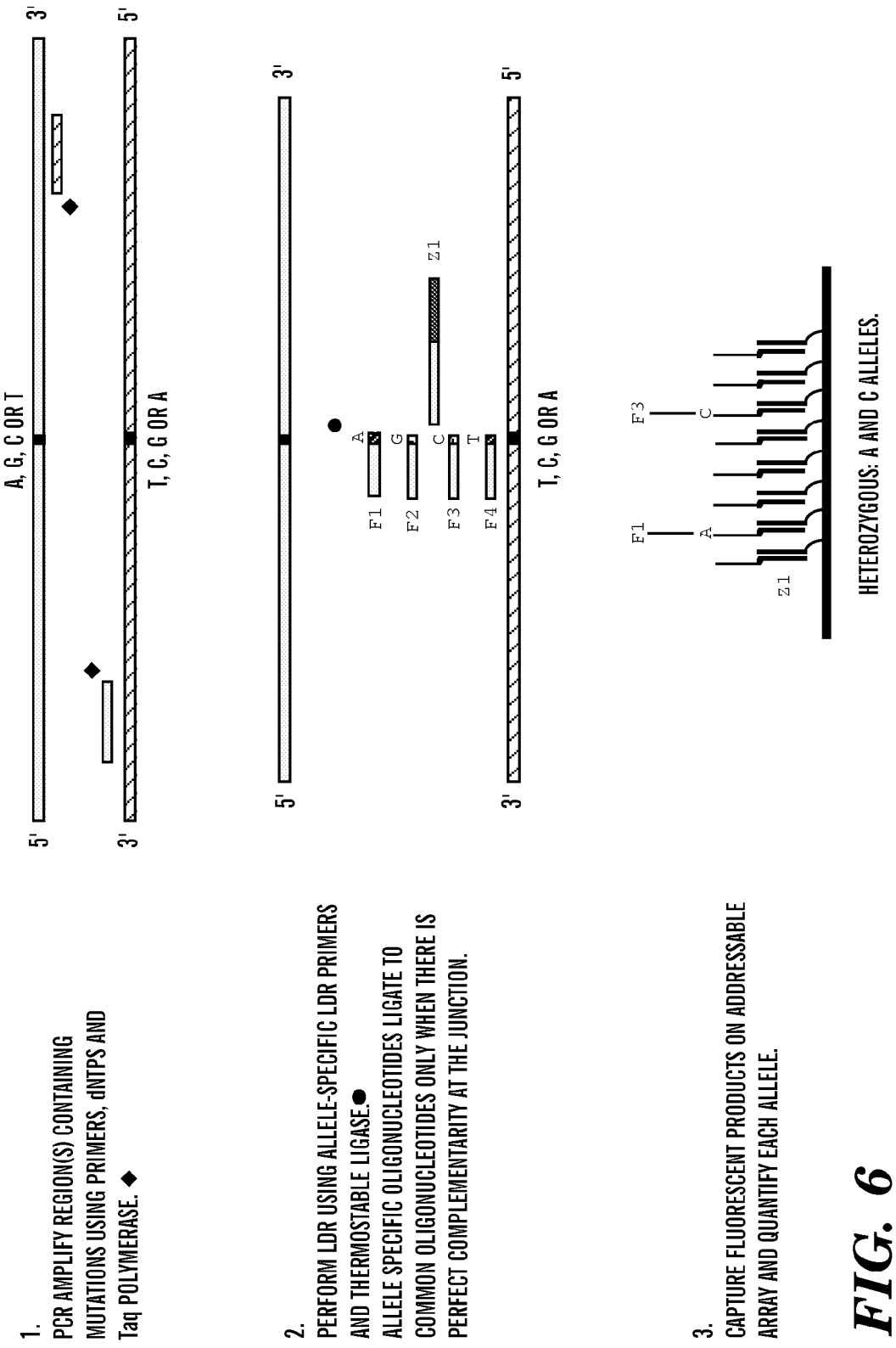
FIG. 6 is a schematic diagram depicting a PCR/LDR process, according to the present invention, using addresses on the common probes which distinguishes all possible bases at a given site.

FIG. 6 is similar to FIG. 5, except that in FIG. 6, the common oligonucleotide probe has the address-specific portion, while the allele-specific probes have different labels.

FIG. 7 is a flow diagram of a PCR/LDR process, in accordance with the present invention, for detecting the presence of any possible base at two nearby sites. Here, the LDR probes are able to overlap, yet are still capable of ligating provided there is perfect complementarity at the junction. This distinguishes LDR from other approaches, such as allele-specific PCR where overlapping primers would interfere with one another. In FIG. 7, the first nucleotide position is heterozygous at the A and C alleles, while the second nucleotide position is heterozygous to the G, C, and T alleles. As in FIG. 5, the addressable array-specific portions are on the discriminating oligonucleotide probes, and the discriminating base is on the 3' end of these probes. The reporter group (e.g., the fluorescent label) is on the 3' end of the common oligonucleotide probes. This is possible for example with the 21 hydroxylase gene, where each individual has 2 normal and 2 pseudogenes, and, at the intron 2 splice site (nucleotide 656), there are 3 possible single bases (G, A, and C). Also, this can be used to detect low abundance mutations in HIV infections which might indicate emergence of drug resistant (e.g., to AZT) strains. Returning to FIG. 7, appearance of fluorescent signal at the addresses complementary to addressable array-specific portions Z1, Z2, Z3, Z4, Z5, Z6, Z7, and Z8 indicates the presence of the A, G, C, and T, respectively, in the site heterozygous at the A and C alleles, and A, G, C, and T, respectively, in the site heterozygous at the G, C, and T alleles.

Figure 8:
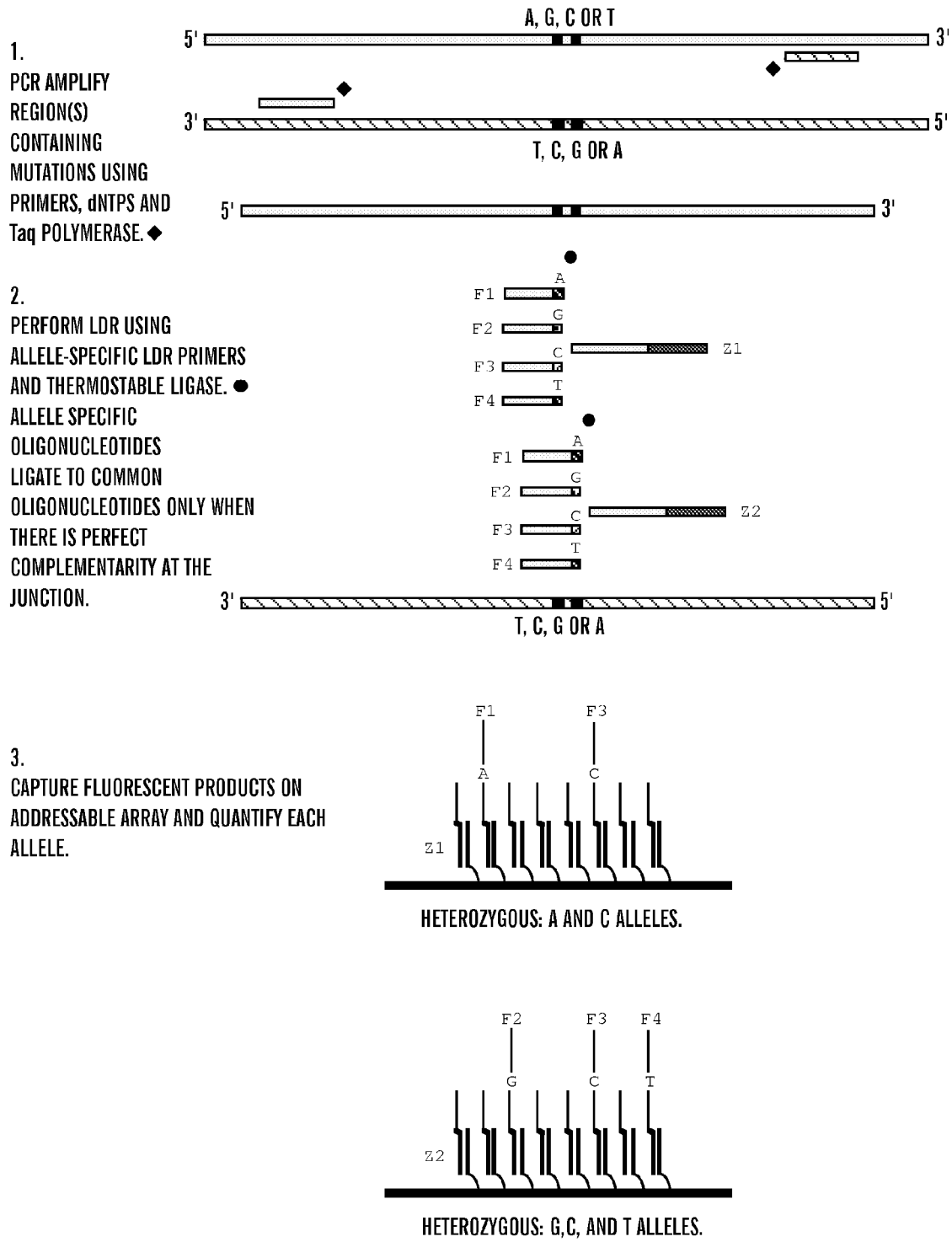
FIG. 8 is a schematic diagram depicting a PCR/LDR process, according to the present invention, using addresses on the common probes for detecting the presence of any possible base at two nearby sites.

FIG. 8 is similar to FIG. 7, except that in FIG. 8, the common oligonucleotide probes have the address-specific portions, while the allele specific probes have different labels.

FIG. 9 is a flow diagram of a PCR/LDR process, in accordance with the present invention, where insertions (top left set of probes) and deletions (bottom right set of probes) are distinguished. On the left, the normal sequence contains 5 A's in a polyA tract. The mutant sequence has an additional 2As inserted into the tract. Therefore, the LDR products with addressable array-specific portions Z1 (representing the normal sequence) and Z3 (representing a 2 base pair insertion) would be fluorescently labeled by ligation to the common probe. While the LDR process (e.g., using a thermostable ligase enzyme) has no difficulty distinguishing single base insertions or deletions in mononucleotide repeats, allele-specific PCR is unable to distinguish such differences, because the 3' base remains the same for both alleles. On the right, the normal sequence is a (CA)5 repeat (i.e. CACACACACA (SEQ ID NO: 9267)). The mutant contains two less CA bases than the normal sequence (i.e. CACACA). These would be detected as fluorescent LDR products at the addressable array-specific portions Z8 (representing the normal sequence) and Z6 (representing the 2 CA deletion) addresses. The resistance of various infectious agents to drugs can also be determined using the present invention. In FIG. 9, the presence of ligated product sequences, as indicated by fluorescent label F, at the address having capture oligonucleotides complementary to Z1 and Z3 demonstrates the presence of both the normal and mutant poly A sequences. Similarly, the presence of ligated product sequences, as indicated by fluorescent label F, at the address having capture oligonucleotides complementary to Z6 and Z8 demonstrates the presence of both the normal CA repeat and a sequence with one repeat unit deleted.

FIG. 10 is similar to FIG. 9, except that in FIG. 10, the common oligonucleotide probes have the address-specific portions, while the allele-specific probes have different labels.

FIG. 11 is a flow diagram of a PCR/LDR process, in accordance with the present invention, using addressable array-specific portions to detect a low abundance mutation in the presence of an excess of normal sequence. FIG. 11 shows codon 12 of the K-ras gene, sequence GGT, which codes for glycine ("Gly"). A small percentage of the cells contain the G to A mutation in GAT, which codes for aspartic acid ("Asp").

The LDR probes for wild-type (i.e. normal sequences) are missing from the reaction. If the normal LDR probes (with the discriminating base=G) were included, they would ligate to the common probes and overwhelm any signal coming from the mutant target Instead, as shown in FIG. 11, the existence of a ligated product sequence with fluorescent label F at the address with a capture oligonucleotide complementary to addressable array-specific portion Z4 indicates the presence of the aspartic acid encoding mutant.

FIG. 12 is similar to FIG. 11, except that in FIG. 12, the common oligonucleotide probes have address-specific portions, while the allele-specific probes have different labels.

FIG. 13 is a flow diagram of a PCR/LDR process, in accordance with the present invention, where the addressable array-specific portion is placed on, the common oligonucleotide probe, while the discriminating oligonucleotide probe has the reporter label. Allele differences are distinguished by different fluorescent signals, F1, F2, F3, and F4. This mode allows for a more dense use of the arrays, because each position is predicted to light up with some group. It has the disadvantage of requiring fluorescent groups which have minimal overlap in their emission spectra and will require multiple scans. It is not ideally suitable for detection of low abundance alleles (e.g., cancer associated mutations).

FIG. 14 is a flow diagram of a PCR/LDR process, in accordance with the present invention, where both adjacent and nearby alleles are detected. The adjacent mutations are right next to each other, and one set of oligonucleotide probes discriminates the bases on the 3' end of the junction (by use of different addressable array-specific portions Z1, Z2, Z3, and Z4), while the other set of oligonucleotide probes discriminates the bases on the 5' end of the junction (by use of different fluorescent reporter labels F1, F2, F3, and F4). In FIG. 14, codons in a disease gene (e.g. CFTR for cystic fibrosis) encoding Gly and arginine ("Arg"), respectively, are candidates for germline mutations. The detection results in FIG. 14 show the Gly (GGA; indicated by the ligated product sequence having portion Z2 and label F2) has been mutated to glutamic acid ("Glu") (GAA; indicated by the ligated product sequence having portion Z2 and label F1), and the Arg (CGG; indicated by the ligated product sequence having portion Z7 and label F2) has been mutated to tryptophan ("Trp") (TGG; indicated by the ligated product sequence with portion Z8 and label F2). Therefore, the patient is a compound heterozygous individual (i.e. with allele mutations in both genes) and will have the disease.

FIG. 15 is a flow diagram of a PCR/LDR process, in accordance with the present invention, where all possible single-base mutations for a single codon are detected. Most amino acid codons have a degeneracy in the third base, thus the first two positions can determine all the possible mutations at the protein level. These amino acids include arginine, leucine, serine, threonine, proline, alanine, glycine, and valine. However, some amino acids are determined by all three bases in the codon and, thus, require the oligonucleotide probes to distinguish mutations in 3 adjacent positions. By designing four oligonucleotide probes containing the four possible bases in the penultimate position to the 3' end, as well as designing an additional four capture oligonucleotides containing the four possible bases at the 3' end, as shown in FIG. 15, this problem has been solved. The common oligonucleotide probes with the reporter labels only have two fluorescent groups which correspond to the codon degeneracies and distinguish between different ligated product sequences which are captured at the same array address. For example, as shown in FIG. 15, the presence of a glutamine ("Gln") encoding codon (i.e., CAA and CAG) is indicated by the presence of a ligated product sequence containing portion Z1 and label F2. Likewise, the existence of a Gln to histidine ("His") encoding mutation (coded by the codon CAC) is indicated by the presence of ligated product sequences with portion Z1 and label F2 and with portion Z7 and label F2 There is an internal redundancy built into this assay due to the fact that primers Z1 and Z7 have the identical sequence.

A particularly important aspect of the present invention is its capability to quantify the amount of target nucleotide sequence in a sample. This can be achieved in a number of ways by establishing standards which can be internal (i.e. where the standard establishing material is amplified and detected with the sample) or external (i.e. where the standard establishing material is not amplified, and is detected with the sample).

In accordance with one quantification method, the signal generated by the reporter label, resulting from capture of ligated product sequences produced from the sample being analyzed, are detected. The strength of this signal is compared to a calibration curve produced from signals generated by capture of ligated product sequences in samples with known amounts of target nucleotide sequence. As a result, the amount of target nucleotide sequence in the sample being analyzed can be determined. This technique involves use of an external standard.

Another quantification method, in accordance with the present invention, relates to an internal standard. Here, a known amount of one or more marker target nucleotide sequences are added to the sample. In addition, a plurality of marker-specific oligonucleotide probe sets are added along with the ligase, the previously-discussed oligonucleotide probe sets, and the sample to a mixture. The marker-specific oligonucleotide probe sets have (1) a first oligonucleotide probe with a target-specific portion complementary to the marker target nucleotide sequence and an addressable array-specific portion complementary to capture oligonucleotides on the support and (2) a second oligonucleotide probe with a target-specific portion complementary to the marker target nucleotide sequence and a detectable reporter label. The oligonucleotide probes in a particular marker-specific oligonucleotide set are suitable for ligation together when hybridized adjacent to one another on a corresponding marker target nucleotide sequence. However, there is a mismatch which interferes with such ligation when hybridized to any other nucleotide sequence present in the sample or added marker sequences. The presence of ligated product sequences captured on the support is identified by detection of reporter labels. The amount of target nucleotide sequences in the sample is then determined by comparing the amount of captured ligated product generated from known amounts of marker target nucleotide sequences with the amount of other ligated product sequences captured.

Another quantification method in accordance with the present invention involves analysis of a sample containing two or more of a plurality of target nucleotide sequences with a plurality of sequence differences. Here, ligated product sequences corresponding to the target nucleotide sequences are detected and distinguished by any of the previously-discussed techniques. The relative amounts of the target nucleotide sequences in the sample are then quantified by comparing the relative amounts of captured ligated product sequences generated. This provides a quantitative measure of the relative level of the target nucleotide sequences in the sample.

The ligase detection reaction process phase of the present invention can be preceded by the ligase chain reaction process to achieve oligonucleotide product amplification. This process is fully described in F. Barany, et. al., "Cloning, Overexpression and Nucleotide Sequence of a Thermostable DNA Ligase-encoding Gene," *Gene* 109:1-11 (1991) and F. Barany, "Genetic Disease Detection and DNA Amplification Using Cloned Thermostable Ligase," *Proc. Natl. Acad. Sci. USA* 88:189-93 (1991), which are hereby incorporated by reference. Instead of using the ligase chain reaction to achieve amplification, a transcription-based amplifying procedure can be used.

The preferred thermostable ligase is that derived from *Thermus aquaticus*. This enzyme can be isolated from that organism. M. Takahashi, et al., "Thermophillic DNA Ligase," *J. Biol. Chem.* 259:10041-47 (1984), which is hereby incorporated by reference. Alternatively, it can be prepared recombinantly. Procedures for such isolation as well as the recombinant production of *Thermus aquaticus* ligase (and *Thermus themophilus* ligase) are disclosed in WO 90/17239 to Barany, et. al., and F. Barany, et al., "Cloning, Overexpression and Nucleotide Sequence of a Thermostable DNA-Ligase Encoding Gene," Gene 109:1-11 (1991), which are hereby incorporated by reference. These references contain complete sequence information for this ligase as well as the encoding DNA. Other suitable ligases include *E. coli* ligase, T4 ligase, *Thermus* sp. AK16 ligase, *Aquifex aeolicus* ligase, *Thermotoga maritima* ligase, and *Pyrococcus* ligase.

The ligation amplification mixture may include a carrier DNA, such as salmon sperm DNA.

The hybridization step, which is preferably a thermal hybridization treatment, discriminates between nucleotide sequences based on a distinguishing nucleotide at the ligation junctions. The difference between the target nucleotide sequences can be, for example, a single nucleic acid base difference, a nucleic acid deletion, a nucleic acid insertion, or rearrangement. Such sequence differences involving more than one base can also be detected. Preferably, the oligonucleotide probe sets have substantially the same length so that they hybridize to target nucleotide sequences at substantially similar hybridization conditions. As a result, the process of the present invention is able to detect infectious diseases, genetic diseases, and cancer. It is also useful in environmental monitoring, forensics, and food science.

A wide variety of infectious diseases can be detected by the process of the present invention. Typically, these are caused by bacterial, viral, parasite, and fungal infectious agents. The resistance of various infectious agents to drugs can also be determined using the present invention.

Bacterial infectious agents which can be detected by the present invention include *Escherichia coli, Salmonella, Shigella, Klebsiella, Pseudomonas, Listeria monocytogenes, Mycobacterium tuberculosis, Mycobacterium avium-intracellulare, Yersinia, Francisella, Pasteurella, Brucella, Clostridia, Bordetella pertussis, Bacteroides, Staphylococcus aureus, Streptococcus pneumonia*, B-Hemolytic strep., *Corynebacteria, Legionella, Mycoplasma, Ureaplasma, Chlamydia, Neisseria gonorrhea, Neisseria meningitides, Hemophilus influenza, Enterococcus faecalis, Proteus vulgaris, Proteus mirabilis, Helicobacter pylori, Treponema palladium, Borrelia burgdorferi, Borrelia recurrentis*, Rickettsial pathogens, *Nocardia*, and *Acitnomycetes*.

Fungal infectious agents which can be detected by the present invention include *Cryptococcus neoformans, Blastomyces dermatitidis, Histoplasma capsulatum, Coccidioides immitis, Paracoccicioides brasiliensis, Candida albicans, Aspergillus fumigautus, Phycomycetes (Rhizopus), Sporothrix schenckii, Chromomycosis*, and *Maduromycosis*.

Viral infectious agents which can be detected by the present invention include human immunodeficiency virus, human T-cell lymphocytotrophic virus, hepatitis viruses (e.g., Hepatitis B Virus and Hepatitis C Virus), Epstein-Barr Virus, cytomegalovirus, human papillomaviruses, orthomyxo viruses, paramyxo viruses, adenoviruses, corona viruses, rhabdo viruses, polio viruses, toga viruses, bunya viruses, arena viruses, rubella viruses, and reo viruses.

Parasitic agents which can be detected by the present invention include *Plasmodium falciparum, Plasmodium malaria, Plasmodium vivax, Plasmodium ovale, Onchoverva volvulus, Leishmania, Trypanosoma* spp., *Schistosoma* spp., *Entamoeba histolytica, Cryptosporidum, Giardia* spp., *Trichimonas* spp., *Balatidium coli, Wuchereria bancrofti, Toxoplasma* spp., *Enterobius vermicularis, Ascaris lumbricoides, Trichuris trichiura, Dracunculus medinesis,* trematodes, *Diphyllobothrium latum, Taenia* spp., *Pneumocystis carinii,* and *Necator americanis.*

The present invention is also useful for detection of drug resistance by infectious agents. For example, vancomycin-resistant *Enterococcus faecium,* methicillin-resistant *Staphylococcus aureus,* penicillin-resistant *Streptococcus pneumoniae,* multi-drug resistant *Mycobacterium tuberculosis,* and AZT-resistant human immunodeficiency virus can all be identified with the present invention.

Genetic diseases can also be detected by the process of the present invention. This can be carried out by prenatal screening for chromosomal and genetic aberrations or post natal screening for genetic diseases. Examples of detectable genetic diseases include: 21 hydroxylase deficiency, cystic fibrosis, Fragile X Syndrome, Turner Syndrome, Duchenne Muscular Dystrophy, Down Syndrome or other trisomies, heart disease, single gene diseases, HLA typing, phenylketonuria, sickle cell anemia, Tay-Sachs Syndrome, thalassemia, Klinefelter's Syndrome, Huntington's Disease, autoimmune diseases, lipidosis, obesity defects, hemophilia, inborn errors in metabolism, and diabetes.

Cancers which can be detected by the process of the present invention generally involve oncogenes, tumor suppressor genes, or genes involved in DNA amplification, replication, recombination, or repair. Examples of these include: BRCA1 gene, p53 gene, *Familial polyposis coli,* Her2/Neu amplification, Bcr/Ab1, K-ras gene, human papillomavirus Types 16 and 18, leukemia, colon cancer, breast cancer, lung cancer, prostate cancer, brain tumors, central nervous system tumors, bladder tumors, melanomas, liver cancer, osteosarcoma and other bone cancers, testicular and ovarian carcinomas, ENT tumors, and loss of heterozygosity.

In the area of environmental monitoring, the present invention can be used for detection, identification, and monitoring of pathogenic and indigenous microorganisms in natural and engineered ecosystems and microcosms such as in municipal waste water purification systems and water reservoirs or in polluted areas undergoing bioremediation. It is also possible to detect plasmids containing genes that can metabolize xenobiotics, to monitor specific target microorganisms in population dynamic studies, or either to detect, identify, or monitor genetically modified microorganisms in the environment and in industrial plants.

The present invention can also be used in a variety or forensic areas, including for human identification for military personnel and criminal investigation, paternity testing and family relation analysis, HLA compatibility typing, and screening blood, sperm, or transplantation organs for contamination.

In the food and feed industry, the present invention has a wide variety of applications. For example, it can be used for identification and characterization of production organisms such as yeast for production of beer, wine, cheese, yogurt, bread, etc. Another area of use is with regard to quality control and certification of products and processes (e.g., livestock, pasteurization, and meat processing) for contaminants. Other uses include the characterization of plants, bulbs, and seeds for breeding purposes, identification of the presence of plant-specific pathogens, and detection and identification of veterinary infections.

Desirably, the oligonucleotide probes are suitable for ligation together at a ligation junction when hybridized adjacent to one another on a corresponding target nucleotide sequence due to perfect complementarity at the ligation junction. However, when the oligonucleotide probes in the set are hybridized to any other nucleotide sequence present in the sample, there is a mismatch at a base at the ligation junction which interferes with ligation. Most preferably, the mismatch is at the base adjacent the 3' base at the ligation junction. Alternatively, the mismatch can be at the bases adjacent to bases at the ligation junction.

The process of the present invention is able to detect the first and second nucleotide sequences in the sample in an amount of 100 attomoles to 250 femtomoles. By coupling the LDR step with a primary polymerase-directed amplification step, the entire process of the present invention is able to detect target nucleotide sequences in a sample containing as few as a single molecule. Furthermore, PCR amplified products, which often are in the picomole amounts, may easily be diluted within the above range. The ligase detection reaction achieves a rate of formation of mismatched ligated product sequences which is less than 0.005 of the rate of formation of matched ligated product sequences.

Once the ligation phase of the process is completed, the capture phase is initiated. During the capture phase of the process, the mixture is contacted with the solid support at a temperature of 25-90° C., preferably 60-80° C., and for a time period of 10-180 minutes, preferably up to 60 minutes. Hybridizations may be accelerated or improved by mixing the ligation mixture during hybridization, or by adding volume exclusion, chaotropic agents, tetramethylammonium chloride, or N,N,N, Trimethylglycine (Betaine monohydrate). When an array consists of dozens to hundreds of addresses, it is important that the correct ligation products have an opportunity to hybridize to the appropriate address. This may be achieved by the thermal motion of oligonucleotides at the high temperatures used, by mechanical movement of the fluid in contact with the array surface, or by moving the oligonucleotides across the array by electric fields. After hybridization, the array is washed with buffer to remove unhybridized probe and optimize detection of captured probe. Alternatively, the array is washed sequentially. The specificity of hybridization may be promoted by the addition of non-specific competitor DNA (e.g. herring sperm DNA) and/or the addition of formamide to the hybridization solution. The stringency of washing may also be augmented by elevating the washing temperature and/or adding formamide to the wash buffer. FIG. 16 shows the results of various combinations of the above alterations to standard hybridization and washing conditions.

Preferably, the solid support has a porous surface of a hydrophilic polymer composed of combinations of acrylamide with functional monomers containing carboxylate, aldehyde, or amino groups. This surface is formed by coating the support with a polyacrylamide based gel. Suitable formulations include mixtures of acrylamide/acrylic acid and N,N-dimethylacrylamide/glycerol monomethacrylate. A crosslinker, N,N'-methylenebisacryl-amide, is present at a level less than 50:1, preferably less than 500:1.

One embodiment of masking negative charges during the contacting of the solid support with the ligation mixture is achieved by using a divalent cation. The divalent cation can be $Mg^{2+}$, $Ca^{2+}$, $MN^{2+}$, or $Co^{2+}$. Typically, masking with the divalent cation is carried out by pre-hydridizing the solid support with hybridization buffer containing the cation at a minimum concentration of 10 mM for a period of 15 minutes at room temperature.

Another embodiment of masking negative charges during the contacting of the solid support with the ligation mixtures is achieved by carrying out the contacting at a pH at or below 6.0. This is effected by adding a buffer to the ligation mixtures before or during contact of it with the solid support. Suitable buffers include 2-(N-morpholino)ethanesulfonic acid (MES), sodium phosphate, and potassium phosphate.

Another embodiment of masking negative charges during the contacting of the solid support with the ligation mixture is achieved by capping free carboxylic acid groups with a neutralizing agent while preserving the hydrophillicity of the polymer. Suitable neutralizing agents include ethanolamine diethanolamine, propanolamine, dipropanolamine, isopropanolamine, and diisopropanolamine. Typically, masking with neutralizing agents is carried out by activating the carboxylic acid groups within the solid support with 1-[3-dimethylamino)propyl]-3-ethylcarbodiimide hydrochloride and N-hydroxysuccinimide followed by treatment with a solution of the neutralizing agent in a polar aprotic solvent such as chloroform, dichloromethane, or tetrahydrfuran.

By masking the negative charges in accordance with the present invention, an enhanced ability to detect the presence of ligated product in the presence of unligated oligonucleotide probes is achieved. In particular, the present invention is effective to detect the presence of ligated product in a ratio to unligated oligonucleotide probes of less than 1:300, preferably less than 1:900, more preferably less than 1:3000, and most preferably less than 1:9000.

In addition, by masking the negative charges in accordance with the present invention, an enhanced ability to detect the presence of a target nucleotide sequence from a non-target nucleotide sequence where the target nucleotide sequence differs from a non-target nucleotide sequence by a single base difference is achieved. In particular, the present invention is effective to detect target nucleotide sequence in a ratio of the target nucleotide sequence to non-target nucleotide sequence of less than 1:20, preferably less than 1:50, more preferably less than 1:100, most preferably less than 1:200.

It is important to select capture oligonucleotides and addressable nucleotide sequences which will hybridize in a stable fashion. This requires that the oligonucleotide sets and the capture oligonucleotides be configured so that the oligonucleotide sets hybridize to the target nucleotide sequences at a temperature less than that which the capture oligonucleotides hybridize to the addressable array-specific portions. Unless the oligonucleotides are designed in this fashion, false positive signals may result due to capture of adjacent unreacted oligonucleotides from the same oligonucleotide set which are hybridized to the target.

The detection phase of the process involves scanning and identifying if ligation of particular oligonucleotide sets occurred and correlating ligation to a presence or absence of the target nucleotide sequence in the test sample. Scanning can be carried out by scanning electron microscopy, confocal microscopy, charge-coupled device, scanning tunneling electron microscopy, infrared microscopy, atomic force microscopy, electrical conductance, and fluorescent or phosphor imaging. Correlating is carried out with a computer.

Another aspect of the present invention relates to a method of forming an array of oligonucleotides on a support. This method involves providing a support having an array of positions each suitable for attachment of an oligonucleotide. A linker or support (preferably non-hydrolyzable), suitable for coupling an oligonucleotide to the support at each of the array positions, is attached to the solid support. An array of oligonucleotides on a solid support is formed by a series of cycles of activating selected array positions for attachment of multimer nucleotides and attaching multimer nucleotides at the activated array positions.

Yet another aspect of the present invention relates to an array of oligonucleotides on a support per se. The support has an array of positions each suitable for an attachment of an oligonucleotide. A linker or support (preferably non-hydrolyzable), suitable for coupling an oligonucleotide to the support, is attached to the support at each of the array positions. An array of oligonucleotides are placed on a support with at least some of the array positions being occupied by oligonucleotides having greater than sixteen nucleotides.

In the method of forming arrays, multimer oligonucleotides from different multimer oligonucleotide sets are attached at different array positions on a support. As a result, the support has an array of positions with different groups of multimer oligonucleotides attached at different positions.

The 1,000 different addresses can be unique capture oligonucleotide sequences (e.g., 24-mer) linked covalently to the target-specific sequence (e.g., approximately 20- to 25-mer) of a LDR oligonucleotide probe. A capture oligonucleotide probe sequence does not have any homology to either the target sequence or to other sequences on genomes which may be present in the sample. This oligonucleotide probe is then captured by its addressable array-specific portion, a sequence complementary to the capture oligonucleotide on the addressable support array. The concept is shown in two possible formats, for example, for detection of the p53 R248 mutation (FIGS. 17A-C).

FIGS. 17A-C show two alternative formats for oligonucleotide probe design to identify the presence of a germ line mutation in codon 248 of the p53 tumor suppressor gene. The wild type sequence codes for arginine (R248), while the cancer mutation codes for tryptophan (R248W). The bottom part of the diagram is a schematic diagram of the capture oligonucleotide. The thick horizontal line depicts the membrane or surface containing the addressable array. The thin curved lines indicate a flexible linker arm. The thicker lines indicate a capture oligonucleotide sequence, attached to the solid surface in the C to N direction. For illustrative purposes, the capture oligonucleotides are drawn vertically, making the linker arm in section B appear "stretched". Since the arm is flexible, the capture oligonucleotide will be able to hybridize 5' to C and 3' to N in each case, as dictated by base pair complementarity. A similar orientation of oligonucleotide hybridization would be allowed if the oligonucleotides were attached to the membrane at the N-terminus. In this case, DNA/PNA hybridization would be in standard antiparallel 5' to 3' and 3' to 5'. Other modified sugar-phosphate backbones would be used in a similar fashion. FIG. 17B shows two LDR probes that are designed to discriminate wild type and mutant p53 by containing the discriminating base C or T at the 3' end. In the presence of the correct target DNA and Tth ligase, the discriminating probe is covalently attached to a common downstream oligonucleotide. The downstream oligonucleotide is fluorescently labeled. The discriminating oligonucleotides are distinguished by the presence of unique addressable array-specific portions, Z1 and Z2, at each of their 5' ends. A black dot indicates that target dependent ligation has taken place. After ligation, oligonucleotide probes may be captured by their complementary addressable array-specific portions at unique addresses on the array. Both ligated and unreacted oligonucleotide probes are captured by the oligonucleotide array. Unreacted fluorescently labeled common probes and target DNA are then washed away at a high temperature (approximately 65° C. to 80° C.) and low salt. Mutant signal is distinguished by detection of fluorescent signal at the capture oligonucleotide complementary to addressable array-specific portion Z1, while wild type signal appears at the capture oligonucleotide complementary to addressable array-specific portion Z2. Heterozygosity is indicated by equal signals at the capture oligonucleotides complementary to addressable array-specific portions Z1 and Z2. The signals may be quantified using a fluorescent imager. This format uses a unique address for each allele and may be preferred for achieving very accurate detection of low levels of signal (30 to 100 attomoles of LDR product). FIG. 17C shows the discriminating signals may be quantified using a fluorescent imager. This format uses a unique address where oligonucleotide probes are distinguished by having different fluorescent groups, F1 and F2, on their 5' end. Either oligonucleotide probe may be ligated to a common downstream oligonucleotide probe containing an addressable array-specific portion Z1 on its 3' end. In this format, both wild type and mutant LDR products are captured at the same address on the array, and are distinguished by their different fluorescence. This format allows for a more efficient use of the array and may be preferred when trying to detect hundreds of potential germline mutations.

The support can be made from a wide variety of materials. The substrate may be biological, nonbiological, organic, inorganic, or a combination of any of these, existing as particles, strands, precipitates, gels, sheets, tubing, spheres, containers, capillaries, pads, slices, films, plates, slides, discs, membranes, etc. The substrate may have any convenient shape, such as a disc, square, circle, etc. The substrate is preferably flat but may take on a variety of alternative surface configurations. For example, the substrate may contain raised or depressed regions on which the synthesis takes place. The substrate and its surface preferably form a rigid support on which to carry out the reactions described herein. The substrate and its surface is also chosen to provide appropriate light-absorbing characteristics. For instance, the substrate may be a polymerized Langmuir Blodgett film, functionalized glass, Si, Ge, GaAs, GaP, $SiO_2$, $SiN_4$, modified silicon, or any one of a wide variety of gels or polymers such as (poly)tetrafluoroethylene, (poly)vinylidenedifluoride, polystyrene, polycarbonate, polyethylene, polypropylene, polyvinyl chloride, poly(methyl acrylate), poly(methyl methacrylate), or combinations thereof. Other substrate materials will be readily apparent to those of ordinary skill in the art upon review of this disclosure. In a preferred embodiment, the substrate is flat glass or single-crystal silicon.

According to some embodiments, the surface of the substrate is etched using well known techniques to provide for desired surface features. For example, by way of the formation of trenches, v-grooves, mesa structures, raised platforms, or the like, the synthesis regions may be more closely placed within the focus point of impinging light, be provided with reflective "mirror" structures for maximization of light collection from fluorescent sources, or the like.

Surfaces on the substrate will usually, though not always, be composed of the same material as the substrate. Thus, the surface may be composed of any of a wide variety of materials, for example, polymers, plastics, ceramics, polysaccharides, silica or silica-based materials, carbon, metals, inorganic glasses, membranes, or composites thereof. The surface is functionalized with binding members which are attached firmly to the surface of the substrate. Preferably, the surface functionalities will be reactive groups such as silanol, olefin, amino, hydroxyl, aldehyde, keto, halo, acyl halide, or carboxyl groups. In some cases, such functionalities preexist on the substrate. For example, silica based materials have silanol groups, polysaccharides have hydroxyl groups, and synthetic polymers can contain a broad range of functional groups, depending on which monomers they are produced from. Alternatively, if the substrate does not contain the desired functional groups, such groups can be coupled onto the substrate in one or more steps.

A variety of commercially-available materials, which include suitably modified glass, plastic, or carbohydrate surfaces or a variety of membranes, can be used. Depending on the material, surface functional groups (e.g., silanol, hydroxyl, carboxyl, amino) may be present from the outset (perhaps as part of the coating polymer), or will require a separate procedure (e.g., plasma amination, chromic acid oxidation, treatment with a functionalized side chain alkyltrichlorosilane) for introduction of the functional group. Hydroxyl groups become incorporated into stable carbamate (urethane) linkages by several methods. Amino functions can be acylated directly, whereas carboxyl groups are activated, e.g., with N,N'-carbonyldiimidazole or water-soluble carbodiimides, and reacted with an amino-functionalized compound. As shown in FIG. 18, the supports can be membranes or surfaces with a starting functional group X. Functional group transformations can be carried out in a variety of ways (as needed) to provide group X* which represents one partner in the covalent linkage with group Y*. FIG. 18 shows specifically the grafting of PEG (i.e. polyethylene glycol), but the same repertoire of reactions can be used (however needed) to attach carbohydrates (with hydroxyl), linkers (with carboxyl), and/or oligonucleotides that have been extended by suitable functional groups (amino or carboxyl). In some cases, group X* or Y* is pre-activated (isolatable species from a separate reaction); alternatively, activation occurs in situ. Referring to PEG as drawn in FIG. 18, Y and Y* can be the same (homobifunctional) or different (heterobifunctional); in the latter case, Y can be protected for further control of the chemistry. Unreacted amino groups will be blocked by acetylation or succinylation, to ensure a neutral or negatively charged environment that "repels" excess unhybridized DNA. Loading levels can be determined by standard analytical methods. Fields, et al., "Principles and Practice of Solid-Phase Peptide Synthesis," *Synthetic Peptides: A User's Guide*, G. Grant, Editor, W.H. Freeman and Co.: New York. p. 77-183 (1992), which is hereby incorporated by reference.

One approach to applying functional groups on a silica-based support surface is to silanize with a molecule either having the desired functional group (e.g., olefin, amino, hydroxyl, aldehyde, keto, halo, acyl halide, or carboxyl) or a molecule A able to be coupled to another molecule B containing the desired functional group. In the former case, functionalizing of glass- or silica-based supports with, for example, an amino group is carried out by reacting with an amine compound such as 3-aminopropyl triethoxysilane, 3-aminopropylmethyldiethoxysilane, 3-aminopropyl dimethylethoxysilane, 3-aminopropyl trimethoxysilane, N-(2-aminoethyl)-3-aminopropylmethyl dimethoxysilane, N-(2-aminoethyl-3-aminopropyl) trimethoxysilane, aminophenyl trimethoxysilane, 4-aminobutyldimethyl methoxysilane, 4-aminobutyl triethoxysilane, aminoethylaminomethylphenethyl trimethoxysilane, or mixtures thereof. In the latter case, molecule A preferably contains olefinic groups, such as vinyl, acrylate, methacrylate, or allyl, while molecule B contains olefinic groups and the desired functional groups. In this case, molecules A and B are polymerized together. In some cases, it is desirable to modify the silanized surface to modify its properties (e.g., to impart biocompatibility and to increase mechanical stability). This can be achieved by addition of olefinic molecule C along with molecule B to produce a polymer network containing molecules A, B, and C.

Molecule A is defined by the following formula:

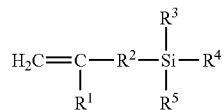

$R^1$ is H or $CH_3$ $R^2$ is (C=O)—O—$R^6$, aliphatic group with or without functional substituent(s), an aromatic group with or without functional substituent(s), or mixed aliphatic/aromatic groups with or without functional substituent(s);

$R^3$ is an O-alkyl, alkyl, or halogen group;

$R^4$ is an O-alkyl, alkyl, or halogen group;

$R^5$ is an O-alkyl, alkyl, or halogen group; and $R^6$ is an aliphatic group with or without functional substituent(s), an aromatic group with or without functional substituent(s), or mixed aliphatic/aromatic groups with or without functional substituent(s). Examples of Molecule A include 3-(trimethoxysilyl)propyl methacrylate, N-[3-(trimethoxysilyl)propyl]-N'-(4-vinylbenzyl)ethylenediamine, triethoxyvinylsilane, triethylvinylsilane, vinyltrichlorosilane, vinyltrimethoxysilane, and vinylytrimethylsilane.

Molecule B can be any monomer containing one or more of the functional groups described above. Molecule B is defined by the following formula:

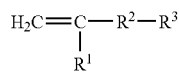

(i) $R^1$ is H or $CH_3$,
    $R^2$ is (C=O), and
    $R^3$ is OH or Cl.
or
(ii) $R^1$ is H or $CH_3$ and
    $R^2$ is (C=O)—O—$R^4$, an aliphatic group with or without functional substituent(s), an aromatic group with or without functional substituent(s), and mixed aliphatic/aromatic groups with or without functional substituent(s); and
    $R^3$ is a functional group, such as OH, COOH, $NH_2$, halogen, SH, COCl, or active ester; and
    $R^4$ is an aliphatic group with or without functional substituent(s), an aromatic group with or without functional substituent(s), or mixed aliphatic/aromatic groups with or without functional substituent(s). Examples of molecule B include acrylic acid, acrylamide, methacrylic acid, vinylacetic acid, 4-vinylbenzoic acid, itaconic acid, allyl amine, allylethylamine, 4-aminostyrene, 2-aminoethyl methacrylate, acryloyl chloride, methacryloyl chloride, chlorostyrene, dichlorostyrene, 4-hydroxystyrene, hydroxymethyl styrene, vinylbenzyl alcohol, allyl alcohol, 2-hydroxyethyl methacrylate, or poly(ethylene glycol) methacrylate.

Molecule C can be any molecule capable of polymerizing to molecule A, molecule B, or both and may optionally contain one or more of the functional groups described above.

Molecule C can be any monomer or cross-linker, such as acrylic acid, methacrylic acid, vinylacetic acid, 4-vinylbenzoic acid, itaconic acid, allyl amine, allylethylamine, 4-aminostyrene, 2-aminoethyl methacrylate, acryloyl chloride, methacryloyl chloride, chlorostyrene, dichlorostyrene, 4-hydroxystyrene, hydroxymethyl styrene, vinylbenzyl alcohol, allyl alcohol, 2-hydroxyethyl methacrylate, poly(ethylene glycol) methacrylate, methyl acrylate, methyl methacrylate, ethyl acrylate, ethyl methacrylate, styrene, 1-vinylimidazole, 2-vinylpyridine, 4-vinylpyridine, divinylbenzene, ethylene glycol dimethacryarylate, N,N'-methylenediacrylamide, N,N'-phenylenediacrylamide, 3,5-bis(acryloylamido)benzoic acid, pentaerythritol triacrylate, trimethylolpropane trimethacrylate, pentaerythritol tetraacrylate, trimethylolpropane ethoxylate (14/3 EO/OH) triacrylate, trimethyolpropane ethoxylate (7/3 EO/OH) triacrylate, triethylolpropane propoxylate (1 PO/OH) triacrylate, or trimethyolpropane propoxylate (2 PO/PH triacrylate).

Generally, the functional groups serve as staring points for oligonucleotides that will ultimately be coupled to the support. These functional groups can be reactive with an organic group that is to be attached to the support or it can be modified to be reactive with that group, as through the use of linkers or handles. The functional groups can also impart various desired properties to the support.

After functionalization (if necessary) of the support, tailor-made polymer networks containing activated functional groups that may serve as carrier sites for complementary oligonucleotide capture probes can be grafted to the support. The advantage of this approach is that the loading capacity of capture probes can thus be increased significantly, while physical properties of the intermediate solid-to-liquid phase can be controlled better. Parameters that are subject to optimization include the type and concentration of functional group-containing monomers, as well as the type and relative concentration of the crosslinkers that are used.

The surface of the functionalized substrate is preferably provided with a layer of linker molecules, although it will be understood that the linker molecules are not required elements of the invention. The linker molecules are preferably of sufficient length to permit polymers in a completed substrate to interact freely with molecules exposed to the substrate. The linker molecules should be 6-50 atoms long to provide sufficient exposure. The linker molecules may be, for example, aryl acetylene, ethylene glycol oligomers containing 2-10 monomer units, diamines, diacids, amino acids, or combinations thereof.

According to alternative embodiments, the linker molecules are selected based upon their hydrophilic/hydrophobic properties to improve presentation of synthesized polymers to certain receptors. For example, in the case of a hydrophilic receptor, hydrophilic linker molecules will be preferred to permit the receptor to approach more closely the synthesized polymer.

According to another alternative embodiment, linker molecules are also provided with a photocleavable group at any intermediate position. The photocleavable group is preferably cleavable at a wavelength different from the protective group. This enables removal of the various polymers following completion of the syntheses by way of exposure to the different wavelengths of light.

The linker molecules can be attached to the substrate via carbon-carbon bonds using, for example, (poly)tri-fluorochloroethylene surfaces or, preferably, by siloxane bonds (using, for example, glass or silicon oxide surfaces). Siloxane bonds with the surface of the substrate may be formed in one embodiment via reactions of linker molecules bearing trichlorosilyl groups. The linker molecules may optionally be attached in an ordered array, i.e., as parts of the head groups in a polymerized monolayer. In alternative embodiments, the linker molecules are adsorbed to the surface of the substrate.

As an example of assembling arrays with multimers, such assembly can be achieved with tetramers. Of the 256 ($4^4$) possible ways in which four bases can be arranged as tetramers, 36 that have unique sequences can be selected. Each of the chosen tetramers differs from all the others by at least two bases, and no two dimers are complementary to each other. Furthermore, tetramers that would result in self-pairing or hairpin formation of the addresses have been eliminated.

The final tetramers are listed in Table 1 and have been numbered arbitrarily from 1 to 36. This unique set of tetramers are used as design modules for the sometimes desired 24-mer capture oligonucleotide address sequences. The structures can be assembled by stepwise (one base at a time) or convergent (tetramer building blocks) synthetic strategies. Many other sets of tetramers may be designed which follow the above rules. The segment approach is not uniquely limited to tetramers, and other units, i.e. dimers, trimers, pentamers, or hexamers could also be used.

TABLE 1

List of tetramer PNA sequences and complementary DNA sequences, which differ from each other by at least 2 bases.

| Number | Sequence (N-C) | Complement (5'-3') | G + C |
|---|---|---|---|
| 1. | TCTG | CAGA | 2 |
| 2. | TGTC | GACA | 2 |
| 3. | TCCC | GGGA | 3 |
| 4. | TGCG | CGCA | 3 |
| 5. | TCGT | ACGA | 2 |
| 6. | TTGA | TCAA | 1 |
| 7. | TGAT | ATCA | 1 |
| 8. | TTAG | CTAA | 1 |
| 9. | CTTG | CAAG | 2 |
| 10. | CGTT | AACG | 2 |
| 11. | CTCA | TGAG | 2 |
| 12. | CACG | CGTG | 3 |
| 13. | CTGT | ACAG | 2 |
| 14. | CAGC | GCTG | 3 |
| 15. | CCAT | ATGG | 2 |
| 16. | CGAA | TTCG | 2 |
| 17. | GCTT | AAGC | 2 |
| 18. | GGTA | TACC | 2 |
| 19. | GTCT | AGAC | 2 |
| 20. | GACC | GGTC | 3 |
| 21. | GAGT | ACTC | 2 |
| 22. | GTGC | GCAC | 3 |
| 23. | GCAA | TTGC | 2 |
| 24. | GGAC | GTCC | 3 |
| 25. | AGTG | CACT | 2 |
| 26. | AATC | GATT | 1 |
| 27. | ACCT | AGGT | 2 |
| 28. | ATCG | CGAT | 2 |
| 29. | ACGG | CCGT | 3 |
| 30. | AGGA | TCCT | 2 |
| 31. | ATAC | GTAT | 1 |
| 32. | AAAG | CTTT | 1 |
| 33. | CCTA | TAGG | 2 |
| 34. | GATG | CATC | 2 |
| 35. | AGCC | GGCT | 3 |
| 36. | TACA | TGTA | 1 |

Note that the numbering scheme for tetramers permits abbreviation of each address as a string of six numbers (e.g., second column of Table 2 infra). The concept of a 24-mer address designed from a unique set of 36 tetramers (Table 1) allows a huge number of possible structures, $36^6=2,176,782,336$.

FIG. 19 shows one of the many possible designs of 36 tetramers which differ from each other by at least 2 bases. The checkerboard pattern shows all 256 possible tetramers. A given square represents the first two bases on the left followed by the two bases on the top of the checkerboard. Each tetramer must differ from each other by at least two bases, and should be non-complementary. The tetramers are shown in the white boxes, while their complements are listed as (number)'. Thus, the complementary sequences GACC (20) and GGTC (20') are mutually exclusive in this scheme. In addition, tetramers must be non-palindromic, e.g., TCGA (darker diagonal line boxes), and non-repetitive, e.g., CACA (darker diagonal line boxes from upper left to lower right). All other sequences which differ from the 36 tetramers by only 1 base are shaded in light gray. Four potential tetramers (white box) were not chosen as they are either all A•T or G•C bases. However, as shown below, the $T_m$ values of A•T bases can be raised to almost the level of G•C bases. Thus, all A•T or G•C base tetramers (including the ones in white boxes) could potentially be used in a tetramer design. In addition, thymine can be replaced by 5-propynyl uridine when used within capture oligonucleotide address sequences as well as in the oligonucleotide probe addressable array-specific portions. This would increase the $T_m$ of an A•T base pair by ~1.7° C. Thus, $T_m$ values of individual tetramers should be approximately 15.1° C. to 15.7° C. $T_m$ values for the full length 24-mers should be 95° C. or higher.

To illustrate the concept, a subset of six of the 36 tetramer sequences were used to construct arrays: 1=TGCG; 2=ATCG; 3=CAGC; 4=GGTA; 5=GACC; and 6=ACCT. This unique set of tetramers can be used as design modules for the required 24-mer addressable array-specific portion and 24-mer complementary capture oligonucleotide address sequences. This embodiment involves synthesis of five addressable array-specific portion (sequences listed in Table 2). Note that the numbering scheme for tetramers allows abbreviation of each portion (referred to as "Zip #") as a string of six numbers (referred to as "zip code").

TABLE 2

List of all 5 DNA/PNA oligonucleotide address sequences.

| Zip # | Zip code | Sequence (5' → 3' or NH$_2$ → COOH) | G + C |
|---|---|---|---|
| Zip11 | 1-4-3-6-6-1 | TGCG-GGTA-CAGC-ACCT-ACCT-TGCG (SEQ ID NO:9268) | 15 |
| Zip12 | 2-4-4-6-1-1 | ATCG-GGTA-GGTA-ACCT-TGCG-TGCG (SEQ ID NO:9269) | 14 |
| Zip13 | 3-4-5-6-2-1 | CAGC-GGTA-GACC-ACCT-ATCG-TGCG (SEQ ID NO:9270) | 15 |
| Zip14 | 4-4-6-6-3-1 | GGTA-GGTA-ACCT-ACCT-CAGC-TGCG (SEQ ID NO:9271) | 14 |
| Zip15 | 5-4-1-6-4-1 | GACC-GGTA-TGCG-ACCT-GGTA-TGCG (SEQ ID NO:9270) | 15 |

Each of these oligomers contains a hexaethylene oxide linker arm on their 5' termini [P. Grossman, et al., *Nuci. Acids Res.*, 22:4527-4534 (1994), which is hereby incorporated by reference], and ultimate amino-functions suitable for attachment onto the surfaces of glass slides, or alternative materials. Conjugation methods will depend on the free surface functional groups [Y. Zhang, et al., *Nucleic Acids Res.*, 19:3929-3933 (1991) and Z. Guo, et al., *Nucleic Acids Res.*, 34:5456-5465 (1994), which are hereby incorporated by reference].

Synthetic oligonucleotides (normal and complementary directions, either for capture hybridization or hybridization/ligation) are prepared as either DNA or PNA, with either natural bases or nucleotide analogues. Such analogues pair with perfect complementarity to the natural bases but increase $T_m$ values (e.g., 5-propynyl-uracil).

In accordance with the present invention, false hybridization signals from DNA synthesis errors are avoided. Addresses can be designed so there are very large differences in hybridization $T_m$ values to incorrect address. In contrast, the direct hybridization approaches depend on subtle differences. The present invention also eliminates problems of false data interpretation with gel electrophoresis or capillary electrophoresis resulting from either DNA synthesis errors, band broadening, or false band migration.

The use of a capture oligonucleotide to detect the presence of ligation products, eliminates the need to detect single-base differences in oligonucleotides using differential hybridization. Other existing methods in the prior art relying on allele-specific PCR, differential hybridization, or sequencing-by-hybridization methods must have hybridization conditions optimized individually for each new sequence being analyzed. When attempting to detect multiple mutations simultaneously, it becomes difficult or impossible to optimize hybridization conditions. In contrast, the present invention is a general method for high specificity detection of correct signal, independent of the target sequence, and under uniform hybridization conditions. The present invention yields a flexible method for discriminating between different oligonucleotide sequences with significantly greater fidelity than by any methods currently available within the prior art.

The array of the present invention will be universal, making it useful for detection of cancer mutations, inherited (germ-line) mutations, and infectious diseases. Further benefit is obtained from being able to reuse the array, lowering the cost per sample.

The present invention also affords great flexibility in the synthesis of oligonucleotides and their attachment to supports. Oligonucleotides can be synthesized off of the support and then attached to unique surfaces on the support. Segments of multimers of oligonucleotides, which do not require intermediate backbone protection (e.g., PNA), can be synthesized and linked onto to the solid support. Added benefit is achieved by being able to integrate these synthetic approaches with design of the capture oligonucleotide addresses. Such production of solid supports is amenable to automated manufacture, obviating the need for human intervention and resulting contamination concerns.

An important advantage of the array of the present invention is the ability to reuse it with the previously attached capture oligonucleotides. In order to prepare the solid support for such reuse, the captured oligonucleotides must be removed without removing the linking components connecting the captured oligonucleotides to the solid support. A variety of procedures can be used to achieve this objective. For example, the solid support can be treated in distilled water at 95-100° C., subjected to 0.01 N NaOH at room temperature, contacted with 50% dimethylformamide at 90-95° C., or treated with 50% formamide at 90-95° C. Generally, this procedure can be used to remove captured oligonucleotides in about 5 minutes. These conditions are suitable for disrupting DNA-DNA hybridizations; DNA-PNA hybridizations require other disrupting conditions.

The present invention is illustrated, but not limited, by the following examples.

EXAMPLES

Example 1

Materials and Methods

Oligonucleotide Synthesis and Purification. Oligonucleotides were obtained as custom synthesis products from IDT, Inc. (Coralville, Iowa), or synthesized in-house on an ABI 394 DNA Synthesizer (PE Biosystems Inc.; Foster City, Calif.) using standard phosphoramidite chemistry. Spacer phosphoramidite 18, 3'-amino-modifer C3 CPG, and 3'-fluorescein CPG were purchased from Glen Research (Sterling, Va.). All other reagents were purchased from PE Biosystems. Both labeled and unlabeled oligonucleotides were purified by electrophoresis on 12% denaturing polyacrylamide gels. Bands were visualized by UV shadowing, excised from the gel, and eluted overnight in 0.5 M NaCl, 5 mM EDTA, pH 8.0 at 37° C. Oligonucleotide solutions were desalted on C18 Sep-Paks (Waters Corporation; Milford, Mass.) according to the manufacturer's instructions, following which the oligonucleotides were concentrated to dryness (Speed-Vac) and stored at −20° C.

Cleaning of Microscope slides. Glass microscope slides (VWR, precleaned, 3 in.×1 in.×1.2 mm) were incubated in boiling conc. NH$_4$OH −30% H$_2$O$_2$—H$_2$O (1:1:5, v/v/v) for 10 min and rinsed in distilled water. A second incubation was performed in boiling conc. HCl −30% H$_2$O$_2$—H$_2$O for 10 min. See U. Jönsson, et al., "Absorption Behavior of Fibronetin on Well Characterized Silica Surfaces," *J. Colloid Interface Sci.* 90:148-163 (1982), which is hereby incorporated by reference. The slides were rinsed thoroughly in distilled water, methanol, and acetone, and were air-dried at room temp.

Polymer Coated Slides. Immediately following cleaning, slides (Fisher Scientific, precleaned, 3 in.×1 in.×1.2 mm) were immersed in 2% methacryloxypropyltrimethoxysilane, 0.2% triethylamine in $CHCl_3$ for 30 min at 25° C., and then washed with $CHCl_3$ (2×15 min). A monomer solution [20 μL: 8% acrylamide, 2% acrylic acid, 0.02% N,N'-methylenebisacrylamide (500:1 ratio of monomers:crosslinker), 0.8% ammonium persulfate radical polymerization initiator] was deposited on one end of the slides and spread out with the aid of a cover slip (24×50 mm) that had been previously silanized [5% $(CH_3)_2SiCl_2$ in $CHCl_3$]. Polymerization was achieved by heating the slides on a 70° C. hot plate for 4.5 min. Upon removal of the slides from the hot plate, the cover slips were immediately peeled off with aid of a single-edge razor blade. The coated slides were rinsed with deionized water, allowed to dry in an open atmosphere, and stored under ambient conditions.

Preparation of Zip-Code Arrays. Polymer-coated slides were pre-activated by immersing them for 30 min at 25° C. in a solution of 0.1 M 1-[3-(dimethylamino)propyl]-3-ethylcarbodiimide hydrochloride plus 20 mM N-hydroxysuccinimide in 0.1 M $K_2HPO_4/KH_2PO_4$, pH 6.0. The activated slides were rinsed with water, and then dried in a 65° C. oven; they were stable upon storage for 6 months or longer at 25° C. in a desiccator over Drierite.

Arrays were spotted on a Cartesian Technologies Pixsys 5500 robot at 25° C. and 70% relative humidity using 500 μM zip-code oligonucleotide solutions in 0.2 M $K_2HPO_4/KH_2PO_4$, pH 8.3. Each address was spotted in quadruplicate. Additionally, Cy3, Cy5, and fluorescein fiducials were printed along the top and down the right hand side of each array. Following spotting, uncoupled oligonucleotides were removed from the polymer surfaces by soaking the slides in 300 mM bicine, pH 8.0, 300 mM NaCl, 0.1% SDS, for 30 min at 65° C., rinsing with water, and drying. The arrays were stored at 25° C. in slide boxes until needed.

PCR Amplification of K-ras DNA Samples. PCR amplifications were carried out under paraffin oil in 50 μL reaction mixtures containing 10 mM Tris.HCl, pH 8.3, 4 mM $MgCl_2$, 50 mM KCl, 800 μM dNTPs, 1 μM forward and reverse primers (50 pmol of each primer; K-rasEx1forward and K-rasEx1reverse (Table 3)), 1 U AmpliTaq Gold, and 100 ng of genomic DNA extracted from paraffin-embedded tumors or from cell lines. Reactions were preincubated for 10 min at 95° C. Amplification was achieved by thermally cycling for 40 rounds of 94° C. for 30 sec; 60° C. for 1 min; and 72° C. for 1 min, followed by a final elongation at 72° C. for 5 min. Following PCR, 1 μL of Proteinase K (18 mg/mL) was added, and reactions were heated to 70° C. for 10 min and then quenched at 95° C. for 15 min. Two μl L of each PCR product was analyzed on a 3% agarose gel to verify the presence of amplification product of the expected size.

LDR of K-ras DNA samples. LDR was carried out under paraffin oil in 20 μL volumes containing 20 mM Tris.HCl, pH 8.5-5 mM $MgCl_2$-100 mM KCl, 10 mM DTT, 1 mM $NAD^+$, 10 pmol total LDR probes [500 fmol each of fluorescently-labeled discriminating probes (K-rasc32Wt, labeled with Cy3, Cy5, and fluorescein; K-rasc12.2D labeled with Cy3; K-rasc12.2A labeled with Cy5; K-rasc12.2V labeled with fluorescein; K-rasc12.1S labeled with Cy3; K-rasc12.1R, labeled with Cy5; K-rasc12.1C, labeled with fluorescein; and K-rasc13.4D labeled with Cy3)+5 pmol total common probes; (1500 fmol each of K-rascd32Com9cZip1, K-rascd12Com2cZip2, and K-rascd12Com1cZip3, and 500 fmol of K-rascd13Com4cZip4) (Table 3)], and 2 μL PCR products from the cell line or tumor samples. The reaction mixtures were pre-heated for 2 min at 94° C., and then 25 fmol of wild-type Tth DNA ligase was added. The LDR reaction mixtures were cycled for 20 rounds of 94° C. for 30 sec and 65° C. for 4 min.

Hybridization of K-ras LDR Products to DNA Arrays. The LDR reaction mixtures were diluted with 20 μL of 2× hybridization buffer to produce a final buffer concentration of 300 mM MES, pH 6.0, 10 mM $MgCl_2$, 0.1% SDS, denatured at 94° C. for 3 min, and chilled on ice. Arrays were pre-incubated for 15 min at 25° C. in 1× hybridization buffer. Coverwells (Grace, Inc; Sunriver, Oreg.) were attached to the arrays and filled with 30 μL of the diluted LDR reaction mixtures. The arrays were placed in humidified culture tubes and incubated for 1 h at 65° C. and 20 rpm in a rotating hybridization oven. Following hybridization, the arrays were washed in 300 mM bicine, pH 8.0, 10 mM $MgCl_2$, 0.1% SDS for 10 min at 25° C. Fluorescent signals were measured using a Scanarray 5000 (GSI Lumonics).

LDR detection of 7 specific mutations in K-ras on an addressable universal microarray is shown in FIG. 36. The three signals along the top and those down the right hand side of each array are fiducials used for alignment. The next 4 addresses across in the second row correspond to addresses #1, #2, #3, and #4, complements of cZip1, cZip2, cZip3, and cZip4, respectively. The eight cell line (i.e. COLO205, LS180, SW1116, SW480, and DLD1) and tumor samples (G12S, G12R, and G12C) correctly identified the mutations present. Wild-type cell line COLO205 gave Cy3, Cy5, and fluorescein signal at address #1. The wild-type signal at address #1 was used as a control for all experiments. The LS180 cell line containing the Asp12 mutation gave a Cy3 signal at address #2. The SW116 cell line containing the Ala12 mutation gave a Cy5 signal at address #2. The SW480 cell line containing the Val12 mutation gave a fluorescein signal at address #2. The G12S tumor sample containing the Ser12 mutation gave a Cy3 signal at address #3. The G12R tumor sample containing the Arg12 mutation gave a Cy5 signal at address #3. The G12C tumor sample containing the Cys12 mutation gave a fluorescein signal at address #3. The DLD1 cell line containing the Asp13 mutation gave a Cy3 signal at address #4. The incorrect signals seen at Zip4 in the LS180 and SW1116 samples were due to contamination of the samples.

TABLE 3

Primers designed for mutation detection in K-ras by PCR/LDR/Array Hybridization.

| Primer | Sequence (5'→3') |
|---|---|
| K-rasEx1forward | AAC CTT ATG TGT GAC ATG TTC TAA TAT AGT CAC (SEQ ID NO:9273) |

TABLE 3-continued

Primers designed for mutation detection in K-ras by PCR/LDR/Array Hybridization.

| Primer | Sequence (5'→3') |
|---|---|
| K-rasEx1reverse | AAA ATG GTC AGA GAA ACC TTT ATC TGT ATC (SEQ ID NO:9274) |
| K-rascd32Com9cZip1 | PTATGATCCAACAATAGAGGTAAATCTTGTCGCAGATTT TGCGCTGGATTTCAA (SEQ ID NO:9275) |
| K-rasc32Wt | Cy3-ATTCAGAATCATTTTGTGGACGAA (SEQ ID NO:9276) |
| | Cy5-ATTCAGAATCATTTTGTGGACGAA (SEQ ID NO:9276) |
| | Fam-ATTCAGAATCATTTTGTGGACGAA (SEQ ID NO:9276) |
| K-rascd12Com2cZip2 | PTGGCGTAGGCAAGAGTGCCTTTCGCCGTCGTGTAGGCT TTTCAA (SEQ ID NO:9277) |
| K-rasc12.2D | Cy3-AAACTTGTGGTAGTTGGAGCTGA (SEQ ID NO:9278) |
| K-rasc12.2A | Cy5-AAACTTGTGGTAGTTGGAGCTGC (SEQ ID NO:9279) |
| K-rasc12.2V | Fam-AAACTTGTGGTAGTTGGAGCTGT (SEQ ID NO:9280) |
| K-rascd12Com1cZip3 | PGTGGCGTAGGCAAGAGTGCCCCGTAAGCCCGTATGGC AGATCAA (SEQ ID NO:9281) |
| K-rasc12.1S | Cy3-ATATAAACTTGTGGTAGTTGGAGCTA (SEQ ID NO:9282) |
| K-rasc12.1R | Cy5-ATATAAACTTGTGGTAGTTGGAGCTC (SEQ ID NO:9283) |
| K-rasc12.1C | Fam-ATATAAACTTGTGGTAGTTGGAGCTT (SEQ ID NO:9284) |
| K-rascd13Com4cZip4 | PCGTAGGCAAGAGTGCCTTGACATGGCCGTGCTGGGGA CAAGTCAA (SEQ ID NO:9285) |
| K-rasc13.4D | Cy3-TGTGGTAGTTGGAGCTGGTGA (SEQ ID NO:9286) |

Amplification was achieved by thermal cycling for 40 rounds of 94° C. for 15 sec and 60° C. for 2 min, followed by a final elongation step at 65° C. for 5 min. Following PCR, 1 µL of Proteinase K (18 mg/mL) was added, and reactions were heated to 70° C. for 10 min and then quenched at 95° C. for 15 min. One µL of each PCR product was analyzed on a 3% agarose gel to verify the presence of amplification product of the expected size.

LDR of K-ras DNA samples. LDR reactions were carried out under paraffin oil in 20 µL volumes containing 20 mM Tris.HCl, pH 8.5, 5 mM MgCl$_2$, 100 mM KCl, 10 mM DTT, 1 mM NAD$^+$, 8 pmol total LDR probes (500 fmol each of discriminating probes+4 pmol fluorescently-labeled common probes), and 1 pmol PCR products from cell line or tumor samples. Two probe mixes were prepared, each containing the seven mutation-specific probes, the three common probes, and either the wild-type discriminating probe for codon 12 or that for codon 13 (Table 3).

The reaction mixtures were pre-heated for 2 min at 94° C., and then 25 fmol of wild-type Tth DNA ligase was added. The LDR reactions were cycled for 20 rounds of 94° C. for 15 sec and 65° C. for 4 min. An aliquot of 2 µL of each reaction was mixed with 2 L of gel loading buffer [8% blue dextran, 50 mM EDTA, pH 8.0—formamide (1:5)], denatured at 94° C. for 2 min, and chilled on ice. One µL of each mixture was loaded on a 10% denaturing polyacrylamide gel and electrophoresed on an ABI 377 DNA sequencer at 1500 volts.

Hybridization of K-ras LDR Products to DNA Arrays. The LDR reactions (17 µL) were diluted with 40 µL of 1.4× hybridization buffer to produce a final buffer concentration of 300 mM MES, pH 6.0, 10 mM MgCl$_2$, 0.1% SDS. Arrays were pre-incubated for 15 min at 25° C. in 1× hybridization buffer. Coverwells (Grace, Inc; Sunriver, Oreg.) were filled with the diluted LDR reactions and attached to the arrays. The arrays were placed in humidified culture tubes and incubated for 1 h at 65° C. and 20 rpm in a rotating hybridization oven.

Following hybridization, the arrays were washed in 300 mM bicine, pH 8.0, 10 mM MgCl$_2$, 0.1% SDS for 10 min at 25° C. Fluorescent signals were measured using a microscope/CCD, as described in the following paragraph.

Image Analysis. Arrays were imaged using a Molecular Dynamics FluorImager 595 (Sunnyvale, Calif.) or an Olympus AX70 epifluorescence microscope (Melville, N.Y.) equipped with a Princeton Instruments TE/CCD-512 TKBM1 camera (Trenton, N.J.). For analysis of fluorescein-labeled probes on the FluorImager, the 488 nm excitation was used with a 530/30 emission filter. The spatial resolution of scans was 100 µm per pixel. The resulting images were analyzed using ImageQuaNT software provided with the instrument. The epifluorescence microscope was equipped with a 100 W mercury lamp, a FITC filter cube (excitation 480/40, dichroic beam splitter 505, emission 535/50), a Texas Red filter cube (excitation 560/55, dichroic beam splitter 595, emission 645/75), and a 100 mm macro objective. The macro objective allows illumination of an object field up to 15 mm in diameter and projects a 7×7 mm area of the array onto the 12.3×12.3 mm matrix of the CCD. Images were collected in 16-bit mode using the Winview32 software provided with the camera Analysis was performed using Scion Image (Scion Corporation, Frederick, Md.).

Example 2

Amplification of BRCA1 and BRCA2 Exons for PCR/PCR/LDR Detection of Wild-Type and Mutant Alleles A multiplex assay was used to detect small insertions and deletions using a modified PCR to evenly amplify each amplicon (PCR/PCR) (Belgrader et al., "A Multiplex PCR-Ligase Detection Reaction Assay for Human Identity Testing," *Genome Science and Technology* 1:77-87 (1996), which is hereby incorporated by reference) followed by ligase detection reaction ("LDR") (Khanna, M. et al., "Multiplex PCR/LDR for Detection of K-ras Mutations in Primary Colon Tumors," *Oncogene* 18:27-38 (1999), which is hereby incorporated by reference). FIG. 20 shows how multiplex amplification of the relevant exons is carried out to ensure equal amplification of all products: a limited number of PCR cycles was performed using gene-specific primers, with further rounds of amplification primed from the universal sequences located at the extreme 5'-ends of the PCR primers. This approach minimizes amplification bias due to primer-specific effects. LDR was next used to detect both wild-type and mutant versions of the queried sequence. The ligation oligonucleotides probes hybridize to both wild-type and mutant products, but ligate only when both probes are perfectly matched with no gaps or overlaps. Products can be either eletrophoretically separated or hybridized to a microarray for identification.

PCR was carried out as a single-tube, multiplex reaction in order to simultaneously amplify BRCA1 exons 2 and 20 and BRCA2 exon 11. Genomic DNA was extracted from blood samples of Ashkenazi Jewish individuals and amplified in a 25 µl reaction mixture containing 100 ng of DNA, 400 µM of each dNTP, 1× PCR Buffer II (10 mM Tris-HCl pH 8.3 at 25° C., 50 mM KCl) supplemented with 4 mM MgCl$_2$, 1 U AmpliTaq Gold and 2 pmol of each gene-specific primer bearing either universal primer A or B on the 5' ends. Table 4 shows the primers and probes for detection of BRCA1 and BRCA2 mutations using PCR/LDR/array hybridization as follows:

TABLE 4

Primers and Probes designed for mutation detection in BRCA1 and BRCA2 by PCR/LDR/Array Hybridization.

| Primer | Sequence (5'->3') |
|---|---|
| PCR primers: | |
| Universal primer A (Uni A) | 5' ggagcacgctatcccgttagac 3' (SEQ ID NO:9287) |
| Universal primer B (Uni B) | 5' cgctgccaactaccgcacatg 3' (SEQ ID NO:9288) |
| BRCA1 exon 2 forward | 5' Uni A-TCATTGGAACAGAAAGAAATGGATTTATC 3' (SEQ ID NO:9289) |
| BRCA1 exon 2 reverse | 5' Uni B-TCTTCCCTAGTATGTAAGGTCAATTCTGTTC 3' (SEQ ID NO:9290) |
| BRCA1 exon 20 forward | 5' Uni A-ACTTCCATTGAAGGAAGCTTCTCTTTC 3' (SEQ ID NO:9291) |
| BRCA1 exon 20 reverse | 5' Uni B-ATCTCTGCAAAGGGGAGTGGAATAC 3' (SEQ ID NO:9292) |
| BRCA2 exon 11 forward | 5' Uni A-CAAAATATGTCTGGATTGGAGAAAGTTTC 3' (SEQ ID NO:9293) |
| BRCA2 exon 11 reverse | 5' Uni B-TTGGAAAAGACTTGCTTGGTACTATCTTC 3' (SEQ ID NO:9294) |
| LDR Gel-Based Assay: Discriminating Oligonucleotide Probes: | |
| BRCA1 ex 2 wild-type position 185 | 5' Fam-aaCATTAATGCTATGCAGAAAATCTTAGAG 3' (SEQ ID NO:9295) |
| BRCA1 ex 2 position 185 del AG mutation | 5' Tet-GTCATTAATGCTATGCAGAAAATCTTAG 3' (SEQ ID NO:9296) |
| BRCA1 ex 20 wild-type position 5382 | 5' Fam-CCAAAGCGAGCAAGAGAATCC 3' (SEQ ID NO:9297) |
| BRCA1 ex 20 position 5382 ins C mutation | 5' Tet-aaCAAAGCGAGCAAGAGAATCCC 3' (SEQ ID NO:9298) |
| BRCA2 ex 11 wild-type position 6174 | 5' Fam-caCTTGTGGGATTTTTAGCACAGCAAGT 3' (SEQ ID NO:9299) |
| BRCA2 ex 11 position 6174 del T mutation | 5' Tet-TACTTGTGGGATTTTTAGCACAGCAAG 3' (SEQ ID NO:9300) |
| LDR Common Oligonucleotide Probes: | |
| BRCA1 ex 2 position 185 | 5' P-TGTCCCATCTGGTAAGTCAGCACAAAC-B 3' (SEQ ID NO:9301) |
| BRCA1 ex 20 position 5382 | 5' P-CAGGACAGAAAGGTAAAGCTCCCTC-B 3' (SEQ ID NO:9302) |

TABLE 4-continued

Primers and Probes designed for mutation detection in BRCA1 and BRCA2 by PCR/LDR/Array Hybridization.

| Primer | Sequence (5'->3') |
|---|---|
| BRCA2 ex 11 position 6174 | 5' P-GGAAAATCTGTCCAGGTATCAGAT-B 3' (SEQ ID NO:9303) |
| LDR Microarray Assay: Discriminating Oligonucleotide Probes: | |
| BRCA1 ex 2 control | 5' Cy3-TGCATAGGAGATAATCATAGGAATCC 3' (SEQ ID NO:9304) |
| BRCA1 ex 2 position 185 del AG mutation | 5' Cy3-GTCATTAATGCTATGCAGAAAATCTTAG 3' (SEQ ID NO:9305) |
| BRCA1 ex 20 control | 5' Cy3-CCTCTGACTTCAAAATCATGCTG 3' (SEQ ID NO:9306) |
| BRCA1 ex 20 position 5382 ins C mutation | 5' Cy3-CAAAGCGAGCAAGAGAATCCC 3' (SEQ ID NO:9307) |
| BRCA2 ex 11 control | 5' Cy3-CTTCCCTATACTACATTTACATATATCTGAAG 3' (SEQ ID NO:9308) |
| BRCA2 ex 11 position 6174 del T mutation | 5' Cys-TACTTGTGGGATTTTTAGCACAGCAAG 3' (SEQ ID NO:9309) |
| Common Oligonucleotide Probes for Controls: | |
| BRCA1 exon 2 control + cZip 1 | 5'P-CAAATTAATACACTCTTGTGCTGACTTACCA-cgcagattttgcgctggatttcaa-B 3' (SEQ ID NO:9310) |
| BRCA1 exon 20 control + cZip 2 | 5' P-AAAGAAACCAAACACAACCCATCAG-ttcgccgtcgtgtaggcttttcaa-B 3' (SEQ ID NO:9311) |
| BRCA2 exon 11 control + cZip 3 | 5' P-TTTCCAAACTAACATCACAAGGTGATATTT-ccgtaagcccgtatggcagatcaa-B 3' (SEQ ID NO:9312) |
| Common Oligonucleotide Probes for Mutations: | |
| BRCA1 exon 2 position 185 + cZip 9 | 5' P-TGTCCCATCTGGTAAGTCAGCACAAAC-catcgtcccttcgatgggatcaa-B 3' (SEQ ID NO:9313) |
| BRCA1 exon 20 position 5382 + cZip 10 | 5' P-CAGGACAGAAAGGTAAAGCTCCCTC-caaggcacgtcccagacgcatcaa-B 3' (SEQ ID NO:9314) |
| BRCA2 exon 11 position 6174 + cZip 11 | 5' P-GGAAAATCTGTCCAGGTATCAGAT-gcacgggagctgacgacgtgtcaa-B 3' (SEQ ID NO:9315) |

The reaction was overlaid with mineral oil and preincubated for 10 mm at 95° C. Amplification was performed for 15 cycles as follows: 94° C. for 15 sec, 65° C. for 1 mm. A second 25 µl aliquot of the reaction mixture was added through the mineral oil containing 25 pmol each of universal primers A and B. Cycling was repeated using 55° C. annealing temperature. The reaction was next digested with a 2 µl solution of 1 mg/ml Proteinase K/50 mM EDTA at 55° C. for 10 min. Proteinase K was eliminated by a final incubation at 90° C. for 15 min. For LDR, oligonucleotide synthesis and purification were carried out as previously described (Khanna et al., "Multiplex PCR/LDR for Detection of K-ras Mutations in Primary Colon Tumors," *Oncogene* 18:27-38 (1999), which is hereby incorporated by reference). Tth DNA ligase was overproduced and purified as described elsewhere (Luo et al., "Identification of Essential Residues in *Thermus thermophilus* DNA Ligase," *Nucleic Acids Research* 24:3079-3085 (1996) and Barany et al., "Cloning, Overexpression, and Nucleotide Sequence of a Thermostable DNA Ligase Gene," *Gene* 109:1-11 (1991), which are hereby incorporated by reference). LDR was performed in a 20 µl reaction containing 500 fmol of each probe, 2 µl of amplified DNA and 20 mM Tris-HCl, pH 7.6; 10 mM MgCl$_2$; 100 mM KCl; 10 mM DTT; 1 mM NAD[30]. The reaction was heated to 94° C. for 1.5 min prior to adding 25 fmol of Tth DNA ligase and then subjected to 20 cycles of 15 sec at 94° C. and 4 min at 65° C. (See Table 4).

Figure 21A:
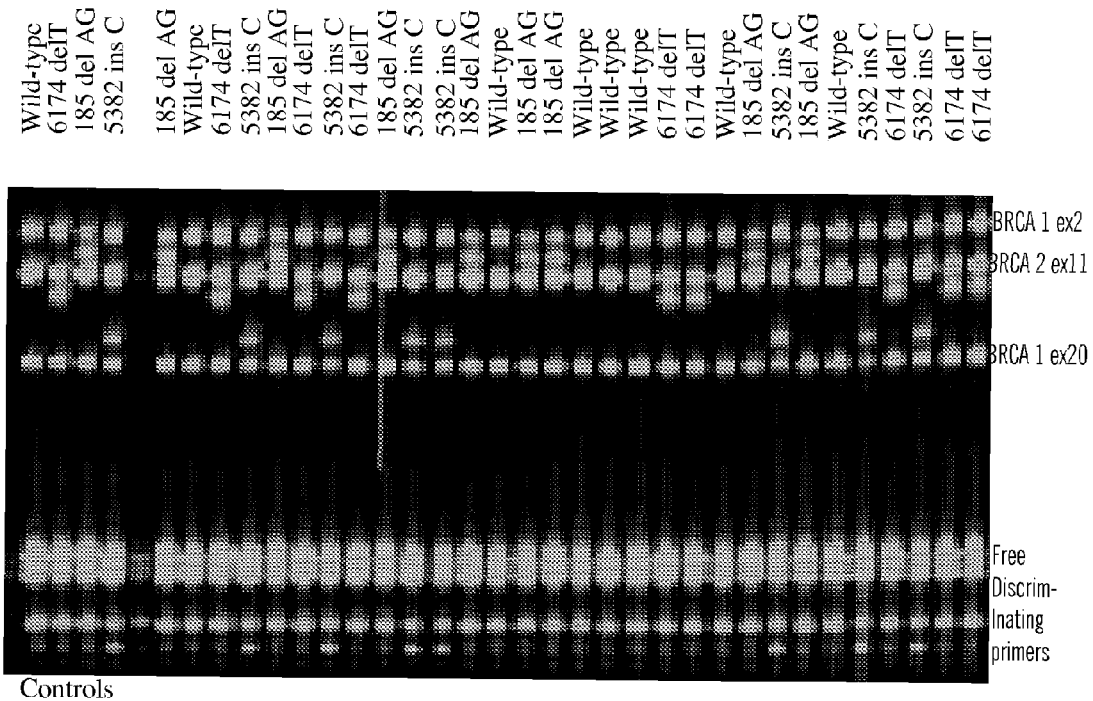
FIGS. 21A-B show the multiplex LDR detection of 3 specific mutations in BRCA1 and BRCA2 in a gel-based assay.

Using the three BRCA1 and BRCA2 founder mutations in the Ashkenazi Jewish population (BRCA1 185delAG; BRCA1 5382insC; BRCA2 6174delT) (Rahman et al., "The Genetics of Breast Cancer Susceptibility," *Annu. Rev. Genet.* 32:95-121 (1998), which is hereby incorporated by reference) as a model system, the assay readily detected these mutations in multiplexed reactions in over 80 DNA samples. FIG. 21A shows a representative LDR gel detecting the three BRCA mutations. By fluorescent end-labeling the discriminating upstream oligonucleotides with either FAM (for wild-type) or TET (for mutant), and by adding different length "tails" to LDR oligonucleotide probes, ligation products were easily distinguished based on label and migration on a polyacrylamide gel. Wild-type products are identified at the right side of the gel. Mutant products are identified at the top of the gel. Electrophoretic separation was performed at 1400 volts using 8 M urea-10% polyacrylamide gels and an ABI 373 DNA sequencer. Fluorescent ligation products were analyzed and quantified using the ABI Gene Scan 672 software.

Figure 21B:
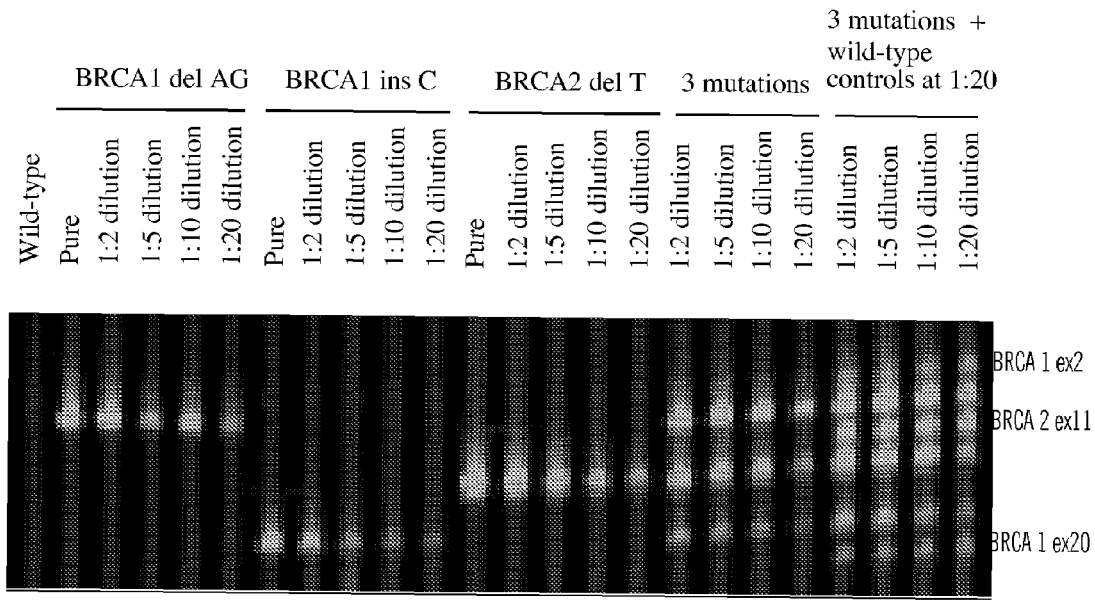

The analysis was next extended to detect the mutations in pooled samples of DNA. DNAs with known mutations were diluted 1:2, 1:5, 1:10, and 1:20 with wild-type DNA prior to PCR amplification and then subjected to LDR These simulation experiments showed PCR/PCR/LDR could successfully detect the presence of all three mutations when known mutant DNA was diluted 1:20 in wild-type DNA prior to amplification. FIG. 21B shows BRCA1 and BRCA2 mutation detection on pooled samples of DNA. DNA samples with known mutations were diluted into wild-type DNA prior to amplification. Ligation products from multiplex LDR are shown for each dilution. BRCA1 delAG, BRCA1 ins C, and BRCA2 del T mean that only one mutation is present; multiplex LDR directed against only mutant sequences use 500 fmol of each LDR oligonucleotide probes. 3 mutations means that all three mutations are present; multiplex LDR directed against mutant sequences only use 500 fmol of each LDR oligonucleotide. 3 mutations+wild-type controls at 1:20 mean that all three mutations are present; multiplex LDR are directed against both mutant and wild-type sequences using 500 fmol and 25 fmol of each LDR oligonucleotide probes, respectively. The pooling experiment was repeated using 249 blinded Ashkenazi Jewish DNA samples. Tubes containing the blinded DNAs were assembled into a 9×9 gridded format and aliquots from each tube were combined across the rows and then down the columns to produce one tube of combined DNA for each row and each column. This was done to uniquely classify each sample using points of intersection on the gridded format. The pooled DNA was then subjected to amplification and LDR as described above. 248 of the 249 samples were correctly typed. The single sample that was incorrectly identified as wild-type proved to be too dilute and fell below the limits of detection when mixed with 9 other samples of higher concentration. The number of individual reactions carried out was reduced from 249 to 96 by this strategy (55 pooled samples and 41 individual samples used for confirmation).

In addition to gel-based detection, mutation identification was also accomplished by screening reaction products with a universal DNA microarray (Gerry et al., "Universal DNA Microarray Method for Multiplex Detection of Low Abundance Point Mutations," *J Mol Bio.* 292: 251-262 (1999), which is hereby incorporated by reference). Microarrays were processed and spotted as previously described (Gerry et al., "Universal DNA Microarray Method for Multiplex Detection of Low Abundance Point Mutations," *J Mol Bio.* 292:251-262 (1999), which is hereby incorporated by reference) using a Pixsys5500 robot enclosed in a humidity chamber (Cartesian Technologies, Irvine, Calif.). Briefly, LDR reactions were hybridized in 32 µl containing 300 mM MES, pH 6.0, 10 mM $MgCl_2$, 0.1% SDS at 65° C. for 1 h in a rotating chamber. After washing in 300 mM bicine, pH 8.0, 10 mM $MgCl_2$, 0.1% SDS for 10 min at 25° C. The array was imaged on an Olympus Provis AX70 microscope using a 100 W mercury burner, a Texas Red filter cube, and a Princeton Instruments TEK512/CCD camera. The 16-bit greyscale images were captured using MetaMorph Imaging System (Universal Imaging Corporation, West Chester, Pa.) and rescaled to more narrowly bracket the LDR signal before conversion to 8-bit greyscale. The 8-bit images were colored using Adobe Photoshop to render the Cy3 signal red.

Preliminary microarray experiments using probes designed in the gel-based format (i.e., differentially labeled discriminating probes and identical common probes) demonstrated that wild-type and mutant versions of the three BRCA sequences were readily detected on the array (see WO 97/31256 to Barany et al., which is hereby incorporated by reference). In this version, both types of sequences were directed to the same addresses (e.g., BRCA1 185delAG and BRCA1 185 wild-type were both directed to zip-code 1). Although this format proved successful, PCR/PCR/LDR has the potential of detecting hundreds of mutations in a single-tube reaction and this design does not make optimal use of the array for such large-scale mutation detection experiments. In order to establish the experimental paradigm for future studies, the addressable format was expanded by choosing a sequence in each of the amplicons to use as a control an LDR ligation product. Thus, rather than require detection of wild-type sequences for each mutant LDR product, this format uses a single product to serve as a positive control for multiple different sequence variants within an amplicon (see FIG. 22). One advantage of this format is that it minimizes oligonucleotide synthesis; additionally, the use of each of the 64 positions is maximized. Since the number of LDR ligation products that can be detected at a single address is limited by the number of currently available spectrally separated fluorescent labels, confining the control to a specified region of the array permits one more sequence variant to be detected at each remaining address. In the experiments described below, control and mutant LDR ligation products for a queried position were directed to six separate addresses on a 64 position array.

All three frameshift mutations were detectable by hybridization to the universal array (FIG. 23). FIG. 23A shows the assignment of each control and mutant sequence to specific addresses on the array surface. Control signals are directed to the upper three addresses; mutant signals are assigned to the lower three. FIG. 23B shows signal produced by a wild-type DNA. FIGS. 23C, E, and G show representative hybridizations for individual DNA samples. FIGS. 23D, F, and H show representative hybridizations for each mutation using pooled samples of DNA from Ashkenazi individuals. The mutations are identified on the extreme right.

Only combinations of the six possible addresses were visible following hybridization and no additional signals were detected at any of the unused addresses. Thus, zip-code hybridization is very specific. Control and mutant signals were clearly present for each of the mutations derived from samples of DNA from single individuals (FIGS. 23C, E, and G). Pooled DNA used in analyzing the 249 DNA samples described above produced signals for mutations identical to those found in the gel-based assay (FIGS. 23D, F, and H). In each case, the array reproduced the result of the gel.

These results demonstrate that universal microarray analysis of PCR/PCR/LDR products permits rapid identification of small insertion and deletion mutations in the context of both clinical diagnosis and population studies.

Example 3 p53 Chip Hybridization and Washing Conditions

Figure 16A:
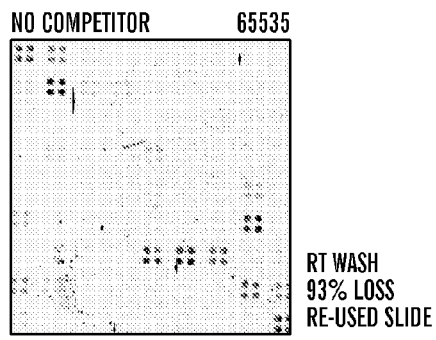
FIGS. 16A-P show the p53 chip hybridization and washing conditions.
Figure 16B:
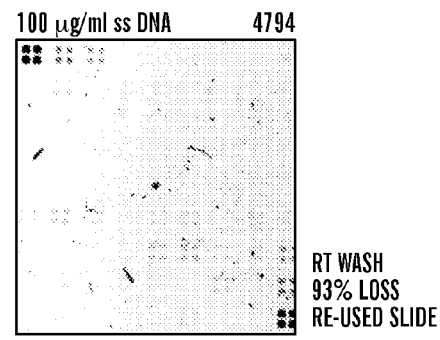
Figure 16C:
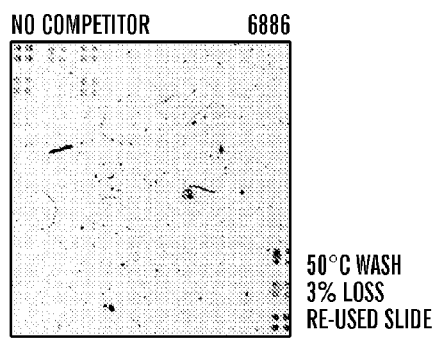
Figure 16D:
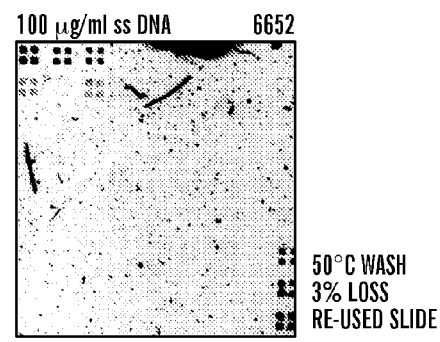
Figure 16E:
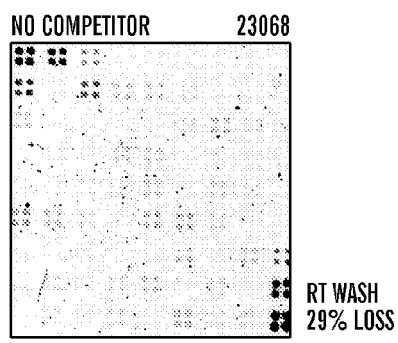
Figure 16F:
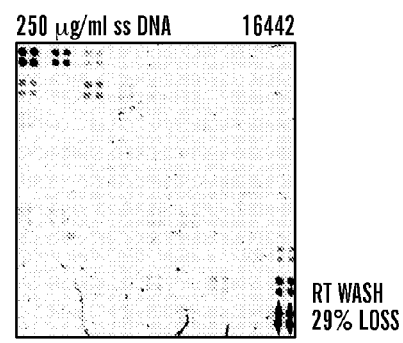
Figure 16G:
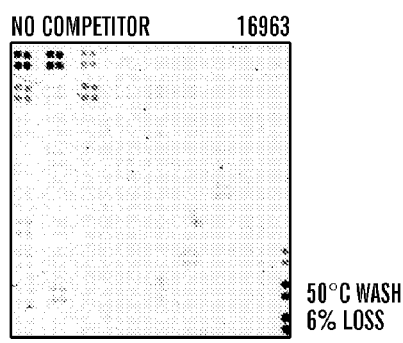
Figure 16H:
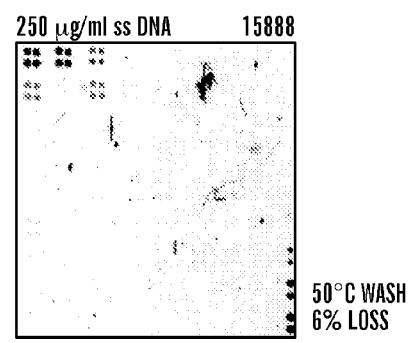
Figure 16I:
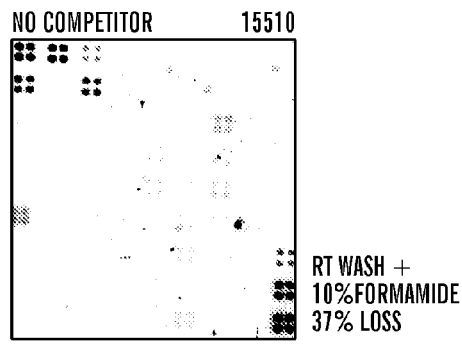
Figure 16J:
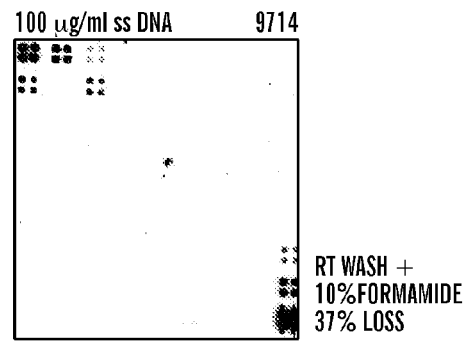
Figure 16K:
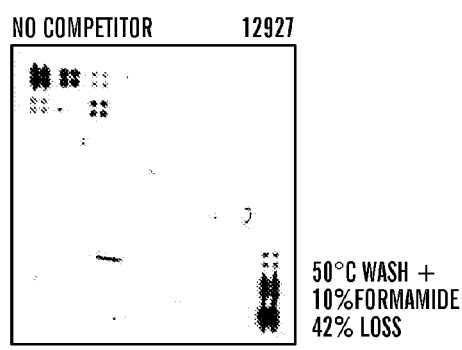
Figure 16L:
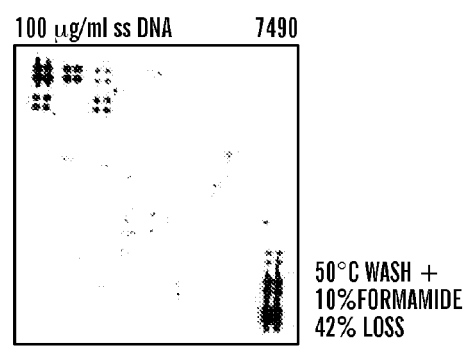
Figure 16M:
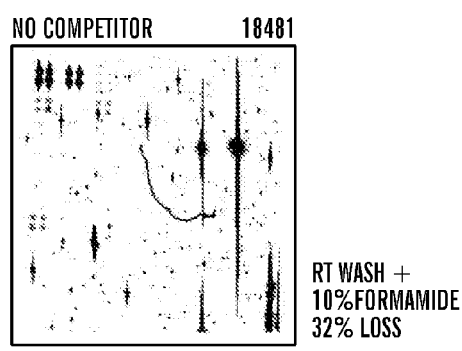
Figure 16N:
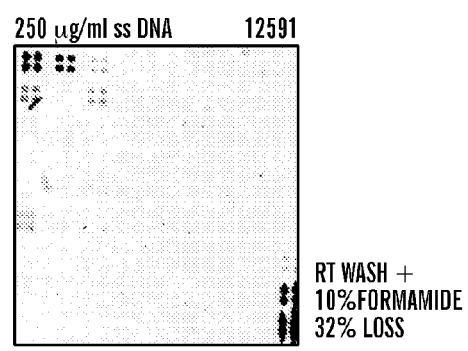
Figure 16O:
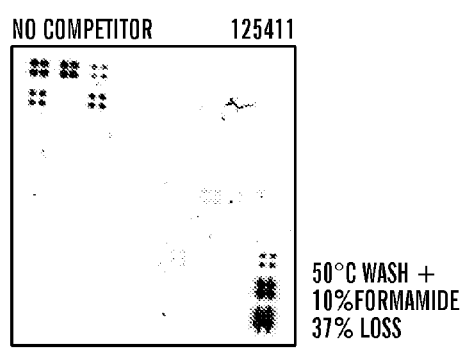
Figure 16P:
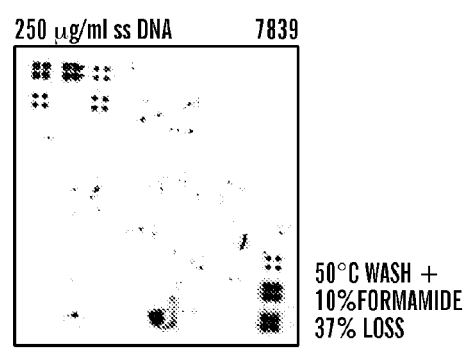

Three parameters (presence or absence of non-specific DNA competitor, temperature, and wash buffer composition) were varied in different combinations in order to determine which method would produce minimum background noise without significant loss of signal. Hybridization was performed with 100 µg/ml of sheared salmon sperm DNA (FIGS. 16B, D, J, and L), 250 µg/ml of sheared salmon sperm DNA (FIGS. 16F, H, N, and P), or no non-specific competitor DNA (FIGS. 16A, C, E, G, I, K, M, and O). Washing was performed for 10 min using four different conditions: room temperature in standard wash buffer (300 mM bicine, pH 8.0, 10 mM $MgCl_2$, 0.1% SDS) (FIGS. 16A, B, E, and F); room temperature in standard wash buffer supplemented with 10% formamide (FIGS. 16I, J, M, and N); 50° C. in standard wash buffer (FIGS. 16C, D, G, and H); or 50° C. in standard wash buffer supplemented with 10% formamide (FIGS. 16K, L, O, and P). The numbers on the upper right of each panel indicate the density of pixels for p53 exon 5 control (zip-code 1) for each condition. The percent of loss indicated on the right side of the figure compares the left and right panel directly adjacent to calculated percentage. Fiducials (Cy3, Cy5, and fluorescein) are spotted horizontally on the upper left and vertically on the lower right regions of the chips to give orientation. Zip-code 1 is located directly below the fiducial in the upper left area; subsequent zip-codes are spotted in numerical order in a left to right manner.

PCR was carried out as a single-tube, multiplex reaction in order to simultaneously amplify p53 exons 5 and 7. Commercially available genomic DNA from lymphocytes was amplified in a 25 µl reaction mixture containing 100 ng of DNA, 400 µM of each dNTP, 1× PCR Buffer II (10 mM Tris-HCl pH 8.3 at 25° C., 50 mM KCl) supplemented with 4 mM $MgCl_2$, 1 U AmpliTaq Gold and 2 pmol of each gene-specific primer bearing either universal primer A or B on the 5' ends (see Table 5). The reaction was overlaid with mineral oil and preincubated for 10 min at 95° C. Amplification was performed for 15 cycles as follows: 94° C. for 15 sec, 65° C. for 1 min. A second 25 µl aliquot of the reaction mixture was added through the mineral oil containing 25 pmol each of universal primers A and B. Cycling was repeated using 55° C. annealing temperature. The reaction was next digested with a 2 µl solution of 1 mg/ml Proteinase K/50 mM EDTA at 55° C. for 10 min. Proteinase K was eliminated by a final incubation at 90° C. for 15 min. For LDR, oligonucleotide synthesis and purification were carried out as previously described (Khanna et al., "Multiplex PCR/LDR for Detection of K-ras Mutations in Primary Colon Tumors," *Oncogene* 18:27-38 (1999), which is hereby incorporated by reference). Tth DNA ligase was overproduced and purified as described elsewhere (Luo et al., "Identification of Essential Residues in *Thermus thermophilus* DNA Ligase," Nucleic Acids Research 24:3079-3085 (1996) and Barany et al., "Cloning, Overexpression, and Nucleotide Sequence of a Thermostable DNA Ligase Gene," *Gene* 109:1-11 (1991), which are hereby incorporated by reference). LDR was performed in a 20 µl reaction containing 500 fmol of each probe, 2 µl of amplified DNA and 20 mM Tris-HCl, pH 7.6; 10 mM MgCl$_2$; 100 mM KCl; 10 mM DTT; 1 mM NAD$^+$. The reactants were heated to 94° C. for 1.5 min prior to adding 25 fmol of Tth DNA ligase and then subjected to 20 cycles of 15 sec at 94° C. and 4 min at 65° C. See Table 5 which shows the oligonucleotide primers and probes designed to detect mutations in p53 by PCR/LDR/array hybridization as follows:

TABLE 5

Primers and Probes Designed for Mutation Detection in p53 by PCR/LDR/Array Hybridization.

| Primer/Probe | Sequence (5'->3') |
| --- | --- |
| Uni A primer | GGAGCACGCTATCCCGTTAGAC<br>(SEQ ID NO: 9316) |
| Uni B2 primer | CGCTGCCAACTACCGCACATC<br>(SEQ ID NO: 9317) |
| p53X5FzipA | GGAGCACGCTATCCCGTTAGACCTGTTCACTTGTGCCCTGACTTTC<br>(SEQ ID NO: 9318) |
| p53X5RzipB | CGCTGCCAACTACCGCACATCCCAGCTGCTCACCATCGCTATC<br>(SEQ ID NO: 9319) |
| K132LA2G | Fam-aaaGCCAGTTGGCAAAACATCC<br>(SEQ ID NO: 9320) |
| K132LA2G3 | Cy3-GCCAGTTGGCAAAACATCC<br>(SEQ ID NO: 9321) |
| K132LA2GCOM | pTGTTGAGGGCAGGGGAGTACTGTAaaa-B<br>(SEQ ID NO: 9322) |
| K132LA2Gzip9 | pTGTTGAGGGCAGGGGAGTACTGTA-catcgtccctttcgatgggatcaa-B<br>(SEQ ID NO: 9323) |
| C135UGA | Fam-CTGCCCTCAACAAGATGTTTTA<br>(SEQ ID NO: 9324) |
| C135UGA3 | Cy3-CTGCCCTCAACAAGATGTTTTA<br>(SEQ ID NO: 9325) |
| C135UGCom | pCCAACTGGCCAAGACCTGCCaaaa-B<br>(SEQ ID NO: 9326) |
| C135UGT | Fam-CTGCCCTCAACAAGATGTTTTT<br>(SEQ ID NO: 9327) |
| C135UGT5 | Cy5-CTGCCCTCAACAAGATGTTTTT<br>(SEQ ID NO: 9328) |
| C135UGzip10 | pCCAACTGGCCAAGACCTGCC-caaggcacgtcccagacgcatcaa-B<br>(SEQ ID NO: 9329) |
| C141UGA | Tet-GCCAACTGGCCAAGACCTA<br>(SEQ ID NO: 9330) |
| C141UGA3 | Cy3-GCCAACTGGCCAAGACCTA<br>(SEQ ID NO: 9331) |
| C141UGCom | pCCCTGTGCAGCTGTGGGTTGAaaaaa-B<br>(SEQ ID NO: 9332) |
| C141UGzip11 | pCCCTGTGCAGCTGTGGGTTGA-gcacgggagctgacgacgtgtcaa-B<br>(SEQ ID NO: 9333) |

TABLE 5-continued

Primers and Probes Designed for Mutation Detection in p53 by PCR/LDR/Array Hybridization.

| Primer/Probe | Sequence (5'->3') |
|---|---|
| V143UGA | Fam-TGGCCAAGACCTGCCCTA<br>(SEQ ID NO: 9334) |
| V143UGA3 | Cy3-TGGCCAAGACCTGCCCTA<br>(SEQ ID NO: 9335) |
| V143UGACOM | pTGCAGCTGTGGGTTGATTCCAaaa-B<br>(SEQ ID NO: 9336) |
| V143UGAzip12 | pTGCAGCTGTGGGTTGATTCCA-agacgcaccgcaacaggctgtcaa-B<br>(SEQ ID NO: 9337) |
| V143UTC | Fam-CCAAGACCTGCCCTGC<br>(SEQ ID NO: 9338) |
| V143UTC3 | Cy3-CCAAGACCTGCCCTGC<br>(SEQ ID NO: 9339) |
| V143UTCOM | pGCAGCTGTGGGTTGATTCCACAaaaa-B<br>(SEQ ID NO: 9340) |
| V143UTzip13 | pGCAGCTGTGGGTTGATTCCACA-catcgctgcaagtaccgcactcaa-B<br>(SEQ ID NO: 9341) |
| W146UG3A3 | Cy3-TGCCCTGTGCAGCTGTGA<br>(SEQ ID NO: 9342) |
| W146UG3zip | pGTTGATTCCACACCCCCGCC-cgatggcttccttacccagattcg-B<br>(SEQ ID NO: 9343) |
| P152LC2T2 | Tet-CGGGTGCCGGGCA<br>(SEQ ID NO: 9344) |
| P152LC2T23 | Cy3-CGGGTGCCGGGCA<br>(SEQ ID NO: 9344) |
| P152LC2T2COM | pGGGGTGTGGAATCAACCCACAaaaaaa-B<br>(SEQ ID NO: 9345) |
| P152Lzip14 | pGGGGTGTGGAATCAACCCACA-ggctgggacgtgcagaccgttcaa-B<br>(SEQ ID NO: 9346) |
| G154LG1A | Fam-atataaCACACCCCCGCCCA<br>(SEQ ID NO: 9347) |
| G154LG1A3 | Cy3-CACACCCCCGCCCA<br>(SEQ ID NO: 9348) |
| G154LG1ACom | pGCACCCGCGTCCGCGatataa-B<br>(SEQ ID NO: 9349) |
| G154LG1Azip15 | pGCACCCGCGTCCGCG-gctggctggcacgcaccagaatca-B<br>(SEQ ID NO: 9350) |
| V157LGC | Tet-GCCATGGCGCGGAG<br>(SEQ ID NO: 9351) |
| V157LGC5 | Cy5-GCCATGGCGCGGAG<br>(SEQ ID NO: 9351) |
| V157LGCOM | pGCGGGTGCCGGGCGaaa-B<br>(SEQ ID NO: 9352) |
| V157LGT | Tet-GCCATGGCGCGGAA<br>(SEQ ID NO: 9353) |
| V157LGT3 | Cy3-GCCATGGCGCGGAA<br>(SEQ ID NO: 9353) |
| V157LGzip16 | pGCGGGTGCCGGGCG-ggctccgtcagaaagcgacaatca-B<br>(SEQ ID NO: 9354) |
| R158LC1A5 | Cy5-GATGGCCATGGCGCT<br>(SEQ ID NO: 9355) |

TABLE 5-continued

Primers and Probes Designed for Mutation Detection in p53 by PCR/LDR/Array Hybridization.

| Primer/Probe | Sequence (5'->3') |
| --- | --- |
| R158LC1zip | pGACGCGGGTGCCGGG-acgagggatacccgcaaacgatca-B<br>(SEQ ID NO: 9356) |
| R158UGA | Tet-CGGCACCCGCGTCCA<br>(SEQ ID NO: 9357) |
| R158UGA3 | Cy3-CGGCACCCGCGTCCA<br>(SEQ ID NO: 9357) |
| R158UGACOM | pCGCCATGGCCATCTACAAGC-B<br>(SEQ ID NO: 9358) |
| R158UGAzip17 | pCGCCATGGCCATCTACAAGC-acgagggatacccgcaaacgatca-B<br>(SEQ ID NO: 9359) |
| A161LC2T5 | Cy5-GTGCTGTGACTGCTTGTAGATGA<br>(SEQ ID NO: 9360) |
| A161LC2Tzip | pCCATGGCGCGGACGC-gggaggctgctgtcctttcgatca-B<br>(SEQ ID NO: 9361) |
| A161UGA | Tet-aaaaaaaaGCGTCCGCGCCATGA<br>(SEQ ID NO: 9362) |
| A161UGA3 | Cy3-GCGTCCGCGCCATGA<br>(SEQ ID NO: 9363) |
| A161UGCOM | pCCATCTACAAGCAGTCACAGCACAaaaaaaaa-B<br>(SEQ ID NO: 9364) |
| A161UGzip18 | pCCATCTACAAGCAGTCACAGCACA-gggaggctgctgtcctttcgatca-B<br>(SEQ ID NO: 9365) |
| V173UGA | Fam-CACAGCACATGACGGAGGTTA<br>(SEQ ID NO: 9366) |
| V173UGA3 | Cy3-CACAGCACATGACGGAGGTTA<br>(SEQ ID NO: 9366) |
| V173UGCOM | pTGAGGCGCTGCCCCCAaaaaa-B<br>(SEQ ID NO: 9367) |
| V173UGT | Fam-CACAGCACATGACGGAGGTTT<br>(SEQ ID NO: 9368) |
| V173UGT5 | Cy5-CACAGCACATGACGGAGGTTT<br>(SEQ ID NO: 9368) |
| V173UGzip19 | pTGAGGCGCTGCCCCCA-acacgcgtgttcgttgcttgcatca-B<br>(SEQ ID NO: 9369) |
| R175LC1Com | pCCTCACAACCTCCGTCATGTGCT-B<br>(SEQ ID NO: 9370) |
| R175LC1T | Fam-CATGGTGGGGCAGCA<br>(SEQ ID NO: 9371) |
| R175LC1T3 | Cy3-CATGGTGGGGCAGCA<br>(SEQ ID NO: 9371) |
| R175LC1zip20 | pCCTCACAACCTCCGTCATGTGCT-atggcgatggtccactcgcaatca-B<br>(SEQ ID NO: 9372) |
| R175LG2T | Fam-CTCATGGTGGGGCAGT<br>(SEQ ID NO: 9373) |
| R175LG2T5 | Cy5-CTCATGGTGGGGCAGT<br>(SEQ ID NO: 9373) |
| R175LG2TCOM | pGCCTCACAACCTCCGTCATGTG-B<br>(SEQ ID NO: 9374) |

TABLE 5-continued

Primers and Probes Designed for Mutation Detection in p53 by PCR/LDR/Array Hybridization.

| Primer/Probe | Sequence (5'->3') |
|---|---|
| R175LG2Tzip21 | pGCCTCACAACCTCCGTCATGTG-gtccgtccatggcaagcgtgatca-B (SEQ ID NO: 9375) |
| R175UG2A | Tet-TGACGGAGGTTGTGAGGCA (SEQ ID NO: 9376) |
| R175UG2A3 | Cy3-TGACGGAGGTTGTGAGGCA (SEQ ID NO: 9376) |
| R175UG2ACom | pCTGCCCCCACCATGAGCGaaaaaa-B (SEQ ID NO: 9377) |
| R175UG2Azip21 | pCTGCCCCCACCATGAGCG-gtccgtccatggcaagcgtgatca-B (SEQ ID NO: 9378) |
| C176UGA | Fam-CGGAGGTTGTGAGGCGCTA (SEQ ID NO: 9379) |
| C176UGA5 | Cy5-CGGAGGTTGTGAGGCGCTA (SEQ ID NO: 9379) |
| C176UGCom | pCCCCCACCATGAGCGCTGaaaaaaaa-B (SEQ ID NO: 9380) |
| C176UGT | Fam-CGGAGGTTGTGAGGCGCTT (SEQ ID NO: 9381) |
| C176UGT3 | Cy3-CGGAGGTTGTGAGGCGCTT (SEQ ID NO: 9381) |
| C176UGzip22 | pCCCCCACCATGAGCGCTG-ggctgcacccgttgaggcacatca-B (SEQ ID NO: 9382) |
| H179LACOM | pGGTGGGGGCAGCGCC-B (SEQ ID NO: 9383) |
| H179LAG | Fam-GCTATCTGAGCAGCGCTCAC (SEQ ID NO: 9384) |
| H179LAG3 | Cy3-GCTATCTGAGCAGCGCTCAC (SEQ ID NO: 9384) |
| H179LAT | Fam-GCTATCTGAGCAGCGCTCAA (SEQ ID NO: 9385) |
| H179LAT5 | Cy5-GCTATCTGAGCAGCGCTCAA (SEQ ID NO: 9385) |
| H179LAzip23 | pGGTGGGGGCAGCGCC-tcaacatcggctaacggtccatca-B (SEQ ID NO: 9386) |
| H179LCT | Fam-GCTATCTGAGCAGCGCTCATA (SEQ ID NO: 9387) |
| H179LCT3 | Cy3-GCTATCTGAGCAGCGCTCATA (SEQ ID NO: 9387) |
| H179LCTCOM | pGTGGGGGCAGCGCCTCAC-B (SEQ ID NO: 9388) |
| H179LCTzip24 | pGTGGGGGCAGCGCCTCAC-cgcacgcagtcctcctccgtatca-B (SEQ ID NO: 9389) |
| X5LCom | pCGGGGGTGTGGAATCAACCC-B (SEQ ID NO: 9390) |
| X5LWT | Fam-CGCGGGTGCCGGG (SEQ ID NO: 9391) |
| X5LWT3 | Cy3-CGCGGGTGCCGGG (SEQ ID NO: 9391) |

TABLE 5-continued

Primers and Probes Designed for Mutation Detection in p53 by PCR/LDR/Array Hybridization.

| Primer/Probe | Sequence (5'->3') |
| --- | --- |
| X5LWT5 | Cy5-CGCGGGTGCCGGG<br>(SEQ ID NO: 9391) |
| X5Lzip1 | pCGGGGGTGTGGAATCAACCC-cgcagattttgcgctggatucaa-B<br>(SEQ ID NO: 9392) |
| p53X6FzipA | GGAGCACGCTATCCCGTTAGACCCTCTGATTCCTCACTGATTGCTCTTA<br>(SEQ ID NO: 9393) |
| p53X6RzipB | CGCTGCCAACTACCGCACATCGGCCACTGACAACCACCCTTAAC<br>(SEQ ID NO: 9394) |
| P190LCT | Tet-aaaaTCGGATAAGATGCTGAGGAGA<br>(SEQ ID NO: 9395) |
| P190LCT3 | Cy3-TCGGATAAGATGCTGAGGAGA<br>(SEQ ID NO: 9396) |
| P190LCTCOM | pGGCCAGACCCTAAGAGCAATCAGaaaa-B<br>(SEQ ID NO: 9397) |
| P190LCTzip25 | pGGCCAGACCCTAAGAGCAATCAG-ggctcgcaggctggctcatcctaa-B<br>(SEQ ID NO: 9398) |
| P190LTA5 | Cy5-CACTCGGATAAGATGCTGAGGT<br>(SEQ ID NO: 9399) |
| P190LTAzip | pGGGGCCAGACCCTAAGAGCAA-ggctcgcaggctggctcatcctaa-B<br>(SEQ ID NO: 9400) |
| H193LAG3 | Cy3-AATTTCCTTCCACTCGGATAAGAC<br>(SEQ ID NO: 9401) |
| H193LAGzip | pGCTGAGGAGGGGCCAGACC-cgcattcgatggacaggacattcg-B<br>(SEQ ID NO: 9402) |
| H193LTA5 | Cy5-AATTTCCTTCCACTCGGATAAGT<br>(SEQ ID NO: 9403) |
| H193LTAzip | pTGCTGAGGAGGGGCCAGAC-cgcattcgatggacaggacattcg-B<br>(SEQ ID NO: 9404) |
| R196LCCom | pGATAAGATGCTGAGGAGGGGCCA-B<br>(SEQ ID NO: 9405) |
| R196LCT | Fam-CGCAAATTTCCTTCCACTCA<br>(SEQ ID NO: 9406) |
| R196LCT3 | Cy3-CGCAAATTTCCTTCCACTCA<br>(SEQ ID NO: 9406) |
| R196LCzip26 | pGATAAGATGCTGAGGAGGGGCCA-cgcatgaggggaaacgacgagatt-B<br>(SEQ ID NO: 9407) |
| Y205LAC | Fam-AAAAGTGTTTCTGTCATCCAAAG<br>(SEQ ID NO: 9408) |
| Y205LAC3 | Cy3-AAAAGTGTTTCTGTCATCCAAAG<br>(SEQ ID NO: 9408) |
| Y205LACOM | pACTCCACACGCAAATTTCCTTCCAaaaaaa-B<br>(SEQ ID NO: 9409) |
| Y205LAG | Fam-AAAAGTGTTTCTGTCATCCAAAC<br>(SEQ ID NO: 9410) |
| Y205LAG5 | Cy5-AAAAGTGTTTCTGTCATCCAAAC<br>(SEQ ID NO: 9410) |
| Y205LAzip27 | pACTCCACACGCAAATTTCCTTCCA-gcaccgtgaacgacagttgcgatt-B<br>(SEQ ID NO: 9411) |

TABLE 5-continued

Primers and Probes Designed for Mutation Detection in p53 by PCR/LDR/Array Hybridization.

| Primer/Probe | Sequence (5'->3') |
| --- | --- |
| T211LAG | Tet-CCACCACACTATGTCGAAAAGC<br>(SEQ ID NO: 9412) |
| T211LAG3 | Cy3-CCACCACACTATGTCGAAAAGC<br>(SEQ ID NO: 9412) |
| T211LAGCOM | pGTTTCTGTCATCCAAATACTCCACACGaaa-B<br>(SEQ ID NO: 9413) |
| T211LAGzip28 | pGTTTCTGTCATCCAAATACTCCACACG-cgcaggtcgctgcgtgtcctgatt-B<br>(SEQ ID NO: 9414) |
| T211LCT | Tet-ACCACCACACTATGTCGAAAAA<br>(SEQ ID NO: 9415) |
| T211LCT3 | Cy3-ACCACCACACTATGTCGAAAAA<br>(SEQ ID NO: 9415) |
| T211LCTCOM | pTGTTTCTGTCATCCAAATACTCCACACaaa-B<br>(SEQ ID NO: 9416) |
| T211LCTzip29 | pTGTTTCTGTCATCCAAATACTCCACAC-cgcaaagcagacacagggtcgatt-B<br>(SEQ ID NO: 9417) |
| R213LCCom | pAAAAGTGTTTCTGTCATCCAAATACTCCa-B<br>(SEQ ID NO: 9418) |
| R213LCT | Tet-GGGCACCACCACACTATGTCA<br>(SEQ ID NO: 9419) |
| R213LCT3 | Cy3-GGGCACCACCACACTATGTCA<br>(SEQ ID NO: 9419) |
| R213LCzip30 | pAAAAGTGTTTCTGTCATCCAAATACTCC-catcgcacttcgctttggctgatt-B<br>(SEQ ID NO: 9420) |
| Y220LACom | pAGGGCACCACCACACTATGTCGA-B<br>(SEQ ID NO: 9421) |
| Y220LAG | Tet-CAGACCTCAGGCGGCTCAC<br>(SEQ ID NO: 9422) |
| Y220LAG3 | Cy3-CAGACCTCAGGCGGCTCAC<br>(SEQ ID NO: 9422) |
| Y220LAzip31 | pAGGGCACCACCACACTATGTCGA-ttgcgggaactcacgaggtcgtat-B<br>(SEQ ID NO: 9423) |
| X6UCOM | pCCTATGAGCCGCCTGAGGTCTaaaa-B<br>(SEQ ID NO: 9424) |
| X6UWT | Fam-aaaTTCGACATAGTGTGGTGGTGC<br>(SEQ ID NO: 9425) |
| X6UWT3 | Cy3-TTCGACATAGTGTGGTGGTGC<br>(SEQ ID NO: 9545) |
| X6UWT5 | Cy5-TTCGACATAGTGTGGTGGTGC<br>(SEQ ID NO: 9545) |
| X6Uzip2 | pCCTATGAGCCGCCTGAGGTCT-ttcgccgtcgtgtaggcttttcaa-B<br>(SEQ ID NO: 9426) |
| p53X7FzipA | GGAGCACGCTATCCCGTTAGACGCCTCATCTTGGGCCTGTGTTATC<br>(SEQ ID NO: 9427) |
| p53X7RzipB | CGCTGCCAACTACCGCACATCGTGGATGGGTAGTAGTATGGAAGAAATC<br>(SEQ ID NO: 9428) |
| Y234UTA3 | Cy3-CTCTGACTGTACCACCATCCACA<br>(SEQ ID NO: 9429) |

TABLE 5-continued

Primers and Probes Designed for Mutation Detection in p53 by PCR/LDR/Array Hybridization.

| Primer/Probe | Sequence (5'->3') |
|---|---|
| Y234UTAzip | pACAACTACATGTGTAACAGTTCCTGCAT-ggctacgacgcatgtaaacgttcg-B (SEQ ID NO: 9430) |
| M237UGA | Fam-aaaaATAAGTACCACCATCCACTACAACTACATA (SEQ ID NO: 9431) |
| M237UGA3 | Cy3-ATAAGTACCACCATCCACTACAACTACATA (SEQ ID NO: 9432) |
| M237UGCOM | pTGTAACAGTTCCTGCATGGGCGaaaa-B (SEQ ID NO: 9433) |
| M237UGT | Fam-aaaaATAAGTACCACCATCCACTACAACTACATT (SEQ ID NO: 9434) |
| M237UGT5 | Cy5-ATAAGTACCACCATCCACTACAACTACATT (SEQ ID NO: 9435) |
| M237UGzip32 | pTGTAACAGTTCCTGCATGGGCG-gcacggctcgataggtcaagcttt-B (SEQ ID NO: 9436) |
| C238UGA | Tet-CCACCATCCACTACAACTACATGTA (SEQ ID NO: 9437) |
| C238UGA3 | Cy3-CCACCATCCACTACAACTACATGTA (SEQ ID NO: 9437) |
| C238UGCom | pTAACAGTTCCTGCATGGGCGGaaaaa-B (SEQ ID NO: 9438) |
| C238UGzip33 | pTAACAGTTCCTGCATGGGCGG-cgatttcgactcaagcggctcttt-B (SEQ ID NO: 9439) |
| S241LC2A6 | Fam-ATGCCGCCCATGCAGT (SEQ ID NO: 9440) |
| S241LC2Azip | pAACTGTTACACATGTAGTTGTAGTGGATGGT-cgcaatggtaggtgagcaagcaga-B (SEQ ID NO: 9441) |
| S241LCCom | pAACTGTTACACATGTAGTTGTAGTGGATGGTaaa-B (SEQ ID NO: 9442) |
| S241LCG | Fam-TGCCGCCCATGCAGC (SEQ ID NO: 9443) |
| S241LCG5 | Cy5-TGCCGCCCATGCAGC (SEQ ID NO: 9443) |
| S241LCT | Fam-TGCCGCCCATGCAGA (SEQ ID NO: 9444) |
| S241LCT3 | Cy3-TGCCGCCCATGCAGA (SEQ ID NO: 9444) |
| S241LCzip34 | pAACTGTTACACATGTAGTTGTAGTGGATGGT-cgcaatggtaggtgagcaagcaga-B (SEQ ID NO: 9445) |
| G244UG1T | Fam-aaaaaCATGTGTAACAGTTCCTGCATGT (SEQ ID NO: 9446) |
| G244UG1T3 | Cy3-CATGTGTAACAGTTCCTGCATGT (SEQ ID NO: 9447) |
| G244UG1TCOM | pGCGGCATGAACCGGAGGCaaaaaa-B (SEQ ID NO: 9448) |
| G244UG1Tzip35 | pGCGGCATGAACCGGAGGC-gtccccgttacctaggcgatcaga-B (SEQ ID NO: 9449) |
| G244UG2A | Fam-aaaaaaTGTGTAACAGTTCCTGCATGGA (SEQ ID NO: 9450) |

TABLE 5-continued

Primers and Probes Designed for Mutation Detection in p53 by PCR/LDR/Array Hybridization.

| Primer/Probe | Sequence (5'->3') |
|---|---|
| G244UG2A3 | Cy3-TGTGTAACAGTTCCTGCATGGA (SEQ ID NO: 9451) |
| G244UG2COM | pCGGCATGAACCGGAGGCCaaaaaa-B (SEQ ID NO: 9452) |
| G244UG2T | Fam-aaaaaaTGTGTAACAGTTCCTGCATGGT (SEQ ID NO: 9453) |
| G244UG2T5 | Cy5-TGTGTAACAGTTCCTGCATGGT (SEQ ID NO: 9454) |
| G244UG2zip36 | pCGGCATGAACCGGAGGCC-atgggtccacagtaccgctgcaga-B (SEQ ID NO: 9455) |
| G245UG1A | Tet-AACAGTTCCTGCATGGGCA (SEQ ID NO: 9456) |
| G245UG1A3 | Cy3-AACAGTTCCTGCATGGGCA (SEQ ID NO: 9456) |
| G245UG1ACom | pGCATGAACCGGAGGCCCAaaaa-B (SEQ ID NO: 9457) |
| G245UG1Azip37 | pGCATGAACCGGAGGCCCA-ccgtgggagattaggtggctcaga-B (SEQ ID NO: 9458) |
| G245UG2A | Fam-CAGTTCCTGCATGGGCGA (SEQ ID NO: 9459) |
| G245UG2A3 | Cy3-CAGTTCCTGCATGGGCGA (SEQ ID NO: 9459) |
| G245UG2ACom | pCATGAACCGGAGGCCCATCaaa-B (SEQ ID NO: 9460) |
| G245UG2Azip38 | pCATGAACCGGAGGCCCATC-gggaatggaggtgggaacgagaca-B (SEQ ID NO: 9461) |
| G245UG2T | Tet-aaaaaaaaAGTTCCTGCATGGGCGA (SEQ ID NO: 9462) |
| G245UG2T5 | Cy5-CAGTTCCTGCATGGGCGT (SEQ ID NO: 9463) |
| G245UG2TCOM | pCATGAACCGGAGGCCCATCaaaaaaaaa-B (SEQ ID NO: 9464) |
| R248LCCom | pGTTCATGCCGCCCATGCAaa-B (SEQ ID NO: 9465) |
| R248LCT | Tet-GGTGAGGATGGGCCTCCA (SEQ ID NO: 9466) |
| R248LCT3 | Cy3-GGTGAGGATGGGCCTCCA (SEQ ID NO: 9466) |
| R248LCzip39 | pGTTCATGCCGCCCATGCA-cgtggctgactcgctgcgatgaca-B (SEQ ID NO: 9467) |
| R248UGA | Tet-TGGGCGGCATGAACCA (SEQ ID NO: 9468) |
| R248UGA3 | Cy3-TGGGCGGCATGAACCA (SEQ ID NO: 9468) |
| R248UGCom | pGAGGCCCATCCTCACCATCATaa-B (SEQ ID NO: 9469) |
| R248UGzip40 | pGAGGCCCATCCTCACCATCAT-ttgcgcaccatcaggttagggaca-B (SEQ ID NO: 9470) |

TABLE 5-continued

Primers and Probes Designed for Mutation Detection in p53 by PCR/LDR/Array Hybridization.

| Primer/Probe | Sequence (5'->3') |
| --- | --- |
| R249LACom | pCCGGTTCATGCCGCCCAa-B<br>(SEQ ID NO: 9471) |
| R249LAG | Fam-TGATGGTGAGGATGGGCCC<br>(SEQ ID NO: 9472) |
| R249LAG5 | Cy5-TGATGGTGAGGATGGGCCC<br>(SEQ ID NO: 9472) |
| R249LAT | Fam-TGATGGTGAGGATGGGCCA<br>(SEQ ID NO: 9473) |
| R249LAT3 | Cy3-TGATGGTGAGGATGGGCCA<br>(SEQ ID NO: 9473) |
| R249LAzip41 | pCCGGTTCATGCCGCCCA-gcaccgatatggagaccgcagaca-B<br>(SEQ ID NO: 9474) |
| R249LG3C | Tet-GATGATGGTGAGGATGGGG<br>(SEQ ID NO: 9475) |
| R249LG3C3 | Cy3-GATGATGGTGAGGATGGGG<br>(SEQ ID NO: 9475) |
| R249LG3Com | pCTCCGGTTCATGCCGCC-B<br>(SEQ ID NO: 9476) |
| R249LG3zip42 | pCTCCGGTTCATGCCGCC-catcgacaaggtaacgcgtggaca-B<br>(SEQ ID NO: 9477) |
| P250LC2T3 | Cy3-AGTGTGATGATGGTGAGGATGA<br>(SEQ ID NO: 9478) |
| P250LC2Tzip | pGCCTCCGGTTCATGCCG-gtcccaagttgcggctcactttcg-B<br>(SEQ ID NO: 9479) |
| I254LAG | Fam-CTGGAGTCTTCCAGTGTGATGAC<br>(SEQ ID NO: 9480) |
| I254LAG3 | Cy3-CTGGAGTCTTCCAGTGTGATGAC<br>(SEQ ID NO: 9480) |
| I254LAGCOM | pGGTGAGGATGGGCCTCCG-B<br>(SEQ ID NO: 9481) |
| I254LAGzip43 | pGGTGAGGATGGGCCTCCG-tgagcgcaaggtcagagcacgaca-B<br>(SEQ ID NO: 9482) |
| X7LCom | pCATGCAGGAACTGTTACACATGTAGTTGTAa-B<br>(SEQ ID NO: 9483) |
| X7LWT | Tet-TCCGGTTCATGCCGCC<br>(SEQ ID NO: 9484) |
| X7LWT3 | Cy3-TCCGGTTCATGCCGCC<br>(SEQ ID NO: 9484) |
| X7LWT5 | Cy5-TCCGGTTCATGCCGCC<br>(SEQ ID NO: 9484) |
| X7Lzip3 | pCATGCAGGAACTGTTACACATGTAGTTGTA-ccgtaagcccgtatggcagatcaa-B<br>(SEQ ID NO: 9485) |
| p53X8FzipA | GGAGCACGCTATCCCGTTAGACGGACAGGTAGGACCTGATTTCCTTAC<br>(SEQ ID NO: 9486) |
| p53X8RzipB | CGCTGCCAACTACCGCACATCCGCTTCTTGTCCTGCTTGCTTAC<br>(SEQ ID NO: 9487) |
| F270UTA | Tet-aaaaaATCTACTGGGACGGAACAGCA<br>(SEQ ID NO: 9488) |

TABLE 5-continued

Primers and Probes Designed for Mutation Detection in p53 by PCR/LDR/Array Hybridization.

| Primer/Probe | Sequence (5'->3') |
| --- | --- |
| F270UTA3 | Cy3-ATCTACTGGGACGGAACAGCA<br>(SEQ ID NO: 9489) |
| F270UTCOM | pTTGAGGTGCGTGTTTGTGCCTaaaaaa-B<br>(SEQ ID NO: 9490) |
| F270UTzip44 | pTTTGAGGTGCGTGTTTGTGCCT-aagccgcagcacgattccgtgaca-B<br>(SEQ ID NO: 9491) |
| V272UGA | Fam-aaaaaaGGACGGAACAGCTTTGAGA<br>(SEQ ID NO: 9492) |
| V272UGA3 | Cy3-GGACGGAACAGCTTTGAGA<br>(SEQ ID NO: 9493) |
| V272UGCOM | pTGCGTGTTTGTGCCTGTCCTGGaaaaaaa-B<br>(SEQ ID NO: 9494) |
| V272UGT | Fam-aaaaaaGGACGGAACAGCTTTGAGT<br>(SEQ ID NO: 9495) |
| V272UGT5 | Cy5-GGACGGAACAGCTTTGAGT<br>(SEQ ID NO: 9496) |
| V272UGzip45 | pTGCGTGTTTGTGCCTGTCCTGG-tgagaagcgtccaagccagaacga-B<br>(SEQ ID NO: 9497) |
| R273LCCom | pCACCTCAAAGCTGTTCCGTCCCaa-B<br>(SEQ ID NO: 9498) |
| R273LCT | Tet-CCAGGACAGGCACAAACACA<br>(SEQ ID NO: 9499) |
| R273LCT3 | Cy3-CCAGGACAGGCACAAACACA<br>(SEQ ID NO: 9499) |
| R273LCzip46 | pCACCTCAAAGCTGTTCCGTCCC-catccaaggtccgacacgcaacga-B<br>(SEQ ID NO: 9500) |
| R273UCA5 | Cy5-ACGGAACAGCTTTGAGGTGA<br>(SEQ ID NO: 9501) |
| R273UCAzip | pGTGTTTGTGCCTGTCCTGGGAGA-catccaaggtccgacacgcaacga-B<br>(SEQ ID NO: 9502) |
| R273UGA | Tet-CGGAACAGCTTTGAGGTGCA<br>(SEQ ID NO: 9503) |
| R273UGA3 | Cy3-CGGAACAGCTTTGAGGTGCA<br>(SEQ ID NO: 9503) |
| R273UGCom | pTGTTTGTGCCTGTCCTGGGAGaaaaaa-B<br>(SEQ ID NO: 9504) |
| R273UGzip47 | pTGTTTGTGCCTGTCCTGGGAG-ttcgacgattcgcatcaacgcaag-B<br>(SEQ ID NO: 9505) |
| C275UGA | Tet-aaaaaaaaAGCTTTGAGGTGCGTGTTTA<br>(SEQ ID NO: 9506) |
| C275UGA3 | Cy3-CAGCTTTGAGGTGCGTGTTTA<br>(SEQ ID NO: 9507) |
| C275UGCOM | pTGCCTGTCCTGGGAGAGACCaaaaaaa-B<br>(SEQ ID NO: 9508) |
| C275UGT | Tet-aaaaaaaaCAGCTTTGAGGTGCGTGTTTT<br>(SEQ ID NO: 9509) |
| C275UGT5 | Cy5-CAGCTTTGAGGTGCGTGTTTT<br>(SEQ ID NO: 9510) |

TABLE 5-continued

Primers and Probes Designed for Mutation Detection in p53 by PCR/LDR/Array Hybridization.

| Primer/Probe | Sequence (5'->3') |
|---|---|
| G275UGzip48 | pTGCCTGTCCTGGGAGAGACC-aacggggaaggttgagcgtgacag-B<br>(SEQ ID NO: 9511) |
| R280UGA | Tet-TTTGTGCCTGTCCTGGGAA<br>(SEQ ID NO: 9512) |
| R280UGA3 | Cy3-TTTGTGCCTGTCCTGGGAA<br>(SEQ ID NO: 9512) |
| R280UGCOM | pAGACCGGCGCACAGAGGAAGaaaaaa-B<br>(SEQ ID NO: 9513) |
| R280UGT | Tet-TTTGTGCCTGTCCTGGGAT<br>(SEQ ID NO: 9514) |
| R280UGT5 | Cy5-TTTGTGCCTGTCCTGGGAT<br>(SEQ ID NO: 9514) |
| R280UGzip49 | pAGACCGGCGCACAGAGGAAG-cactgcacacgaaacggcacacag-B<br>(SEQ ID NO: 9515) |
| D281UCA3 | Cy3-GTGCCTGTCCTGGGAGAGAA<br>(SEQ ID NO: 9516) |
| D281UCAGzip | pCGGCGCACAGAGGAAGAGAA-aagcaagccaaggtatggctttgc-B<br>(SEQ ID NO: 9517) |
| D281UCG5 | Cy5-GTGCCTGTCCTGGGAGAGAG<br>(SEQ ID NO: 9518) |
| D281UGA3 | Cy3-TTGTGCCTGTCCTGGGAGAA<br>(SEQ ID NO: 9519) |
| D281UGACzip | pACCGGCGCACAGAGGAAGAG-cgtgcgcacactcactgtccttcg-B<br>(SEQ ID NO: 9520) |
| D281UGC5 | Cy5-TTGTGCCTGTCCTGGGAGAC<br>(SEQ ID NO: 9521) |
| R282LCCom | pGTCTCTCCCAGGACAGGCACAAAaaa-B<br>(SEQ ID NO: 9522) |
| R282LCT | Fam-TCTCTTCCTCTGTGCGCCA<br>(SEQ ID NO: 9523) |
| R282LCT3 | Cy3-TCTCTTCCTCTGTGCGCCA<br>(SEQ ID NO: 9523) |
| R282LCzip50 | pGTCTCTCCCAGGACAGGCACAAA-taccgacatcctgggattgcatgg-B<br>(SEQ ID NO: 9524) |
| R282UG2A5 | Cy5-CCTGTCCTGGGAGAGACCA<br>(SEQ ID NO: 9525) |
| R282UG2Azip | pGCGCACAGAGGAAGAGAATCTCC-taccgacatcctgggattgcatgg-B<br>(SEQ ID NO: 9526) |
| E286UGA3 | Cy3-AGACCGGCGCACAGAGA<br>(SEQ ID NO: 9527) |
| E286UGAzip | pAAGAGAATCTCCGCAAGAAAGGG-ttcggctgttcgtaggcaagaggt-B<br>(SEQ ID NO: 9528) |
| R306LCT | Cy3-TTGTCCTGCTTGCTTACCTCA<br>(SEQ ID NO: 9529) |
| R306LCT | Fam-aaaaTTGTCCTGCTTGCTTACCTCA<br>(SEQ ID NO: 9530) |
| R306LCTCOM | pCTTAGTGCTCCCTGGGGGCAGaaaaa-B<br>(SEQ ID NO: 9531) |

TABLE 5-continued

Primers and Probes Designed for Mutation Detection in p53 by PCR/LDR/Array Hybridization.

| Primer/Probe | Sequence (5'->3') |
|---|---|
| R306LCTzip51 | pCTTAGTGCTCCCTGGGGGCAG-actccgcattgccagagctgatgg-B<br>(SEQ ID NO: 9532) |
| X8UCOM | pCTCACCACGAGCTGCCCCC-B<br>(SEQ ID NO: 9533) |
| X8UWT | Fam-TCCGCAAGAAAGGGGAGC<br>(SEQ ID NO: 9534) |
| X8UWT3 | Cy3-TCCGCAAGAAAGGGGAGC<br>(SEQ ID NO: 9534) |
| X8UWT5 | Cy5-TCCGCAAGAAAGGGGAGC<br>(SEQ ID NO: 9534) |
| X8Uzip4 | pCTCACCACGAGCTGCCCCC-atggccgtgctggggacaagtcaa-B<br>(SEQ ID NO: 9535) |

The PCR primers are specifically designed to amplify regions within and surrounding the p53 gene. After 15 rounds of amplification at high Tm's (i.e. 65° C.) using the longer gene-specific primers (at 1-2 pmoles per reaction), the two universal primers (bold upper case) are added at 50 pmoles in 50 µl and products cycled for an additional 20 rounds of amplification.
The allele-specific LDR probes contained fluorescent labels on the 5'-ends (Fam, Tet, Cy3 or Cy5) and the discriminating bases on their 3'-ends. Non-genomic sequence was added to the 5'-ends of some probes (designated by bold lower case) to control the final ligation product size for gel-based assays. The common LDR probes contained 5'-phosphates (p) and C-3 blocking (B) groups on their 3'-ends. Common LDR probes used in array-based detection have zipcode sequences (designated by lower case) on their 3'-ends.

LDR reactions were hybridized in 32 µl containing 300 mM MES, pH 6.0, 10 mM MgCl$_2$, 0.1% SDS with or without 100 µg/ml sheared salmon sperm DNA at 65° C. for 1 h in a rotating chamber. After washing in 300 mM bicine, pH 8.0, 10 mM MgCl$_2$, 0.1% SDS with or without 10% formamide for 10 min at 25° C. or for 10 min at 50° C. The array was imaged on an Olympus Provis AX70 microscope using a 100 W mercury burner, a Texas Red filter cube, and a Princeton Instruments TEK512/CCD camera. The 16-bit greyscale images were captured using MetaMorph Imaging System (Universal Imaging Corporation) and rescaled to more narrowly bracket the LDR signal before conversion to 8-bit greyscale. The 8-bit images were inverted using Adobe Photoshop to render the Cy3 signal black.

Figure 24A:
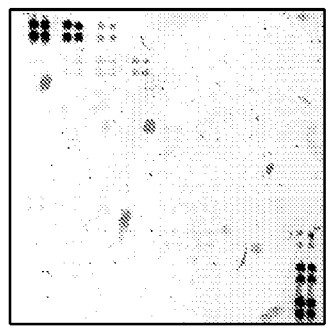
FIG. 24A-H show p53 chip hybridization indicating the presence of mutations in DNA from colon tumors.
Figure 24B:
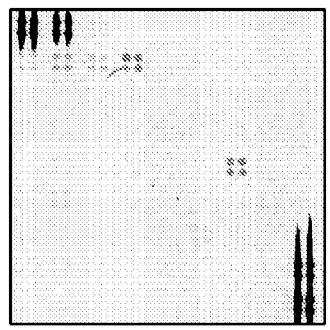
Figure 24C:
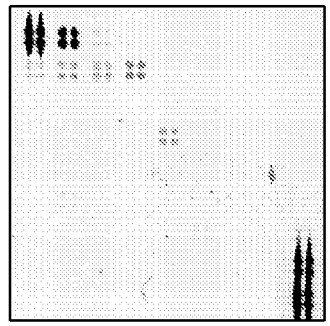
Figure 24D:
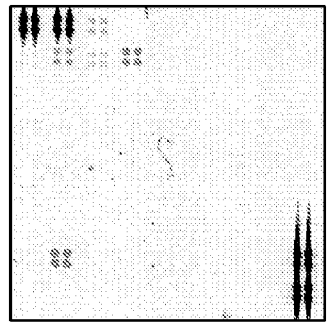
Figure 24E:
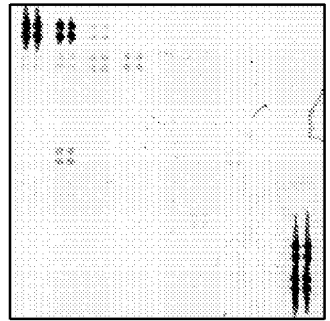
Figure 24F:
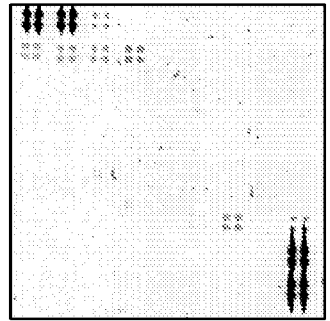
Figure 24G:
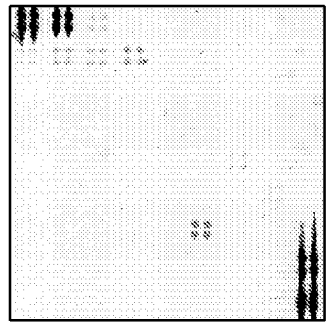
Figure 24H:
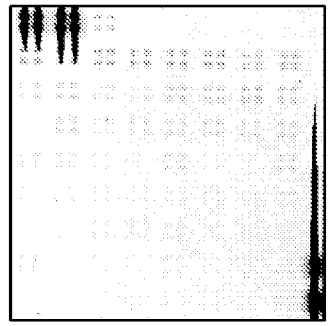

Example 4 p53 Chip Hybridization Showing the Presence of Mutations in DNA from Colon Tumors A p53 chip can detect the presence of 75 different mutations in exons 5, 6, 7 and 8 and uses 144 LDR oligonucleotides (see Table 5). FIG. 24 is an example of microarray-based p53 mutation detection using DNA derived from colon tumors. The mutation status of each sample and the zip-codes expected to capture signal are indicated to the right of each panel. The figure shows Cy3 background in the lowest panel on the right that is due to contaminating fluorescence in the spotted zip-codes (FIG. 24H). PCR was carried out as a single-tube, multiplex reaction in order to simultaneously amplify p53 exons 5, 6, 7, and 8. Genomic DNA extracted from colon tumors was amplified in a 25 µl reaction mixture containing 100 ng of DNA, 400 µM of each dNTP, 1× PCR Buffer II (10 mM Tris-HCl pH 8.3 at 25° C., 50 mM KCl) supplemented with 4 mM MgCl$_2$, 1 U AmpliTaq Gold and 2 pmol of each gene-specific primer bearing either universal primer A or B on the 5' ends (see Table 5). The reaction was overlaid with mineral oil and preincubated for 10 min at 95° C. Amplification was performed for 15 cycles as follows: 94° C. for 15 sec, 65° C. for 1 min. A second 25 µl aliquot of the reaction mixture was added through the mineral oil containing 25 pmol each of universal primers A and B. Cycling was repeated using 55° C. annealing temperature. The reaction was next digested with a 2 µl solution of 1 mg/ml Proteinase K/50 mM EDTA at 55° C. for 10 min. Proteinase K was eliminated by a final incubation at 90° C. for 15 min. For LDR, oligonucleotide synthesis and purification were carried out as previously described (Khanna et al., "Multiplex PCR/LDR for Detection of K-ras Mutations in Primary Colon Tumors," *Oncogene* 18:27-38 (1999), which is hereby incorporated by reference). Tth DNA ligase was overproduced and purified as described elsewhere (Luo et al., "Identification of Essential Residues in *Thermus thermophilus* DNA Ligase," *Nucleic Acids Research* 24:3079-3085 (1996) and Barany et al., "Cloning, Overexpression, and Nucleotide Sequence of a Thermostable DNA Ligase Gene," *Gene* 109:1-11 (1991), which are hereby incorporated by reference). LDR was performed in a 20 µl reaction containing 500 fmol of each probe, 2 µl of amplified DNA and 20 mM Tris-HCl, pH 7.6; 10 mM MgCl$_2$; 100 mM KCl; 10 mM DTT; 1 mM NAD$^+$. Two reactions were performed for each sample containing LDR probes that were designed to hybridize to the upper strand or lower strand of p53 sequence. The reaction was heated to 94° C. for 1.5 min prior to adding 25 fmol of Tth DNA ligase and then subjected to 20 cycles of 15 sec at 94° C. and 4 min at 65° C. (See Table 5) LDR reactions were hybridized in 32 µl containing 100 µg/ml sheared salmon sperm DNA 300 mM MES, pH 6.0, 10 mM MgCl$_2$, 0.1% SDS at 65° C. for 1 h in a rotating chamber. After washing in 300 mM bicine, pH 8.0, 10 mM MgCl$_2$, 0.1% SDS for 10 min at 50° C. The array was imaged on an Olympus Provis AX70 microscope using a 100 W mercury burner, a Texas Red filter cube, and a Princeton Instruments TEK512/CCD camera. The 16-bit greyscale images were captured using MetaMorph Imaging System (Universal Imaging Corporation) and rescaled to more narrowly bracket the LDR signal before conversion to 8-bit greyscale. Using Adobe Photoshop, the 8-bit images were first inverted to render the Cy3 signal black and then the images for each sample derived from hybridization using LDR targeted to the upper strand and lower strand of the p53 sequence were overlaid and merged. The results of this procedure are shown in FIG. 24.

Example 5

Optimized Zipcode Sequence Construction Using Tetramers

The universal DNA array is designed on the concept of using divergent sequences to uniquely tag LDR products such that each one is captured at a unique site. The heart of the concept is the design of 36 tetramers, each of which differs from any other by at least 2 bases (See Table 6).

TABLE 6

| New tetramer designation | Original tetramer designation (See Table 1) | Tetramer sequence 5'-3' | Tetramer complement 5'-3' | G + C bases |
|---|---|---|---|---|
| 1 | 6 | TTGA | TCAA | 1 |
| 2 | 7 | TGAT | ATCA | 1 |
| 3 | 8 | TTAG | CTAA | 1 |
| 4 | 26 | AATC | GATT | 1 |
| 5 | 31 | ATAC | GTAT | 1 |
| 6 | 32 | AAAG | CTTT | 1 |
| 7 | 36 | TACA | TGTA | 1 |
| 8 | 1 | TCTG | CAGA | 2 |
| 9 | 2 | TGTC | GACA | 2 |
| 10 | 5 | TCGT | ACGA | 2 |
| 11 | 9 | CTTG | CAAG | 2 |
| 12 | 10 | CGTT | AACG | 2 |
| 13 | 11 | CTCA | TGAG | 2 |
| 14 | 13 | CTGT | ACAG | 2 |
| 15 | 15 | CCAT | ATGG | 2 |
| 16 | 16 | CGAA | TTCG | 2 |
| 17 | 17 | GCTT | AAGC | 2 |
| 18 | 18 | GGTA | TACC | 2 |
| 19 | 19 | GTCT | AGAC | 2 |
| 20 | 21 | GAGT | ACTC | 2 |
| 21 | 23 | GCAA | TTGC | 2 |
| 22 | 25 | AGTG | CACT | 2 |
| 23 | 27 | ACCT | AGGT | 2 |
| 24 | 28 | ATCG | CGAT | 2 |
| 25 | 30 | AGGA | TCCT | 2 |
| 26 | 33 | CCTA | TAGG | 2 |
| 27 | 34 | GATG | CATC | 2 |
| 28 | 3 | TCCC | GGGA | 3 |
| 29 | 4 | TGCG | CGCA | 3 |
| 30 | 12 | CACG | CGTG | 3 |
| 31 | 14 | CAGC | GCTG | 3 |
| 32 | 20 | GACC | GGTC | 3 |

TABLE 6-continued

| New tetramer designation | Original tetramer designation (See Table 1) | Tetramer sequence 5'-3' | Tetramer complement 5'-3' | G + C bases |
|---|---|---|---|---|
| 33 | 22 | GTGC | GCAC | 3 |
| 34 | 24 | GGAC | GTCC | 3 |
| 35 | 29 | ACGG | CCGT | 3 |
| 36 | 35 | AGCC | GGCT | 3 |

By combining these 36 tetramers in sets of six, addresses that are 24 bases long can be constructed.

A 1296 array can be designed based on the concept of alternating tiling of given sets of tetramers. These capture oligonucleotides differed from their neighbors at three alternating positions, but were the same at the other three positions, i.e. (First=A, third=C, and fifth=E positions). Thus, each capture oligonucleotide differed from any other one by at least 6 out of 24 positions. Moreover, these differences were distributed across the length of the capture oligonucleotides. When aligning a correct capture oligonucleotide with an incorrect address, the Tm differences were predicted to be greater than 24° C. Nevertheless, one of the possibilities with this type of design is for three contiguous tetramers in a given set of positions (i.e. ABC) to match another capture oligonucleotide, but at a different set of positions (i.e. BCD).

Since optimal surfaces are three-dimensional porous surfaces, a given LDR product has numerous opportunity to be captured at the correct address. Even if an LDR product transiently dissociates from a given oligonucleotide within the correct address, it will rapidly find and hybridize to another oligonucleotide within the same address. In preliminary studies, it was found that changes which would be expected to alter Tm, (i.e. use of propynyl derivatives) did not markedly affect yield of correctly hybridized products. Thus, hybridization may be kinetically controlled. In order to minimize the possibility of even low levels of cross-hybridization between two closely related capture oligonucleotides, the sequences can be designed to maximize differences among the tetramer order with a 24 mer capture oligonucleotide.

The process for designing such sequences is outlined below:

1. Create three columns containing all 46,656 (=36×36× 36) permutations of three sets of the 36 tetramers.

2. Compute the Tm of the 46,656 12-mers using the Oligo 6.0 program from Molecular Biology Insights, Inc. (Cascade, Colo.) and sort the list according to predicted Tm values.

3. Remove 12-mers that contain one GC base (Tetramers #1-7) in each tetramer or contain three GC bases in each tetramer (Tetramers #28-36). This process removes the extremes in Tm range. Remove 12-mers with Tm values less than 24° C. Remove the remaining 12-mers that have three repeated tetramers (i.e. 9-9-9)

4. Group the set of 12-mers by Tm with a new group for each 2 degrees increase in Tm. Values were set by dividing Tm by two and truncating to whole numbers.

5. Randomize list and split into odd and even 12-mers. Invert second list and append to the end of first list to form 6 tetramers=12,880 address candidates. Concatenate sequences and determine Tm values of 24-mers.

6. Select only hexa-tetramers with Tm values between 75 and 84. Reclaim unused trimers and make new hexa-tetramers with increased Tm and add back to list.

7. The lists were pruned using the 13 selection conditions as described in Table 7: A "1" indicates a match at that position, a "0" indicates no match. Anytime two candidate addresses matched at one of the conditions, it was removed from the candidate list and returned to the unused trimer list.

TABLE 7

| Condition | Tetramer 1 | Tetramer 2 | Tetramer 3 | Tetramer 4 | Tetramer 5 | Tetramer 6 |
|---|---|---|---|---|---|---|
| L Four in a row | 1 | 1 | 1 | 1 | 0 | 0 |
| M Four in a row | 0 | 1 | 1 | 1 | 1 | 0 |
| R Four in a row | 0 | 0 | 1 | 1 | 1 | 1 |
| L Three in a row | 1 | 1 | 1 | 0 | 0 | 0 |
| M Three in a row | 0 | 1 | 1 | 1 | 0 | 0 |
| M Three in a row | 0 | 0 | 1 | 1 | 1 | 0 |
| R Three in a row | 0 | 0 | 0 | 1 | 1 | 1 |
| Interrupted 4-1 | 1 | 1 | 0 | 1 | 1 | 0 |
| Interrupted 4-2 | 1 | 1 | 0 | 0 | 1 | 1 |
| Interrupted 4-3 | 0 | 1 | 1 | 0 | 1 | 1 |
| Interrupted 4-4 | 1 | 0 | 1 | 0 | 1 | 1 |
| Interrupted 4-5 | 1 | 1 | 0 | 1 | 0 | 1 |
| Interrupted 4-6 | 1 | 0 | 1 | 1 | 0 | 1 |

8. The above 13 selection conditions reduced the list to 9,650 address candidates.

9. The above 13 selection conditions remove matches of four in a row and three in a row which are in the same alignment as one another; however, they do not remove sequences which are similar but shifted over by one or two tetramer units. In order to eliminate those kinds of artifacts, the sequences were copied below the original 6 tetramers, offset by a tetramer or two as in Table 8 below:

TABLE 8

| Condition | Position A | Position B | Position C | Position D | Position E | Position F |
|---|---|---|---|---|---|---|
| Four in a row + 1 | | Position A | Position B | Position C | Position D | |
| Four in a row + 2 | | | Position A | Position B | Position C | Position D |
| Four in a row − 1 | | Position C | Position D | Position E | Position F | |
| Four split − 1 | Position B | Position C | | | Position E | Position F |

10. These three selections culled the list to 8,894 candidate capture oligonucleotides, 4,798 more than the target of 4,096 for a 64×64 address array. These capture oligonucleotide sequences have the following properties: (1) there are no cases of 4 tetramers in a row which are identical, either when capture oligonucleotide sequences are aligned with each other, or when they are offset with respect to each other or split with respect to each other; (2) there are no cases of 3 tetramers in a row which are identical, when capture oligo-nucleotide seqences are aligned with each other from one end; and (3) there are no cases where four out of six tetramers are in the same position.

11. For further selection, sequences of three in a row which were offset were eliminated as in Table 9 below.

12. These six selections culled the list to 3,038 candidate capture oligonucleotides, more than a more selective target of 2,500 for a 50×50 address array. These capture oligonucleotide sequences have the following properties: (1) there are no cases of 4 tetramers in a row which are identical, either when capture oligonucleotide seqences are aligned with each other, or when they are offset with respect to each other; (2) there are no cases of 3 tetramers in a row which are identical, when capture oligonucleotides seqences are aligned with each other from one end, or when they are offset with respect to each other; and (3) there are no cases where four out of six tetramers are in the same position.

13. The order of tetramers were reversed and new Tm values were calculated, added back in (6,076), and then pruned as described in steps 7-11 above. The candidate list increased only marginally to 3,270. Therefore, an approach which enriched the unused trimers was needed.

14. A list of used trimers in all positions was used to determine available (unused) trimers and construct new sets of hexa-tetramers. To increase the percent of hexa-tetramers with Tm values in the 75-84° C. range, trimers with predicted Tm values of 34-50° C. were inverted with respect to each other and used (i.e. trimer ABC with Tm of 34 was fused to trimer DEF with Tm of 50, trimer ABC with Tm of 38 was fused to trimer DEF with Tm of 46, etc.).

TABLE 9

| Condition | Position A | Position B | Position C | Position D | Position E | Position F |
|---|---|---|---|---|---|---|
| Three in a row + 1 | | Position A | Position B | Position C | | |
| Three in a row + 2 | | | Position A | Position B | Position C | |
| Three in a row + 3 | | | | Position A | Position B | Position C |
| Three in a row + 1 | | | Position B | Position C | Position D | |
| Three in a row + 2 | | | | Position B | Position C | Position D |
| Three in a row + 1 | | | | Position C | Position D | Position E |

15. Sets of hexa-tetramers were constructed and the trimers generated at the junction (i.e. positions BCD and CDE) were retested against the used trimer list, and those hexa-tetramers which conflicted were recycled. Those hexa-tetramers which did not conflict were added to the 3,270 candidate list and resorted and pruned as described in steps 7-11. The candidate list was expanded to 4,035.

16. The process was reiterated two more times to generate the final list of 4,633 capture oligonucleotides (SEQ ID NOS: 1-4633) (FIG. 25, which refers to the tetramers in Table 6), 537 sequences more than the target of 4,096 for a 64×64 address array. These capture oligonucleotide sequences have the following properties: (1) there are no cases of 4 tetramers in a row which are identical, either when capture oligonucleotide seqences are aligned with each other, or when they are offset with respect to each other; (2) there are no cases of 3 tetramers in a row which are identical, when capture oligonucleotide seqences are aligned with each other from one end, or when they are offset with respect to each other; and (3) there are no cases where four out of six tetramers are in the same position.

17. Using the 4,633 capture oligonucleotide list, smaller lists for an 8×8=64 address array, 8×12=96 address array, 16×24=384 address array, and 20×20=400 address array were created. As selection criteria, capture oligonucleotides which shared pairs of tetramers in common were selectively removed from the list. A culling of all dimer pairs which were the same in given positions (i.e. AB=AB) reduced the list to 465 capture oligonucleotide sequences (SEQ ID NOS: 1-465) (FIG. 26, which refers to the tetramers in Table 6). A second culling of dimer pairs similar among neighboring positions (i.e. AB=BC, BC=CD, etc.) and removal of all dimer pairs used more than twice reduced the set to 96 capture oligonucleotide sequences (SEQ ID NOS: 1-96) (FIG. 27, which refers to the tetramers in Table 6). Finally, ensuring that no dimer was used more than once generated a list of 65 capture oligonucleotide sequences (SEQ ID NOS: 1-65) (FIG. 28, which refers to the tetramers in Table 6).

18. The capture oligonucleotides can also be in the form of PNA (i.e. Peptide Nucleotide Analogues), as shown in FIG. 29 (which refers to the tetramers in Table 6), which contains a list of 4633 such capture oligonucleotides (SEQ ID NOS: 4634-9266). These PNA capture oligonucleotides are in the form of 20 mer units. PNA provides the advantage of increasing the Tm of the oligonucleotide, on average 1.0° C. to 1.5° C. per base, so the Tm values of the oligomers listed in FIG. 29 would be on average 20° C. (or more) higher when synthesized as the PNA form. Thus, the addresses would only need to be 20 mers or less in the PNA form. These sequences are amenable to a more rapid synthesis by considering two alternative approaches. In the first approach, the 36 tetramers listed in Table 6 are initially synthesized, and then 5 tetramers linked in the correct order to form the sequences listed in FIG. 29. Alternatively, the PNA oligomers would be synthesized using a lithographic synthesis approach. A standard lithographic synthesis would use the 4 bases over and over again, i.e. A-C-G-T for the first position, A-C-G-T for the second position, etc., and would require 4×20=80 masks. The current sequences listed in FIG. 29 are amenable to synthesis in 62 masks, or less by altering the order of masks. The 62 masks would allow attachment of the PNA monomers in the following order:

```
T-G-C-A-T-G-C-A-G-T-C-A-T-G-C-A-T-G-C-A-G-T-C-A-T-
G-C-A-T-G-C-A-G-T-C-A-T-G-C-A-T-G-C-A-G-T-C-A-T-G-
C-A-T-G-C-A-G-T-C-A-T-G
(SEQ IN NO: 9536)
```

For a given sequence, the mask at the next base which allows that sequence is opened over that address. By way of example, if the nucleotide sequence of SEQ ID NO:9536 were shortened to be the first 20 nucleotides of SEQ ID NO:9536, it could be finished using just 20 masks. Different sequences will require more masks. Thus, the 20-mers are finished with different numbers of masks. Examples are provided below for synthesis of 5 different addresses Zip ID#s 1, 2, 3, 4, and 26 which require less than 62 masks. In these examples, use of a mask is designated by an underlining of that base to achieve the correct sequence.

```
Zip ID#1. AATCCAGCGCAAAATCTGCG = 45 masks
(SEQ ID NO:9545)

T-G-C-A-T-G-C-A-G-T-C-A-T-G-C-A-T-G-C-A-G-T-C-A-T-
G-C-A-T-G-C-A-G-T-C-A-T-G-C-A-T-G-C-A-G-T-C-A-T-G-
C-A-T-G-C-A-G-T-C-A-T-G
(SEQ ID NO:9536)

Zip ID#2. AAAGCCTACACGACGGCGAA = 56 masks
(SEQ ID NO:9546)

T-G-C-A-T-G-C-A-G-T-C-A-T-G-C-A-T-G-C-A-G-T-C-A-T-
G-C-A-T-G-C-A-G-T-C-A-T-G-C-A-T-G-C-A-G-T-C-A-T-G-
C-A-T-G-C-A-G-T-C-A-T-G
(SEQ ID NO:9536)

Zip ID#3. TCTGCCATACGGGCTTACGG = 50 masks
(SEQ ID NO:9547)

T-G-C-A-T-G-C-A-G-T-C-A-T-G-C-A-T-G-C-A-G-T-C-A-T-
G-C-A-T-G-C-A-G-T-C-A-T-G-C-A-T-G-C-A-G-T-C-A-T-G-
C-A-T-G-C-A-G-T-C-A-T-G
(SEQ ID NO:9536)

Zip ID#4. CTTGTCCCCAGCACGGCCAT = 49 masks
(SEQ ID NO:9548)

T-G-C-A-T-G-C-A-G-T-C-A-T-G-C-A-T-G-C-A-G-T-C-A-T-
G-C-A-T-G-C-A-G-T-C-A-T-G-C-A-T-G-C-A-G-T-C-A-T-G-
C-A-T-G-C-A-G-T-C-A-T-G
(SEQ ID NO:9536)

Zip ID#26. TCGTCGTTTCCCCTCATGCG = 54 masks
(SEQ ID NO:9549)

T-G-C-A-T-G-C-A-G-T-C-A-T-G-C-A-T-G-C-A-G-T-C-A-T-
G-C-A-T-G-C-A-G-T-C-A-T-G-C-A-T-G-C-A-G-T-C-A-T-G-
C-A-T-G-C-A-G-T-C-A-T-G
(SEQ ID NO:9536)
```

This demonstrates that PNA addresses of 20 mers may be synthesized using a lithographic approach with no more than 62 masks, far less than the 80 masks required by the standard approach to synthesize a 20 mer, and even less than the 64 masks required to make a standard PNA 16 mer.

Figure 30:
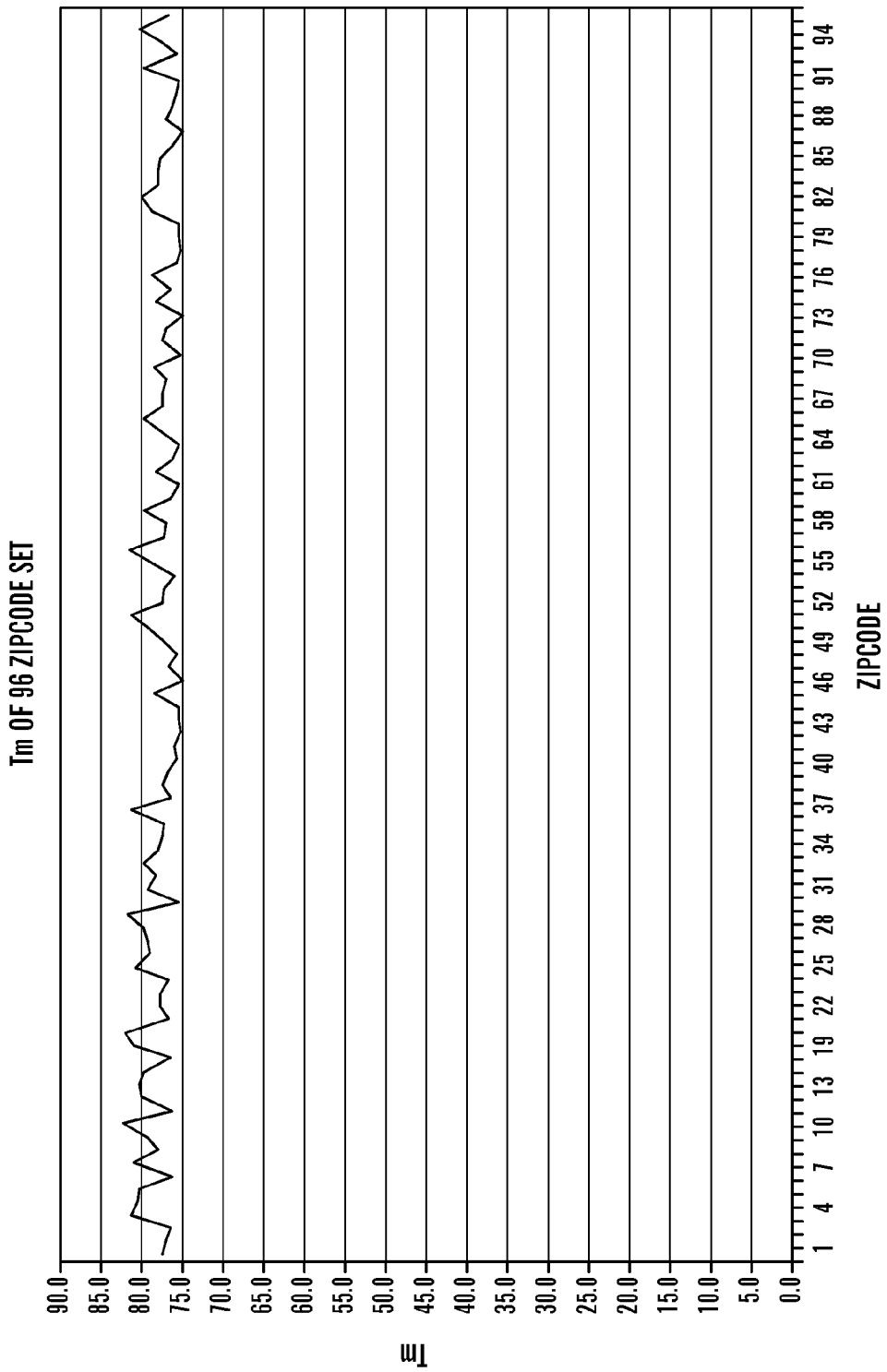
FIG. 30 shows a melting temperature (i.e. Tm) distribution for a list of 96 capture oligonucleotides produced in accordance with the present invention.
Figure 31:
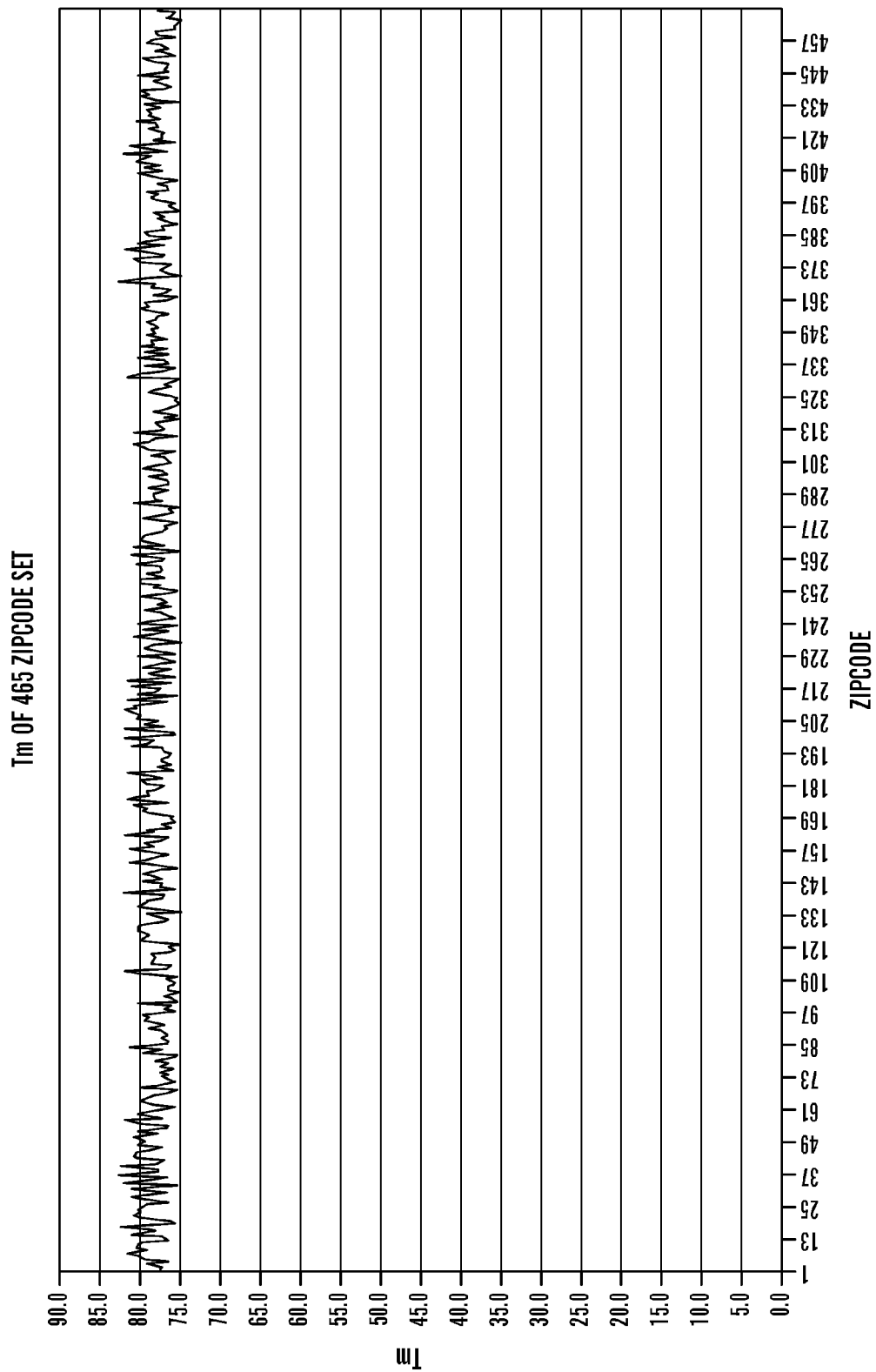
FIG. 31 shows a melting temperature (i.e. Tm) distribution for a list of 465 capture oligonucleotides produced in accordance with the present invention.
Figure 32:
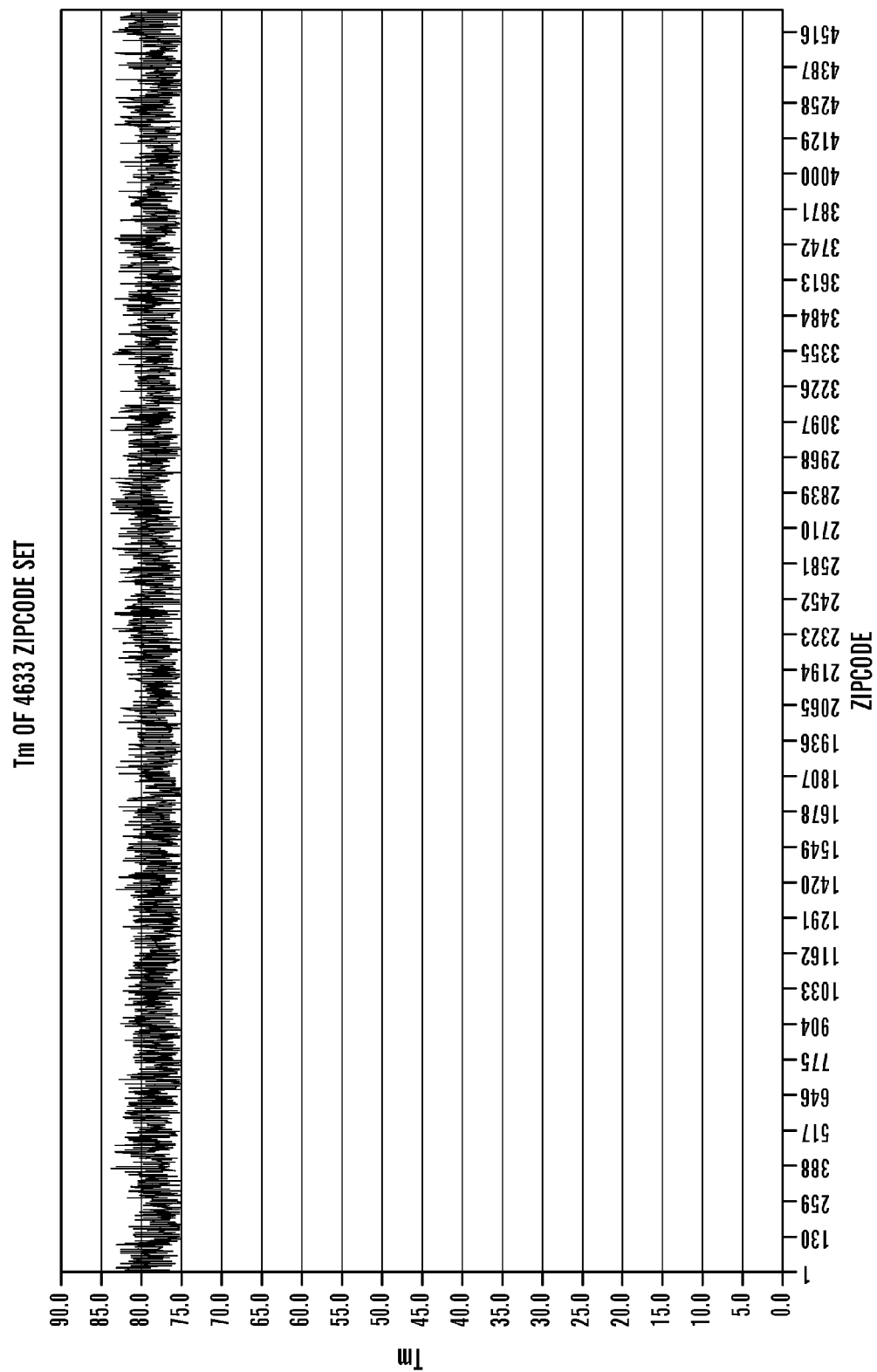
FIG. 32 shows a melting temperature (i.e. Tm) distribution for a list of 4633 capture oligonucleotides produced in accordance with the present invention.
Figure 33:
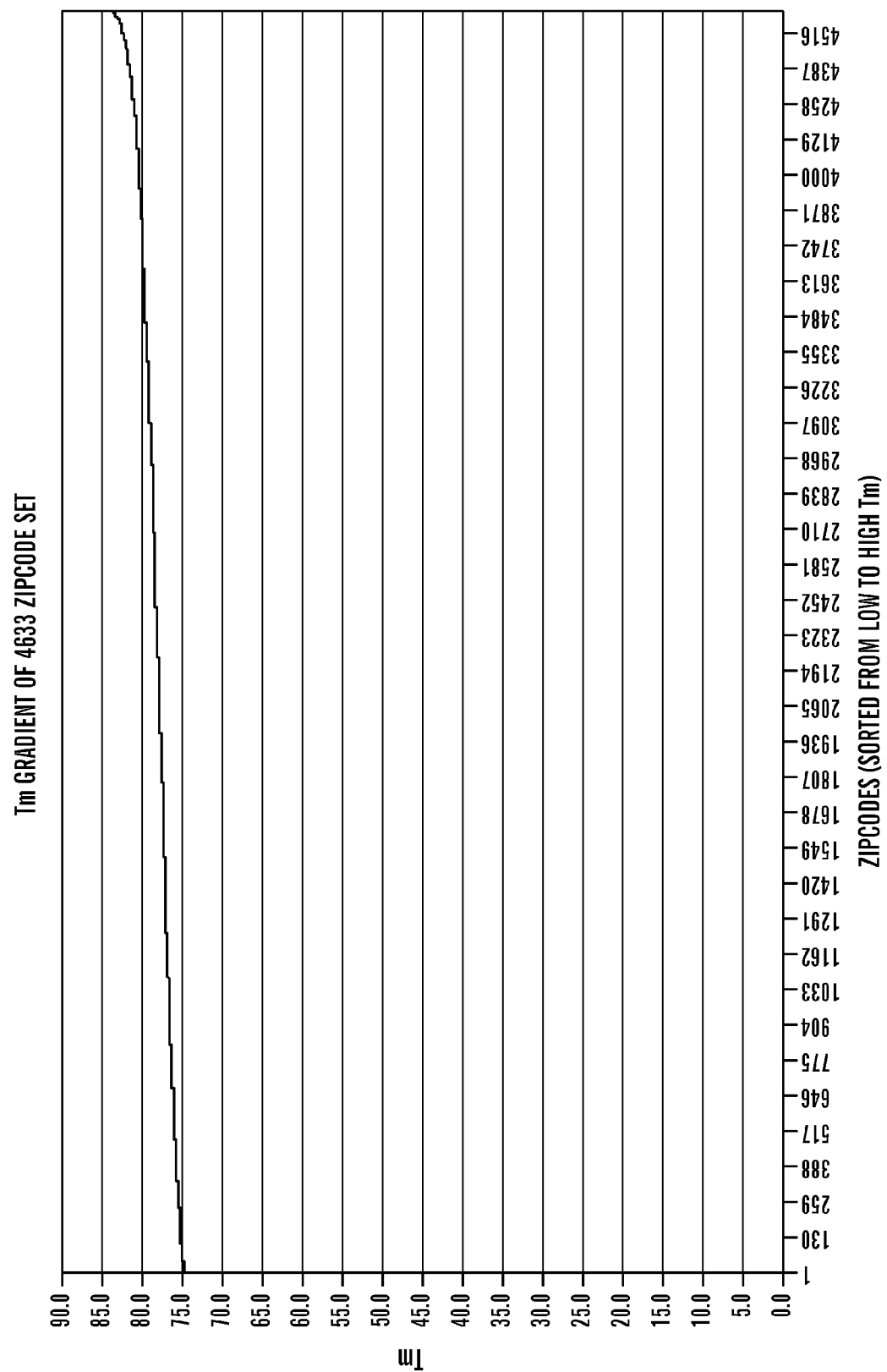
FIG. 33 shows a sorted melting temperature (i.e. Tm) distribution for a list of 4633 capture oligonucleotides produced in accordance with the present invention.
Figure 34:
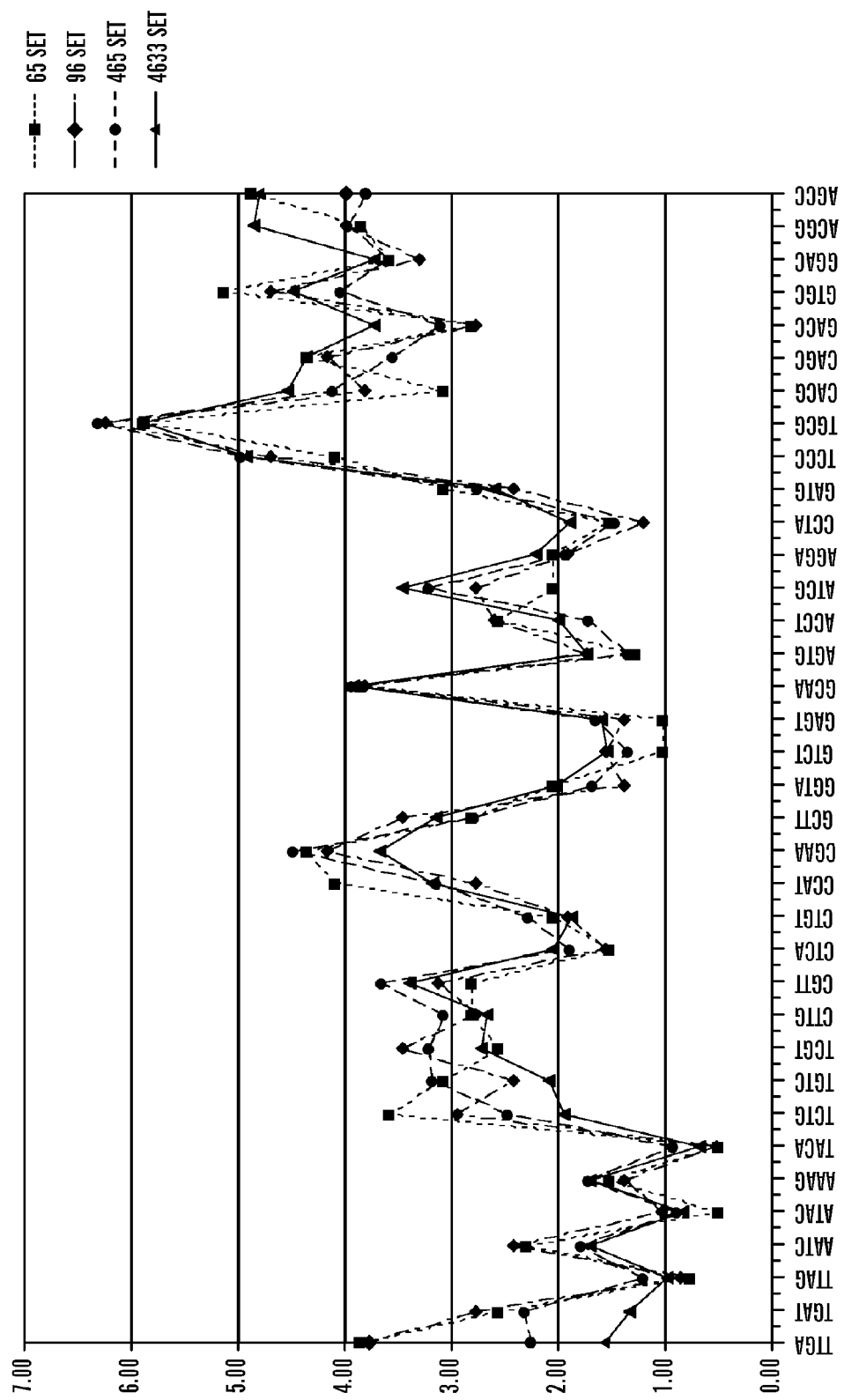
FIG. 34 shows the tetramer usage in the lists of 65, 96, 465, and 4633 capture oligonucleotides produced in accordance with the present invention.
Figure 36A:
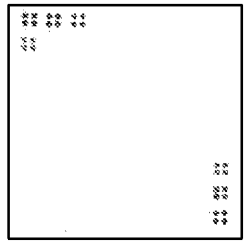
FIGS. 36A-H show the LDR detection of 7 specific mutations in K-ras on an addressable universal microarray.
Figure 36B:
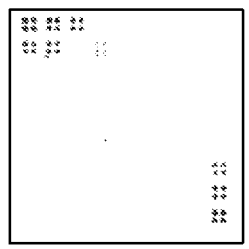
Figure 36C:
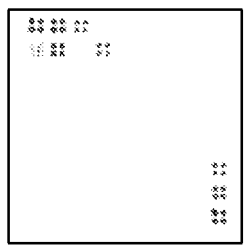
Figure 36D:
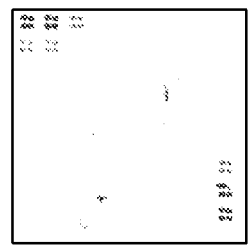
Figure 36E:
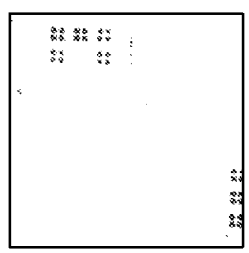
Figure 36F:
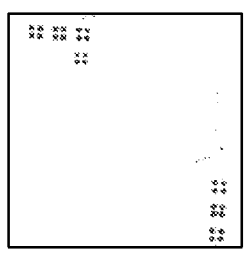
Figure 36G:
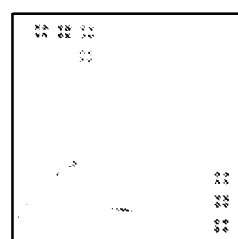
Figure 36H:
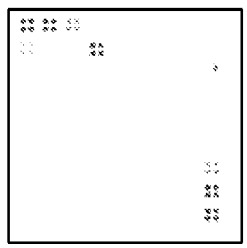

All addresses were selected to have Tm values between 75 and 84° C. The distribution of Tm values is more or less independent of capture oligonucleotide number. While addresses with higher G+C content in general gave higher Tm values, the simple Tm=4(G+C)+2(A+T) rule was off by up to 10° C. in many cases. The values for the 96, 465, and 4633 capture oligonucleotides is shown in FIGS. 30, 31, and 32, respectively. Sorted Tm values of the 4633 list of capture oligonucleotide probes are shown in FIG. 33. The gradient of Tm values was relatively even, with the majority of capture oligonucleotides (80%) having Tm values from and including 75° C. to 80° C. FIG. 34 shows tetramer usage in the lists of 65, 96, 465, and 4633 capture oligonucleotides produced in accordance with the present invention. If tetramer distribution was completely random, each tetramer should be represented 2.7% of the time. However, selection was biased towards higher Tm capture oligonucleotide probes. Thus, tetramers which tend to increase the Tm values, i.e. #29=TGCG are over-represented, while tetramers which tend to decrease the $T_m$ values, i.e. #7=TACA are under-represented.

The present approach to mutation detection has three orthogonal components: (i) primary PCR amplification; (ii) solution-phase LDR detection; and (iii) solid-phase hybridization capture. Therefore, background signal from each step can be minimized, and, consequently, the overall sensitivity and accuracy of the present method is significantly enhanced over those provided by other strategies. For example, "sequencing by hybridization" methods require: (i) multiple rounds of PCR or PCR/T7 transcription; (ii) processing of PCR amplified products to fragment them or render them single-stranded; and (iii) lengthy hybridization periods (10 h or more) which limit their throughput (Guo, et al., Nucleic Acids Res. 22:5456-5465 (1994); Hacia, et. al., Nat. Genet., 14441-447 (1996); Chee, et al., Science, 274:610-614 (1996); Cronin, et al., Human Mutation, 7:244-255 (1996); Wang, et al., Science, 280:1077-1082 (1998); Schena, et al., Proc. Natl. Acad. Sci. USA, 93:10614-10619 (1996); and Shalon, et al., Genome Res., 6:639-645 (1996), which are hereby incorporated by reference). Additionally, since the immobilized probes on these arrays have a wide range of $T_m$'s, it is necessary to perform the hybridizations at temperatures from 0° C. to 44° C. The result is increased background noise and false signals due to mismatch hybridization and non-specific binding, for example on small insertions and deletions in repeat sequences (Hacia, et. al., Nat. Genet., 14441-447 (1996); Cronin, et al., Human Mutation, 7:244-255 (1996); Wang, et al., Science 280:1077-1082 (1998); and Southern, E. M., Trends in Genet., 12:110-115 (1996), which are hereby incorporated by reference). In contrast, the approach of the present invention allows multiplexed PCR in a single reaction (Belgrader, et al., Genome Sci. Technol., 1:77-87 (1996), which is hereby incorporated by reference), does not require an additional step to convert product into single-stranded form, and can readily distinguish all point mutations including slippage in repeat sequences (Day, et al., Genomics, 29:152-162 (1995), which is hereby incorporated by reference). Alternative DNA arrays suffer from differential hybridization efficiencies due to either sequence variation or to the amount of target present in the sample. By using the present approach of designing divergent address sequences with similar thermodynamic properties, hybridizations can be carried out at 65° C., resulting in a more stringent and rapid hybridization. The decoupling of the hybridization step from the mutation detection stage offers the prospect of quantification of LDR products, as has already been achieved using gel-based LDR detection.

Arrays spotted on polymer surfaces provide substantial improvements in signal capture, as compared with arrays spotted or synthesized in situ directly on glass surfaces (Drobyshev, et al., Gene, 188:45-52 (1997); Yershov, et al., Proc. Natl. Acad. Sci. USA, 93:4913-4918 (1996); and Parinov, et al., Nucleic Acids Res., 24:2998-3004 (1996), which are hereby incorporated by reference). However, the polymers described by others are limited to using 8- to 10-mer addresses while the polymeric surface of the present invention readily allows 24-mer capture oligonucleotides to penetrate and couple covalently. Moreover, LDR products of length 60 to 75 nucleotide bases are also found to penetrate and subsequently hybridize to the correct address. As additional advantages, the polymer gives little or no background fluorescence and does not exhibit non-specific binding of fluorescently-labeled oligonucleotides. Finally, capture oligonucleotides spotted and coupled covalently at a discrete address do not "bleed over" to neighboring spots, hence obviating the need to physically segregate sites, e.g., by cutting gel pads.

The present invention relates to a strategy for high-throughput mutation detection which differs substantially from other array-based detection systems presented previously in the literature. In concert with a polymerase chain reaction/ligase detection reaction (PCR/LDR) assay carried out in solution, the array of the present invention allows for accurate detection of single base mutations, whether inherited and present as 50% of the sequence for that gene, or sporadic and present at 1% or less of the wild-type sequence. This sensitivity is achieved, because thermostable DNA ligase provides the specificity of mutation discrimination, while the divergent addressable array-specific portions of the LDR probes guide each LDR product to a designated address on the DNA array. Since the address sequences remain constant and their complements can be appended to any set of LDR probes, the addressable arrays of the present invention are universal. Thus, a single array design can be programmed to detect a wide range of genetic mutations.

Robust methods for the rapid detection of mutations at numerous potential sites in multiple genes hold great promise to improve the diagnosis and treatment of cancer patients. Noninvasive tests for mutational analysis of shed cells in saliva, sputum, urine, and stool could significantly simplify and improve the surveillance of high risk populations, reduce the cost and discomfort of endoscopic testing, and lead to more effective diagnosis of cancer in its early, curable stage. Although the feasibility of detecting shed mutations has been demonstrated clearly in patients with known and genetically characterized tumors (Sidransky, et al., Science, 256:102-105 (1992), Nollau, et al., Int. J. Cancer, 66:332-336 (1996); Calas, et al., Cancer Res. 54:3568-73 (1994); Hasegawa, et al., Oncogene 10:1413-16 (1995); and Wu et al., Early Detection of Cancer Molecular Markers (Lippman, et al. ed.) (1994), which are hereby incorporated by reference), effective presymptomatic screening will require that a myriad of potential low frequency mutations be identified with minimal false-positive and false-negative signals. Furthermore, the integration of technologies for determining the genetic changes within a tumor with clinical information about the likelihood of response to therapy could radically alter how patients with more advanced tumors are selected for treatment. Identification and validation of reliable genetic markers will require that many candidate genes be tested in large scale clinical trials. While costly microfabricated chips can be manufactured with over 100,000 addresses, none of them have demonstrated a capability to detect low abundance mutations (Hacia, et. al., Nat. Genet., 14441-447 (1996); Chee, et al., Science, 274:610-614 (1996); Kozal, et al., Nat. Med., 2:753-759 (1996); and Wang, et al., Science, 280:1077-1082 (1998), which are hereby incorporated by reference), as required to accurately score mutation profiles in such clinical trials. The universal addressable array approach of the present invention has the potential to allow rapid and reliable identification of low abundance mutations in multiple codons in numerous genes, as well as quantification of multiple gene deletions and amplifications associated with tumor progression. In addition, for mRNA expression profiling, the LDR-universal array can differentiate highly homologous genes, such as K-, N-, and H-ras. Moreover, as new therapies targeted to specific genes or specific mutant proteins are developed, the importance of rapid and accurate high-throughput genetic testing will undoubtedly increase.

Example 6

Computer Software For Designing Addressable Array to Avoid Binding to Target Sequence In designing an addressable array, it is important to insure that the target sequence does not hybridize to capture probes on the array. As described below, a computer program has been designed for this purpose. The program locates stretches of sequence that match any of the array sequences at N-x of N adjacent nucleotide positions. The parameters x and N are set by the user.

The program sends output to the screen and to a file. The screen output summarizes the number of sequences comparisons where the longest match was i of M bases, where M is greater than or equal to N, and where i is greater than or equal to M-x. The output file shows the actual match for each sequence pair, as well as giving the summary information provided on the screen. An example of the file output is shown below.

```
Input file 1: kraspoly.dos
Input file 2: zip64.dos
Minimum number of sites that must match:   7
Maximum number of mismatches allowed:      2
7 out of 8      attcagaatc (ATTTTGtG) gacgaa
K-rasc32Wt      (SEQ ID NO:9537)

ZIP1            cgcag (ATTTTGcG) ctggatttcaa
                    (SEQ ID NO:9538)

7 out of 9      attcagaatcattt (TGtGGACgA) a
K-rasc32Wt      (SEQ ID NO:9539)

ZIP4            atggccgtgc (TGgGGACaA) gtcaa
                    (SEQ ID NO:9540)

< . . . deleted output . . . >

7 out of 8      tgtggtagt (TGgAGCTG) gtga
K-rasc13.4D     (SEQ ID NO:9541)

ZIP61           ggctcgtg (TGtAGCTG) ccgttcct
                    (SEQ ID NO:9542)
```

```
                        -continued
7 out of 8      tgtggtagttg (GAGcTGGT) ga
K-rasc13.4D     (SEQ ID NO:9543)

Z1P62           ggtcaagcgct (GAGgTGGT) ccatc
                    (SEQ ID NO:9544)

SUMMARY OF ANALYSIS
Comparisons with 1 mismatch 8 out of 9 bases matching:                       10
7 out of 8 bases matching:                        9
Comparisons with 2 mismatches 9 out of 11 bases matching:                       2
8 out of 10 bases matching:                      27
7 out of 9 bases matching:                       36
A total of 84 out of 520 sequence comparisons met
the match criteria.
```

The area within the parentheses represents the longest identified match, with upper-case alleles representing the actual matched sites and lower-case alleles representing the allowed mismatches.

The program has been written in ANSI C for the purpose of portability across platforms. The precise software used is set forth in FIG. 35. The program accepts input files in straight text format. Sequences may include standard ambiguity codes (e.g., the code Y corresponds to either C or T).

Each of $F_1$ sequences in Input File #1 is compared to each of $F_2$ sequence in File #2, for a total of $F_1 \times F_2$ comparisons. For each pair, the two sequences are compared N consecutive sites at a time in all possible alignments. If a match of at least N-x out of N adjacent sites is detected, the number of sites compared is incremented by one (i.e., after i increments, the match criteria become N-x+i out of N+i sites). This process is repeated until no matches meeting the match criteria are found. The longest match for a sequence pair is defined as the match involving the longest value of N+i, as opposed to the longest value of N-x+i. Therefore, users are explicitly should repeat all analyses with different levels of stringency (i.e., x=0, x=1, x=2, . . . ). This is important if the user is concerned with the possibility that a perfect, or near-perfect, match might be masked by a less perfect match over a longer stretch. For example, 7 out of 7 matched sites would not be reported if (i) a pair of sequences matched at 8 out of 10 sites and (ii) if the match criterion allowed 2 mismatches.

Although the invention has been described in detail for the purpose of illustration, it is understood that such details are solely for that purpose and variations can be made therein by those skilled in the art without departing from the spirit and scope of the invention which is defined by the following claims.

SEQUENCE LISTING (9545 sequences)

SEQ ID NO: 1 - DNA, 24 bp, Artificial Sequence
  Description of Artificial Sequence:  Hypothetical Probe Sequence
ttgaaatccagcgcaaaatctgcg

SEQ ID NO: 2 - DNA, 24 bp, Artificial Sequence
  Description of Artificial Sequence:  Hypothetical Probe Sequence
ttgaaaagcctacacgacggcgaa

SEQ ID NO: 3 - DNA, 24 bp, Artificial Sequence
  Description of Artificial Sequence:  Hypothetical Probe Sequence
ttgatctgccatacgggcttacgg

SEQ ID NO: 4 - DNA, 24 bp, Artificial Sequence
  Description of Artificial Sequence:  Hypothetical Probe Sequence
ttgacttgtccccagcacggccat

SEQ ID NO: 5 - DNA, 24 bp, Artificial Sequence
  Description of Artificial Sequence:  Hypothetical Probe Sequence
ttgacgttgaccagcccgttgcaa

SEQ ID NO: 6 - DNA, 24 bp, Artificial Sequence
  Description of Artificial Sequence:  Hypothetical Probe Sequence
ttgacgaagctttcccccatgatg

SEQ ID NO: 7 - DNA, 24 bp, Artificial Sequence
  Description of Artificial Sequence:  Hypothetical Probe Sequence
ttgagcaaggacgaccgcaaacgg

SEQ ID NO: 8 - DNA, 24 bp, Artificial Sequence
  Description of Artificial Sequence:  Hypothetical Probe Sequence
ttgagatgacggacggtgcggcaa

SEQ ID NO: 9 - DNA, 24 bp, Artificial Sequence
  Description of Artificial Sequence:  Hypothetical Probe Sequence
ttgatcccatcgaaagggacgatg

SEQ ID NO: 10 - DNA, 24 bp, Artificial Sequence
  Description of Artificial Sequence:  Hypothetical Probe Sequence
ttgatgcgtctgggacgtgccttg

SEQ ID NO: 11 - DNA, 24 bp, Artificial Sequence
  Description of Artificial Sequence:  Hypothetical Probe Sequence
ttgacacgtcgtcagctcccgtgc

SEQ ID NO: 12 - DNA, 24 bp, Artificial Sequence
  Description of Artificial Sequence:  Hypothetical Probe Sequence
ttgacagcctgttgcggtgcgtct

SEQ ID NO: 13 - DNA, 24 bp, Artificial Sequence
  Description of Artificial Sequence:  Hypothetical Probe Sequence
ttgagtgcggtacttgcagcgatg

SEQ ID NO: 14 - DNA, 24 bp, Artificial Sequence
  Description of Artificial Sequence:  Hypothetical Probe Sequence
ttgaacggtctgcacgtcccagcc

SEQ ID NO: 15 - DNA, 24 bp, Artificial Sequence
  Description of Artificial Sequence:  Hypothetical Probe Sequence
tgattctggtgcgtgccagccagc

SEQ ID NO: 16 - DNA, 24 bp, Artificial Sequence
  Description of Artificial Sequence:  Hypothetical Probe Sequence
tgattgtcgctttctgacggagcc

SEQ ID NO: 17 - DNA, 24 bp, Artificial Sequence
  Description of Artificial Sequence:  Hypothetical Probe Sequence
tgatcgtttgcgggtatccctcgt

SEQ ID NO: 18 - DNA, 24 bp, Artificial Sequence
  Description of Artificial Sequence:  Hypothetical Probe Sequence
tgatcgaaaggacagcagcctccc

SEQ ID NO: 19 - DNA, 24 bp, Artificial Sequence
  Description of Artificial Sequence:  Hypothetical Probe Sequence
tgatgcaagcaacgaacacgctgt

SEQ ID NO: 20 - DNA, 24 bp, Artificial Sequence
  Description of Artificial Sequence:  Hypothetical Probe Sequence
tgattgcgagtggaccatcgccat

SEQ ID NO: 21 - DNA, 24 bp, Artificial Sequence
  Description of Artificial Sequence:  Hypothetical Probe Sequence
tgatcacgcttgccatggacggac

SEQ ID NO: 22 - DNA, 24 bp, Artificial Sequence
  Description of Artificial Sequence:  Hypothetical Probe Sequence
tgatgtgcctcaacgggtgcagcc

SEQ ID NO: 23 - DNA, 24 bp, Artificial Sequence
  Description of Artificial Sequence:  Hypothetical Probe Sequence
tgatggaccgttagccgatgttga

SEQ ID NO: 24 - DNA, 24 bp, Artificial Sequence
  Description of Artificial Sequence:  Hypothetical Probe Sequence
tgatacggaggaggactgcgtgcg

SEQ ID NO: 25 - DNA, 24 bp, Artificial Sequence
  Description of Artificial Sequence:  Hypothetical Probe Sequence
ttaggatgagccagcctgcgagcc

SEQ ID NO: 26 - DNA, 24 bp, Artificial Sequence
  Description of Artificial Sequence:  Hypothetical Probe Sequence
aatctcgtcgtttcccctcatgcg

SEQ ID NO: 27 - DNA, 24 bp, Artificial Sequence
  Description of Artificial Sequence:  Hypothetical Probe Sequence
aatcgcaactgtcgttcacggtgc

SEQ ID NO: 28 - DNA, 24 bp, Artificial Sequence
  Description of Artificial Sequence:  Hypothetical Probe Sequence
aatcaggacacgcagcgacctgcg

SEQ ID NO: 29 - DNA, 24 bp, Artificial Sequence
  Description of Artificial Sequence:  Hypothetical Probe Sequence
aatcgaccctgtgtctgctttgcg

SEQ ID NO: 30 - DNA, 24 bp, Artificial Sequence
  Description of Artificial Sequence:  Hypothetical Probe Sequence
aatcagccaaagcgaagtgcgatg

SEQ ID NO: 31 - DNA, 24 bp, Artificial Sequence
  Description of Artificial Sequence:  Hypothetical Probe Sequence
atacgacctcgtgagttcccgcaa

SEQ ID NO: 32 - DNA, 24 bp, Artificial Sequence
  Description of Artificial Sequence:  Hypothetical Probe Sequence
aaagcttgacctatcgagccgtgc

SEQ ID NO: 33 - DNA, 24 bp, Artificial Sequence
  Description of Artificial Sequence:  Hypothetical Probe Sequence
aaagagccgcttgagtcgaaatcg

SEQ ID NO: 34 - DNA, 24 bp, Artificial Sequence
  Description of Artificial Sequence:  Hypothetical Probe Sequence
tctgcttgctcacctaccattgcg

SEQ ID NO: 35 - DNA, 24 bp, Artificial Sequence
  Description of Artificial Sequence:  Hypothetical Probe Sequence
tctgatcgcctaggtaacggggac

SEQ ID NO: 36 - DNA, 24 bp, Artificial Sequence
  Description of Artificial Sequence:  Hypothetical Probe Sequence
tctgcagcggtactgtggacccat

SEQ ID NO: 37 - DNA, 24 bp, Artificial Sequence
  Description of Artificial Sequence:  Hypothetical Probe Sequence
tctgagccacctaatctcccacgg

SEQ ID NO: 38 - DNA, 24 bp, Artificial Sequence
  Description of Artificial Sequence:  Hypothetical Probe Sequence
tgtctcgttcccacctccattccc

SEQ ID NO: 39 - DNA, 24 bp, Artificial Sequence
  Description of Artificial Sequence:  Hypothetical Probe Sequence
tgtcatcgcagcgagtcagccacg

SEQ ID NO: 40 - DNA, 24 bp, Artificial Sequence
  Description of Artificial Sequence:  Hypothetical Probe Sequence
tgtccctaacctgatggtgcgcaa

SEQ ID NO: 41 - DNA, 24 bp, Artificial Sequence
  Description of Artificial Sequence:  Hypothetical Probe Sequence
tgtctgcggtctccatatcggtgc

SEQ ID NO: 42 - DNA, 24 bp, Artificial Sequence
  Description of Artificial Sequence:  Hypothetical Probe Sequence
tgtccacgcgttaccttgtcgatg

SEQ ID NO: 43 - DNA, 24 bp, Artificial Sequence
  Description of Artificial Sequence:  Hypothetical Probe Sequence
tgtcgtgctctgaccttgcgctca

SEQ ID NO: 44 - DNA, 24 bp, Artificial Sequence
  Description of Artificial Sequence:  Hypothetical Probe Sequence
tgtcacggaatcgtgctgcggctt

SEQ ID NO: 45 - DNA, 24 bp, Artificial Sequence
  Description of Artificial Sequence:  Hypothetical Probe Sequence
tcgttctggcttggacgcttctca

SEQ ID NO: 46 - DNA, 24 bp, Artificial Sequence
  Description of Artificial Sequence:  Hypothetical Probe Sequence
tcgttgcgtgtcggaccttggatg

SEQ ID NO: 47 - DNA, 24 bp, Artificial Sequence
  Description of Artificial Sequence:  Hypothetical Probe Sequence
cttgcgttgatgcgaatcgtcgaa

SEQ ID NO: 48 - DNA, 24 bp, Artificial Sequence
  Description of Artificial Sequence:  Hypothetical Probe Sequence
ctgtcacgctcaaccttccccgtt

SEQ ID NO: 49 - DNA, 24 bp, Artificial Sequence
  Description of Artificial Sequence:  Hypothetical Probe Sequence
ctgtgtgccgtttcgtgtgcagtg

SEQ ID NO: 50 - DNA, 24 bp, Artificial Sequence
  Description of Artificial Sequence:  Hypothetical Probe Sequence
ccatgcaatcccaggatgtcggta

SEQ ID NO: 51 - DNA, 24 bp, Artificial Sequence
  Description of Artificial Sequence:  Hypothetical Probe Sequence
ccatcagctctggcaatgcggagt

SEQ ID NO: 52 - DNA, 24 bp, Artificial Sequence
  Description of Artificial Sequence:  Hypothetical Probe Sequence
cgaatctgggtaaggaagccatcg

SEQ ID NO: 53 - DNA, 24 bp, Artificial Sequence
  Description of Artificial Sequence:  Hypothetical Probe Sequence
cgaatgtcctgtccatcgaatgcg

SEQ ID NO: 54 - DNA, 24 bp, Artificial Sequence
  Description of Artificial Sequence:  Hypothetical Probe Sequence
cgaacgtttacatgcgtcgtagcc

SEQ ID NO: 55 - DNA, 24 bp, Artificial Sequence
  Description of Artificial Sequence:  Hypothetical Probe Sequence
cgaaagtgagccgcaacttgggac

SEQ ID NO: 56 - DNA, 24 bp, Artificial Sequence
  Description of Artificial Sequence:  Hypothetical Probe Sequence
cgaaggacagtgagtgtgcgcacg

SEQ ID NO: 57 - DNA, 24 bp, Artificial Sequence
  Description of Artificial Sequence:  Hypothetical Probe Sequence
gcaaagccataccttggcttgctt

SEQ ID NO: 58 - DNA, 24 bp, Artificial Sequence
  Description of Artificial Sequence:  Hypothetical Probe Sequence
acctcttgcctacgaacagccgaa

SEQ ID NO: 59 - DNA, 24 bp, Artificial Sequence
  Description of Artificial Sequence:  Hypothetical Probe Sequence
acctgcaagtgcccatgtgcccta

SEQ ID NO: 60 - DNA, 24 bp, Artificial Sequence
  Description of Artificial Sequence:  Hypothetical Probe Sequence
aggatctggaccggactccccgaa

SEQ ID NO: 61 - DNA, 24 bp, Artificial Sequence
  Description of Artificial Sequence:  Hypothetical Probe Sequence
aggaacggcagctacacacgagcc

SEQ ID NO: 62 - DNA, 24 bp, Artificial Sequence
  Description of Artificial Sequence:  Hypothetical Probe Sequence
gatggaccacctcagcgcttgacc

SEQ ID NO: 63 - DNA, 24 bp, Artificial Sequence
  Description of Artificial Sequence:  Hypothetical Probe Sequence
tcccttaggacccagcgtctgtgc

SEQ ID NO: 64 - DNA, 24 bp, Artificial Sequence
  Description of Artificial Sequence:  Hypothetical Probe Sequence
tgcgccataaaggaccttagccat

SEQ ID NO: 65 - DNA, 24 bp, Artificial Sequence
  Description of Artificial Sequence:  Hypothetical Probe Sequence
tgcgaggaccatggtaggtaagcc

SEQ ID NO: 66 - DNA, 24 bp, Artificial Sequence
  Description of Artificial Sequence:  Hypothetical Probe Sequence
ttgatcgtggacacggcacgctca

SEQ ID NO: 67 - DNA, 24 bp, Artificial Sequence
  Description of Artificial Sequence:  Hypothetical Probe Sequence
ttgaagtgcagccacgaaagcgaa

SEQ ID NO: 68 - DNA, 24 bp, Artificial Sequence
  Description of Artificial Sequence:  Hypothetical Probe Sequence
ttgaatcggagttgcgcgttggac

SEQ ID NO: 69 - DNA, 24 bp, Artificial Sequence
  Description of Artificial Sequence:  Hypothetical Probe Sequence
tgatgatggcttcagctgcgcgaa

SEQ ID NO: 70 - DNA, 24 bp, Artificial Sequence
  Description of Artificial Sequence:  Hypothetical Probe Sequence
tgattcccttgaacggtcccggac

SEQ ID NO: 71 - DNA, 24 bp, Artificial Sequence
  Description of Artificial Sequence:  Hypothetical Probe Sequence
ttaggcaattgatcccgaccgtgc

SEQ ID NO: 72 - DNA, 24 bp, Artificial Sequence
  Description of Artificial Sequence:  Hypothetical Probe Sequence
ttagtcccacgggatgcgttgacc

SEQ ID NO: 73 - DNA, 24 bp, Artificial Sequence
  Description of Artificial Sequence:  Hypothetical Probe Sequence
aatcggacatcgagtgtccccagc

SEQ ID NO: 74 - DNA, 24 bp, Artificial Sequence
  Description of Artificial Sequence:  Hypothetical Probe Sequence
atactgcgcgttctgtgagttgcg

SEQ ID NO: 75 - DNA, 24 bp, Artificial Sequence
  Description of Artificial Sequence:  Hypothetical Probe Sequence
tctggtctgcaatcgtcacgcagc

SEQ ID NO: 76 - DNA, 24 bp, Artificial Sequence
  Description of Artificial Sequence:  Hypothetical Probe Sequence
tgtcagtgcacggcttctgttgcg

SEQ ID NO: 77 - DNA, 24 bp, Artificial Sequence
  Description of Artificial Sequence:  Hypothetical Probe Sequence
tcgtctcagcttgaccgcttcagc

SEQ ID NO: 78 - DNA, 24 bp, Artificial Sequence
  Description of Artificial Sequence:  Hypothetical Probe Sequence
tcgtcagccctaatcgacctgtgc

SEQ ID NO: 79 - DNA, 24 bp, Artificial Sequence
  Description of Artificial Sequence:  Hypothetical Probe Sequence
tcgtgtgcgcttaatcacggaatc

SEQ ID NO: 80 - DNA, 24 bp, Artificial Sequence
  Description of Artificial Sequence:  Hypothetical Probe Sequence
cgttcgaagtctcttgacggacgg

SEQ ID NO: 81 - DNA, 24 bp, Artificial Sequence
  Description of Artificial Sequence:  Hypothetical Probe Sequence
cgtttcccaatcatcggcaagtct

SEQ ID NO: 82 - DNA, 24 bp, Artificial Sequence
  Description of Artificial Sequence:  Hypothetical Probe Sequence
cgttgtgctgatgcaaatcggctt

SEQ ID NO: 83 - DNA, 24 bp, Artificial Sequence
  Description of Artificial Sequence:  Hypothetical Probe Sequence
ctgtcttggtgcgcaaaggatgcg

SEQ ID NO: 84 - DNA, 24 bp, Artificial Sequence
  Description of Artificial Sequence:  Hypothetical Probe Sequence
cgaatcgtttgagcaagacccacg

SEQ ID NO: 85 - DNA, 24 bp, Artificial Sequence
  Description of Artificial Sequence:  Hypothetical Probe Sequence
cgaacagctgcgaatcgtctagcc

SEQ ID NO: 86 - DNA, 24 bp, Artificial Sequence
  Description of Artificial Sequence:  Hypothetical Probe Sequence
gagttcgtgcttacggcttgagcc

SEQ ID NO: 87 - DNA, 24 bp, Artificial Sequence
  Description of Artificial Sequence:  Hypothetical Probe Sequence
agtgtcccgagtacctggacacgg

SEQ ID NO: 88 - DNA, 24 bp, Artificial Sequence
  Description of Artificial Sequence:  Hypothetical Probe Sequence
tcccgctttgattctgtcgttcgt

SEQ ID NO: 89 - DNA, 24 bp, Artificial Sequence
  Description of Artificial Sequence:  Hypothetical Probe Sequence
tcccacctgtctacctagccgacc

SEQ ID NO: 90 - DNA, 24 bp, Artificial Sequence
  Description of Artificial Sequence:  Hypothetical Probe Sequence
tccccacgatacacctttgatgcg

SEQ ID NO: 91 - DNA, 24 bp, Artificial Sequence
  Description of Artificial Sequence:  Hypothetical Probe Sequence
tgcgcttgatactgtcgcttcgaa

SEQ ID NO: 92 - DNA, 24 bp, Artificial Sequence
  Description of Artificial Sequence:  Hypothetical Probe Sequence
tgcgctcaatacagcctcgtatcg

SEQ ID NO: 93 - DNA, 24 bp, Artificial Sequence
  Description of Artificial Sequence:  Hypothetical Probe Sequence
tgcgatcgcgaagcaatgatcgtt

SEQ ID NO: 94 - DNA, 24 bp, Artificial Sequence
  Description of Artificial Sequence:  Hypothetical Probe Sequence
tgcgtccctctgtgatcacgagga

SEQ ID NO: 95 - DNA, 24 bp, Artificial Sequence
  Description of Artificial Sequence:  Hypothetical Probe Sequence
tgcgcacgaggaatcgcttgagtg

SEQ ID NO: 96 - DNA, 24 bp, Artificial Sequence
  Description of Artificial Sequence:  Hypothetical Probe Sequence
cacggtgctacagtgcaaagcacg

SEQ ID NO: 97 - DNA, 24 bp, Artificial Sequence
  Description of Artificial Sequence:  Hypothetical Probe Sequence
ttgaaaagggacgtgcgcttcgaa

SEQ ID NO: 98 - DNA, 24 bp, Artificial Sequence
  Description of Artificial Sequence:  Hypothetical Probe Sequence
ttgatctgcacgcgttgtgcggta

SEQ ID NO: 99 - DNA, 24 bp, Artificial Sequence
  Description of Artificial Sequence:  Hypothetical Probe Sequence
ttgatgtcccattccccacgcgtt

SEQ ID NO: 100 - DNA, 24 bp, Artificial Sequence
  Description of Artificial Sequence:  Hypothetical Probe Sequence
ttgatcgtagccggtatgcgacgg

SEQ ID NO: 101 - DNA, 24 bp, Artificial Sequence
  Description of Artificial Sequence:  Hypothetical Probe Sequence
ttgaccatgcttcgaaacggcgaa

SEQ ID NO: 102 - DNA, 24 bp, Artificial Sequence
  Description of Artificial Sequence:  Hypothetical Probe Sequence
ttgacgaaatcggcaacctatgcg

SEQ ID NO: 103 - DNA, 24 bp, Artificial Sequence
  Description of Artificial Sequence:  Hypothetical Probe Sequence
ttgatcccggtattagagcccacg

SEQ ID NO: 104 - DNA, 24 bp, Artificial Sequence
  Description of Artificial Sequence:  Hypothetical Probe Sequence
ttgatgcgtgcgctcaatcgagga

SEQ ID NO: 105 - DNA, 24 bp, Artificial Sequence
  Description of Artificial Sequence:  Hypothetical Probe Sequence
ttgatgcgagccgatgccatcttg

SEQ ID NO: 106 - DNA, 24 bp, Artificial Sequence
  Description of Artificial Sequence:  Hypothetical Probe Sequence
ttgacagcacgggacccctacacg

SEQ ID NO: 107 - DNA, 24 bp, Artificial Sequence
  Description of Artificial Sequence:  Hypothetical Probe Sequence
ttgagtgctcccgcaacgttgtgc

SEQ ID NO: 108 - DNA, 24 bp, Artificial Sequence
  Description of Artificial Sequence:  Hypothetical Probe Sequence
ttgaacgggcaaacctcttgcttg

SEQ ID NO: 109 - DNA, 24 bp, Artificial Sequence
  Description of Artificial Sequence:  Hypothetical Probe Sequence
ttgaacgggatggcaaggacctca

SEQ ID NO: 110 - DNA, 24 bp, Artificial Sequence
  Description of Artificial Sequence:  Hypothetical Probe Sequence
ttgaagcctgtccgtttgcgacgg

SEQ ID NO: 111 - DNA, 24 bp, Artificial Sequence
  Description of Artificial Sequence:  Hypothetical Probe Sequence
ttgaagccaggatcccaaagccta

SEQ ID NO: 112 - DNA, 24 bp, Artificial Sequence
  Description of Artificial Sequence:  Hypothetical Probe Sequence
tgattctgacggtcccgcttacgg

SEQ ID NO: 113 - DNA, 24 bp, Artificial Sequence
  Description of Artificial Sequence:  Hypothetical Probe Sequence
tgattgtccacgtgcgggacacgg

SEQ ID NO: 114 - DNA, 24 bp, Artificial Sequence
  Description of Artificial Sequence:  Hypothetical Probe Sequence
tgatcgaagtgccacgcacgcgtt

SEQ ID NO: 115 - DNA, 24 bp, Artificial Sequence
  Description of Artificial Sequence:  Hypothetical Probe Sequence
tgatggtaacggctcaagccgctt

SEQ ID NO: 116 - DNA, 24 bp, Artificial Sequence
  Description of Artificial Sequence:  Hypothetical Probe Sequence
tgatgcaaagccgtgcagcctctg

SEQ ID NO: 117 - DNA, 24 bp, Artificial Sequence
  Description of Artificial Sequence:  Hypothetical Probe Sequence
tgatgatggtgcgcttagccgcaa

SEQ ID NO: 118 - DNA, 24 bp, Artificial Sequence
  Description of Artificial Sequence:  Hypothetical Probe Sequence
tgattccctcccggtatcgtacgg

SEQ ID NO: 119 - DNA, 24 bp, Artificial Sequence
  Description of Artificial Sequence:  Hypothetical Probe Sequence
tgattccccacggagtggaccagc

SEQ ID NO: 120 - DNA, 24 bp, Artificial Sequence
  Description of Artificial Sequence:  Hypothetical Probe Sequence
tgatcacgatcgggacgcaacacg

SEQ ID NO: 121 - DNA, 24 bp, Artificial Sequence
  Description of Artificial Sequence:  Hypothetical Probe Sequence
tgatcacgtcccttgagaccgcaa

SEQ ID NO: 122 - DNA, 24 bp, Artificial Sequence
  Description of Artificial Sequence:  Hypothetical Probe Sequence
tgatcagccacgggacagccagtg

SEQ ID NO: 123 - DNA, 24 bp, Artificial Sequence
  Description of Artificial Sequence:  Hypothetical Probe Sequence
tgatcagcggacttagtcccgtgc

SEQ ID NO: 124 - DNA, 24 bp, Artificial Sequence
  Description of Artificial Sequence:  Hypothetical Probe Sequence
tgatgacccgaatgattgtcgcaa

SEQ ID NO: 125 - DNA, 24 bp, Artificial Sequence
  Description of Artificial Sequence:  Hypothetical Probe Sequence
tgatgaccatcgagcccacgagga

SEQ ID NO: 126 - DNA, 24 bp, Artificial Sequence
  Description of Artificial Sequence:  Hypothetical Probe Sequence
tgatgtgccgaagagtcacgggac

SEQ ID NO: 127 - DNA, 24 bp, Artificial Sequence
  Description of Artificial Sequence:  Hypothetical Probe Sequence
tgatgtgcgtctacggagcctgcg

SEQ ID NO: 128 - DNA, 24 bp, Artificial Sequence
  Description of Artificial Sequence:  Hypothetical Probe Sequence
tgatgtgcgagtacggacggcgtt

SEQ ID NO: 129 - DNA, 24 bp, Artificial Sequence
  Description of Artificial Sequence:  Hypothetical Probe Sequence
tgatgtgctgcgaaagaggatccc

SEQ ID NO: 130 - DNA, 24 bp, Artificial Sequence
  Description of Artificial Sequence:  Hypothetical Probe Sequence
tgatggacgacccgaaggaccttg

SEQ ID NO: 131 - DNA, 24 bp, Artificial Sequence
  Description of Artificial Sequence:  Hypothetical Probe Sequence
tgatggacagccgcttgaccgatg

SEQ ID NO: 132 - DNA, 24 bp, Artificial Sequence
  Description of Artificial Sequence:  Hypothetical Probe Sequence
ttaggcaatgcgctgtcctaacgg

SEQ ID NO: 133 - DNA, 24 bp, Artificial Sequence
  Description of Artificial Sequence:  Hypothetical Probe Sequence
ttagatcgcacgtctgcttgccat

SEQ ID NO: 134 - DNA, 24 bp, Artificial Sequence
  Description of Artificial Sequence:  Hypothetical Probe Sequence
ttagcagcgcaatacaggaccacg

SEQ ID NO: 135 - DNA, 24 bp, Artificial Sequence
  Description of Artificial Sequence:  Hypothetical Probe Sequence
ttagggacctgtgtgccttgcgtt

SEQ ID NO: 136 - DNA, 24 bp, Artificial Sequence
  Description of Artificial Sequence:  Hypothetical Probe Sequence
ttagggacggacaatcgatgcacg

SEQ ID NO: 137 - DNA, 24 bp, Artificial Sequence
  Description of Artificial Sequence:  Hypothetical Probe Sequence
aatctctgcgttcctatgcgcgaa

SEQ ID NO: 138 - DNA, 24 bp, Artificial Sequence
  Description of Artificial Sequence:  Hypothetical Probe Sequence
aatccgtttcccatacgatgcgaa

SEQ ID NO: 139 - DNA, 24 bp, Artificial Sequence
  Description of Artificial Sequence:  Hypothetical Probe Sequence
aatccgaatctgtccctcccggac

SEQ ID NO: 140 - DNA, 24 bp, Artificial Sequence
  Description of Artificial Sequence:  Hypothetical Probe Sequence
aatccgaagcaaacggtgtcgatg

SEQ ID NO: 141 - DNA, 24 bp, Artificial Sequence
  Description of Artificial Sequence:  Hypothetical Probe Sequence
aatccgaacacggaccggacagtg

SEQ ID NO: 142 - DNA, 24 bp, Artificial Sequence
  Description of Artificial Sequence:  Hypothetical Probe Sequence
aatcgcttttaggatgcagcacgg

SEQ ID NO: 143 - DNA, 24 bp, Artificial Sequence
  Description of Artificial Sequence:  Hypothetical Probe Sequence
aatcgcttccatcgaagaccggta

SEQ ID NO: 144 - DNA, 24 bp, Artificial Sequence
  Description of Artificial Sequence:  Hypothetical Probe Sequence
aatcgagtcgaatgcgtcccagcc

SEQ ID NO: 145 - DNA, 24 bp, Artificial Sequence
  Description of Artificial Sequence:  Hypothetical Probe Sequence
aatcaggaacggcgttcttggctt

SEQ ID NO: 146 - DNA, 24 bp, Artificial Sequence
  Description of Artificial Sequence:  Hypothetical Probe Sequence
aatctgcgtcgttctgtcccgatg

SEQ ID NO: 147 - DNA, 24 bp, Artificial Sequence
  Description of Artificial Sequence:  Hypothetical Probe Sequence
aatccagcgatgggacgagtcgtt

SEQ ID NO: 148 - DNA, 24 bp, Artificial Sequence
  Description of Artificial Sequence:  Hypothetical Probe Sequence
aatcgtgcaggactcaggactgcg

SEQ ID NO: 149 - DNA, 24 bp, Artificial Sequence
  Description of Artificial Sequence:  Hypothetical Probe Sequence
aatcggactgcgccatacctgcaa

SEQ ID NO: 150 - DNA, 24 bp, Artificial Sequence
  Description of Artificial Sequence:  Hypothetical Probe Sequence
aatcagccatcgctgtgcttgcaa

SEQ ID NO: 151 - DNA, 24 bp, Artificial Sequence
  Description of Artificial Sequence:  Hypothetical Probe Sequence
aatcagccgtgcggtagaccggac

SEQ ID NO: 152 - DNA, 24 bp, Artificial Sequence
  Description of Artificial Sequence:  Hypothetical Probe Sequence
atacgcttggacgagttgcggcaa

SEQ ID NO: 153 - DNA, 24 bp, Artificial Sequence
  Description of Artificial Sequence:  Hypothetical Probe Sequence
atacgcaagaccatcgcacggcaa

SEQ ID NO: 154 - DNA, 24 bp, Artificial Sequence
  Description of Artificial Sequence:  Hypothetical Probe Sequence
ataccagcctcaagcccgaagtgc

SEQ ID NO: 155 - DNA, 24 bp, Artificial Sequence
  Description of Artificial Sequence:  Hypothetical Probe Sequence
atacgtgctcgtgctttgcgtgcg

SEQ ID NO: 156 - DNA, 24 bp, Artificial Sequence
  Description of Artificial Sequence:  Hypothetical Probe Sequence
aaagcgtttgtccttggatgcgaa

SEQ ID NO: 157 - DNA, 24 bp, Artificial Sequence
  Description of Artificial Sequence:  Hypothetical Probe Sequence
aaagctcatcgtggaccgaaagcc

SEQ ID NO: 158 - DNA, 24 bp, Artificial Sequence
  Description of Artificial Sequence:  Hypothetical Probe Sequence
aaagcgaactgtagtgcagcacgg

SEQ ID NO: 159 - DNA, 24 bp, Artificial Sequence
  Description of Artificial Sequence:  Hypothetical Probe Sequence
aaagatcgcttgctgtacggcgaa

SEQ ID NO: 160 - DNA, 24 bp, Artificial Sequence
  Description of Artificial Sequence:  Hypothetical Probe Sequence
aaagatcgggtatgcgcacgtgtc

SEQ ID NO: 161 - DNA, 24 bp, Artificial Sequence
  Description of Artificial Sequence:  Hypothetical Probe Sequence
aaagtgcgatcgaggactcaacgg

SEQ ID NO: 162 - DNA, 24 bp, Artificial Sequence
  Description of Artificial Sequence:  Hypothetical Probe Sequence
aaaggaccgcaactgttcgtgctt

SEQ ID NO: 163 - DNA, 24 bp, Artificial Sequence
  Description of Artificial Sequence:  Hypothetical Probe Sequence
aaagggaccgaaagtgccatggac

SEQ ID NO: 164 - DNA, 24 bp, Artificial Sequence
  Description of Artificial Sequence:  Hypothetical Probe Sequence
tacaccattccctccccagcgcaa

SEQ ID NO: 165 - DNA, 24 bp, Artificial Sequence
  Description of Artificial Sequence:  Hypothetical Probe Sequence
tacatccccttgcgaatgcgtgcg

SEQ ID NO: 166 - DNA, 24 bp, Artificial Sequence
  Description of Artificial Sequence:  Hypothetical Probe Sequence
tacaacggctgttcgttgtcgcaa

SEQ ID NO: 167 - DNA, 24 bp, Artificial Sequence
  Description of Artificial Sequence:  Hypothetical Probe Sequence
tacaacgggctttgtccacggagt

SEQ ID NO: 168 - DNA, 24 bp, Artificial Sequence
  Description of Artificial Sequence:  Hypothetical Probe Sequence
tacaacggacggccatccatgctt

SEQ ID NO: 169 - DNA, 24 bp, Artificial Sequence
  Description of Artificial Sequence:  Hypothetical Probe Sequence
tctgttgaagcccgttcgaaacgg

SEQ ID NO: 170 - DNA, 24 bp, Artificial Sequence
  Description of Artificial Sequence:  Hypothetical Probe Sequence
tctgtgattgcgcttgggacgatg

SEQ ID NO: 171 - DNA, 24 bp, Artificial Sequence
  Description of Artificial Sequence:  Hypothetical Probe Sequence
tctgaatctgcgcgaatgtctgcg

SEQ ID NO: 172 - DNA, 24 bp, Artificial Sequence
  Description of Artificial Sequence:  Hypothetical Probe Sequence
tctgaatccacgttagtgcgcacg

SEQ ID NO: 173 - DNA, 24 bp, Artificial Sequence
  Description of Artificial Sequence:  Hypothetical Probe Sequence
tctgcttgctgtgctttcccccta

SEQ ID NO: 174 - DNA, 24 bp, Artificial Sequence
  Description of Artificial Sequence:  Hypothetical Probe Sequence
tctgcttggcttagtggcttcacg

SEQ ID NO: 175 - DNA, 24 bp, Artificial Sequence
  Description of Artificial Sequence:  Hypothetical Probe Sequence
tctgcttggatgccatacggtgcg

SEQ ID NO: 176 - DNA, 24 bp, Artificial Sequence
  Description of Artificial Sequence:  Hypothetical Probe Sequence
tctgcttggaccctgtcacggcaa

SEQ ID NO: 177 - DNA, 24 bp, Artificial Sequence
  Description of Artificial Sequence:  Hypothetical Probe Sequence
tctgcgttatcgcacggagtgcaa

SEQ ID NO: 178 - DNA, 24 bp, Artificial Sequence
  Description of Artificial Sequence:  Hypothetical Probe Sequence
tctgcgttagccggacctgtcacg

SEQ ID NO: 179 - DNA, 24 bp, Artificial Sequence
  Description of Artificial Sequence:  Hypothetical Probe Sequence
tctgccatgaccgacctccccttg

SEQ ID NO: 180 - DNA, 24 bp, Artificial Sequence
  Description of Artificial Sequence:  Hypothetical Probe Sequence
tctggctttgtccagcgcaatccc

SEQ ID NO: 181 - DNA, 24 bp, Artificial Sequence
  Description of Artificial Sequence:  Hypothetical Probe Sequence
tctggcttgtgcgtctgtgccgtt

SEQ ID NO: 182 - DNA, 24 bp, Artificial Sequence
  Description of Artificial Sequence:  Hypothetical Probe Sequence
tctgggtacgttcgaatcccccat

SEQ ID NO: 183 - DNA, 24 bp, Artificial Sequence
  Description of Artificial Sequence:  Hypothetical Probe Sequence
tctgggtagtgcatcgcgaagctt

SEQ ID NO: 184 - DNA, 24 bp, Artificial Sequence
  Description of Artificial Sequence:  Hypothetical Probe Sequence
tctgacctacgggtgccgttgtgc

SEQ ID NO: 185 - DNA, 24 bp, Artificial Sequence
  Description of Artificial Sequence:  Hypothetical Probe Sequence
tctgatcgtgcggtctacgggtgc

SEQ ID NO: 186 - DNA, 24 bp, Artificial Sequence
  Description of Artificial Sequence:  Hypothetical Probe Sequence
tctgatcgggaccagcatcggacc

SEQ ID NO: 187 - DNA, 24 bp, Artificial Sequence
  Description of Artificial Sequence:  Hypothetical Probe Sequence
tctgtcccctgtgaccagccgatg

SEQ ID NO: 188 - DNA, 24 bp, Artificial Sequence
  Description of Artificial Sequence:  Hypothetical Probe Sequence
tctgtgcgaaagggaccagcagga

SEQ ID NO: 189 - DNA, 24 bp, Artificial Sequence
  Description of Artificial Sequence:  Hypothetical Probe Sequence
tctgcacgacctttgatcccgatg

SEQ ID NO: 190 - DNA, 24 bp, Artificial Sequence
  Description of Artificial Sequence:  Hypothetical Probe Sequence
tctggtgcaatcgacccacgcagc

SEQ ID NO: 191 - DNA, 24 bp, Artificial Sequence
  Description of Artificial Sequence:  Hypothetical Probe Sequence
tctgagccgacctcgtgatgcttg

SEQ ID NO: 192 - DNA, 24 bp, Artificial Sequence
  Description of Artificial Sequence:  Hypothetical Probe Sequence
tgtctcgtgtgctcgtgaccgcaa

SEQ ID NO: 193 - DNA, 24 bp, Artificial Sequence
  Description of Artificial Sequence:  Hypothetical Probe Sequence
tgtccgttttgaggacgaccatcg

SEQ ID NO: 194 - DNA, 24 bp, Artificial Sequence
  Description of Artificial Sequence:  Hypothetical Probe Sequence
tgtccgtttgattccccttggcaa

SEQ ID NO: 195 - DNA, 24 bp, Artificial Sequence
  Description of Artificial Sequence:  Hypothetical Probe Sequence
tgtccgttgtgccgttcagcctgt

SEQ ID NO: 196 - DNA, 24 bp, Artificial Sequence
  Description of Artificial Sequence:  Hypothetical Probe Sequence
tgtcccatttgaaaagcagctgcg

SEQ ID NO: 197 - DNA, 24 bp, Artificial Sequence
  Description of Artificial Sequence:  Hypothetical Probe Sequence
tgtcgcttacggatacagccgatg

SEQ ID NO: 198 - DNA, 24 bp, Artificial Sequence
  Description of Artificial Sequence:  Hypothetical Probe Sequence
tgtcggtaggacatcgggaccacg

SEQ ID NO: 199 - DNA, 24 bp, Artificial Sequence
  Description of Artificial Sequence:  Hypothetical Probe Sequence
tgtcgagtgcttgtgcgtgcgacc

SEQ ID NO: 200 - DNA, 24 bp, Artificial Sequence
  Description of Artificial Sequence:  Hypothetical Probe Sequence
tgtcgcaacttgcttggtgctccc

SEQ ID NO: 201 - DNA, 24 bp, Artificial Sequence
  Description of Artificial Sequence:  Hypothetical Probe Sequence
tgtcgcaaccatcacggtctgctt

SEQ ID NO: 202 - DNA, 24 bp, Artificial Sequence
  Description of Artificial Sequence:  Hypothetical Probe Sequence
tgtcgcaaggtaaatctgcgtccc

SEQ ID NO: 203 - DNA, 24 bp, Artificial Sequence
  Description of Artificial Sequence:  Hypothetical Probe Sequence
tgtcatcggaccaatcatcgcgaa

SEQ ID NO: 204 - DNA, 24 bp, Artificial Sequence
  Description of Artificial Sequence:  Hypothetical Probe Sequence
tgtcaggacgaatcccatcggcaa

SEQ ID NO: 205 - DNA, 24 bp, Artificial Sequence
  Description of Artificial Sequence:  Hypothetical Probe Sequence
tgtcgatgcttgtacatcccgcaa

SEQ ID NO: 206 - DNA, 24 bp, Artificial Sequence
  Description of Artificial Sequence:  Hypothetical Probe Sequence
tgtcgatggatggacctgcgacgg

SEQ ID NO: 207 - DNA, 24 bp, Artificial Sequence
  Description of Artificial Sequence:  Hypothetical Probe Sequence
tgtcgatgtccctcgtgcttgtgc

SEQ ID NO: 208 - DNA, 24 bp, Artificial Sequence
  Description of Artificial Sequence:  Hypothetical Probe Sequence
tgtcgatgtgcgcctacagcatcg

SEQ ID NO: 209 - DNA, 24 bp, Artificial Sequence
  Description of Artificial Sequence:  Hypothetical Probe Sequence
tgtcgatgcacgacctttagcgaa

SEQ ID NO: 210 - DNA, 24 bp, Artificial Sequence
  Description of Artificial Sequence:  Hypothetical Probe Sequence
tgtctgcgcctatgatcttgcagc

SEQ ID NO: 211 - DNA, 24 bp, Artificial Sequence
  Description of Artificial Sequence:  Hypothetical Probe Sequence
tgtccacggcaaaaagcctagacc

SEQ ID NO: 212 - DNA, 24 bp, Artificial Sequence
  Description of Artificial Sequence:  Hypothetical Probe Sequence
tgtccacgcagcaatcagccttga

SEQ ID NO: 213 - DNA, 24 bp, Artificial Sequence
  Description of Artificial Sequence:  Hypothetical Probe Sequence
tgtccagcatcgccatgatggctt

SEQ ID NO: 214 - DNA, 24 bp, Artificial Sequence
  Description of Artificial Sequence:  Hypothetical Probe Sequence
tgtccagccagccttgcgaactgt

SEQ ID NO: 215 - DNA, 24 bp, Artificial Sequence
  Description of Artificial Sequence:  Hypothetical Probe Sequence
tgtcgaccaaagagccagcccgaa

SEQ ID NO: 216 - DNA, 24 bp, Artificial Sequence
  Description of Artificial Sequence:  Hypothetical Probe Sequence
tgtcgaccggtaagccgaccatac

SEQ ID NO: 217 - DNA, 24 bp, Artificial Sequence
  Description of Artificial Sequence:  Hypothetical Probe Sequence
tgtcgaccagtgcagcgatggcaa

SEQ ID NO: 218 - DNA, 24 bp, Artificial Sequence
  Description of Artificial Sequence:  Hypothetical Probe Sequence
tgtcgacctcccgacctcgtcagc

SEQ ID NO: 219 - DNA, 24 bp, Artificial Sequence
  Description of Artificial Sequence:  Hypothetical Probe Sequence
tgtcgaccgtgctgtcaatccacg

SEQ ID NO: 220 - DNA, 24 bp, Artificial Sequence
  Description of Artificial Sequence:  Hypothetical Probe Sequence
tgtcgtgctgtctcgtagcccgaa

SEQ ID NO: 221 - DNA, 24 bp, Artificial Sequence
  Description of Artificial Sequence:  Hypothetical Probe Sequence
tgtcgtgccctatctgtgcggtct

SEQ ID NO: 222 - DNA, 24 bp, Artificial Sequence
  Description of Artificial Sequence:  Hypothetical Probe Sequence
tgtcgtgccagcccataggaatcg

SEQ ID NO: 223 - DNA, 24 bp, Artificial Sequence
  Description of Artificial Sequence:  Hypothetical Probe Sequence
tgtcggacaaagtgcgacggatcg

SEQ ID NO: 224 - DNA, 24 bp, Artificial Sequence
  Description of Artificial Sequence:  Hypothetical Probe Sequence
tgtcggacctcaatacgtgccagc

SEQ ID NO: 225 - DNA, 24 bp, Artificial Sequence
  Description of Artificial Sequence:  Hypothetical Probe Sequence
tgtcggacccatgaccctcaccat

SEQ ID NO: 226 - DNA, 24 bp, Artificial Sequence
  Description of Artificial Sequence:  Hypothetical Probe Sequence
tgtcacggcgttaaagtgtccgaa

SEQ ID NO: 227 - DNA, 24 bp, Artificial Sequence
  Description of Artificial Sequence:  Hypothetical Probe Sequence
tgtcagcccttgcagcaaagcttg

SEQ ID NO: 228 - DNA, 24 bp, Artificial Sequence
  Description of Artificial Sequence:  Hypothetical Probe Sequence
tcgtaaagacggtgtcgcaacacg

SEQ ID NO: 229 - DNA, 24 bp, Artificial Sequence
  Description of Artificial Sequence:  Hypothetical Probe Sequence
tcgtcttgcttgcgttatcgccat

SEQ ID NO: 230 - DNA, 24 bp, Artificial Sequence
  Description of Artificial Sequence:  Hypothetical Probe Sequence
tcgtcgttgcaactcaggtatgcg

SEQ ID NO: 231 - DNA, 24 bp, Artificial Sequence
  Description of Artificial Sequence:  Hypothetical Probe Sequence
tcgtcgttaggaacctacggcgaa

SEQ ID NO: 232 - DNA, 24 bp, Artificial Sequence
  Description of Artificial Sequence:  Hypothetical Probe Sequence
tcgtcgttcacgtacatcgttgcg

SEQ ID NO: 233 - DNA, 24 bp, Artificial Sequence
  Description of Artificial Sequence:  Hypothetical Probe Sequence
tcgtctgttcgtgaccacggtgcg

SEQ ID NO: 234 - DNA, 24 bp, Artificial Sequence
  Description of Artificial Sequence:  Hypothetical Probe Sequence
tcgtccatatcgcagcccatcagc

SEQ ID NO: 235 - DNA, 24 bp, Artificial Sequence
  Description of Artificial Sequence:  Hypothetical Probe Sequence
tcgtccatggaccgaagcaagacc

SEQ ID NO: 236 - DNA, 24 bp, Artificial Sequence
  Description of Artificial Sequence:  Hypothetical Probe Sequence
tcgtacctgtgccagccacggtgc

SEQ ID NO: 237 - DNA, 24 bp, Artificial Sequence
  Description of Artificial Sequence:  Hypothetical Probe Sequence
tcgtatcgctgtacctcgtttgcg

SEQ ID NO: 238 - DNA, 24 bp, Artificial Sequence
  Description of Artificial Sequence:  Hypothetical Probe Sequence
tcgtcctaacggatcgttgaagcc

SEQ ID NO: 239 - DNA, 24 bp, Artificial Sequence
  Description of Artificial Sequence:  Hypothetical Probe Sequence
tcgtgatgatcggtgcacggtccc

SEQ ID NO: 240 - DNA, 24 bp, Artificial Sequence
  Description of Artificial Sequence:  Hypothetical Probe Sequence
tcgttcccctcaagtggaccacct

SEQ ID NO: 241 - DNA, 24 bp, Artificial Sequence
  Description of Artificial Sequence:  Hypothetical Probe Sequence
tcgttcccagtggatgggacccat

SEQ ID NO: 242 - DNA, 24 bp, Artificial Sequence
  Description of Artificial Sequence:  Hypothetical Probe Sequence
tcgttcccgatgaggaacggtgat

SEQ ID NO: 243 - DNA, 24 bp, Artificial Sequence
  Description of Artificial Sequence:  Hypothetical Probe Sequence
tcgttccccagccgttgtctcagc

SEQ ID NO: 244 - DNA, 24 bp, Artificial Sequence
  Description of Artificial Sequence:  Hypothetical Probe Sequence
tcgttgcggcaatgatccatcacg

SEQ ID NO: 245 - DNA, 24 bp, Artificial Sequence
  Description of Artificial Sequence:  Hypothetical Probe Sequence
tcgttgcgtcccctcagtgcctca

SEQ ID NO: 246 - DNA, 24 bp, Artificial Sequence
  Description of Artificial Sequence:  Hypothetical Probe Sequence
tcgttgcgcacgtgatcgttccat

SEQ ID NO: 247 - DNA, 24 bp, Artificial Sequence
  Description of Artificial Sequence:  Hypothetical Probe Sequence
tcgttgcggtgctgatggacatcg

SEQ ID NO: 248 - DNA, 24 bp, Artificial Sequence
  Description of Artificial Sequence:  Hypothetical Probe Sequence
tcgtgaccgaccgatgtcccagga

SEQ ID NO: 249 - DNA, 24 bp, Artificial Sequence
  Description of Artificial Sequence:  Hypothetical Probe Sequence
tcgtgtgcgatggagtgtgcccat

SEQ ID NO: 250 - DNA, 24 bp, Artificial Sequence
  Description of Artificial Sequence:  Hypothetical Probe Sequence
tcgtgtgcgacctgatatcggtgc

SEQ ID NO: 251 - DNA, 24 bp, Artificial Sequence
  Description of Artificial Sequence:  Hypothetical Probe Sequence
tcgtggacaggagatggcttgtgc

SEQ ID NO: 252 - DNA, 24 bp, Artificial Sequence
  Description of Artificial Sequence:  Hypothetical Probe Sequence
tcgtacggtgatcacgcagcacgg

SEQ ID NO: 253 - DNA, 24 bp, Artificial Sequence
  Description of Artificial Sequence:  Hypothetical Probe Sequence
tcgtacggggacaaagcgttgtct

SEQ ID NO: 254 - DNA, 24 bp, Artificial Sequence
  Description of Artificial Sequence:  Hypothetical Probe Sequence
cttgtgtcgtgcacggctgttgcg

SEQ ID NO: 255 - DNA, 24 bp, Artificial Sequence
  Description of Artificial Sequence:  Hypothetical Probe Sequence
cttgtcgtccatagcctcccggta

SEQ ID NO: 256 - DNA, 24 bp, Artificial Sequence
  Description of Artificial Sequence:  Hypothetical Probe Sequence
cttgccatgtcttgcggcttacgg

SEQ ID NO: 257 - DNA, 24 bp, Artificial Sequence
  Description of Artificial Sequence:  Hypothetical Probe Sequence
cttggctttcgtccatcttggtgc

SEQ ID NO: 258 - DNA, 24 bp, Artificial Sequence
  Description of Artificial Sequence:  Hypothetical Probe Sequence
cttgaggagctttgcgccatgcaa

SEQ ID NO: 259 - DNA, 24 bp, Artificial Sequence
  Description of Artificial Sequence:  Hypothetical Probe Sequence
cttgtcccaaaggcttgcaatccc

SEQ ID NO: 260 - DNA, 24 bp, Artificial Sequence
  Description of Artificial Sequence:  Hypothetical Probe Sequence
cttgtgcgcttgaaagcgaatctg

SEQ ID NO: 261 - DNA, 24 bp, Artificial Sequence
  Description of Artificial Sequence:  Hypothetical Probe Sequence
cttgtgcggagttgtcagccggta

SEQ ID NO: 262 - DNA, 24 bp, Artificial Sequence
  Description of Artificial Sequence:  Hypothetical Probe Sequence
cttgcacgtgtctcccagccccat

SEQ ID NO: 263 - DNA, 24 bp, Artificial Sequence
  Description of Artificial Sequence:  Hypothetical Probe Sequence
cttgcacgctgtcgaattagcagc

SEQ ID NO: 264 - DNA, 24 bp, Artificial Sequence
  Description of Artificial Sequence:  Hypothetical Probe Sequence
cttgggacacctctgtgtgcgcaa

SEQ ID NO: 265 - DNA, 24 bp, Artificial Sequence
  Description of Artificial Sequence:  Hypothetical Probe Sequence
cttgacggagtgacggcgaacgaa

SEQ ID NO: 266 - DNA, 24 bp, Artificial Sequence
  Description of Artificial Sequence:  Hypothetical Probe Sequence
cttgagccaatctgcggcaaccat

SEQ ID NO: 267 - DNA, 24 bp, Artificial Sequence
  Description of Artificial Sequence:  Hypothetical Probe Sequence
cttgagccgtctcctaatcgagcc

SEQ ID NO: 268 - DNA, 24 bp, Artificial Sequence
  Description of Artificial Sequence:  Hypothetical Probe Sequence
cttgagccagtgaaagtgcgcacg

SEQ ID NO: 269 - DNA, 24 bp, Artificial Sequence
  Description of Artificial Sequence:  Hypothetical Probe Sequence
cgtttctgtcgttcccgtgcggac

SEQ ID NO: 270 - DNA, 24 bp, Artificial Sequence
  Description of Artificial Sequence:  Hypothetical Probe Sequence
cgtttcgtgtctggaccacgtccc

SEQ ID NO: 271 - DNA, 24 bp, Artificial Sequence
  Description of Artificial Sequence:  Hypothetical Probe Sequence
cgttgctttgcggatgtcgtacgg

SEQ ID NO: 272 - DNA, 24 bp, Artificial Sequence
  Description of Artificial Sequence:  Hypothetical Probe Sequence
cgttggtaaaagtcgttcccagcc

SEQ ID NO: 273 - DNA, 24 bp, Artificial Sequence
  Description of Artificial Sequence:  Hypothetical Probe Sequence
cgttggtacacgccatcagccacg

SEQ ID NO: 274 - DNA, 24 bp, Artificial Sequence
  Description of Artificial Sequence:  Hypothetical Probe Sequence
cgttcctacacgcttgtgcggacc

SEQ ID NO: 275 - DNA, 24 bp, Artificial Sequence
  Description of Artificial Sequence:  Hypothetical Probe Sequence
cgtttccccgttggtaaatcccat

SEQ ID NO: 276 - DNA, 24 bp, Artificial Sequence
  Description of Artificial Sequence:  Hypothetical Probe Sequence
cgtttcccccattgtcgagtcgtt

SEQ ID NO: 277 - DNA, 24 bp, Artificial Sequence
  Description of Artificial Sequence:  Hypothetical Probe Sequence
cgtttcccgtgctgcgagtgtgat

SEQ ID NO: 278 - DNA, 24 bp, Artificial Sequence
  Description of Artificial Sequence:  Hypothetical Probe Sequence
cgtttgcgttagagtgcacgatcg

SEQ ID NO: 279 - DNA, 24 bp, Artificial Sequence
  Description of Artificial Sequence:  Hypothetical Probe Sequence
cgttcacgcacgtgtcaaagtccc

SEQ ID NO: 280 - DNA, 24 bp, Artificial Sequence
  Description of Artificial Sequence:  Hypothetical Probe Sequence
cgttgacccttggcaatacaacgg

SEQ ID NO: 281 - DNA, 24 bp, Artificial Sequence
  Description of Artificial Sequence:  Hypothetical Probe Sequence
cgttgtgcacggcttgtgtccgtt

SEQ ID NO: 282 - DNA, 24 bp, Artificial Sequence
  Description of Artificial Sequence:  Hypothetical Probe Sequence
ctcaaaagtgcgtcgttgattgcg

SEQ ID NO: 283 - DNA, 24 bp, Artificial Sequence
  Description of Artificial Sequence:  Hypothetical Probe Sequence
ctcaaaaggacctctgcagccgtt

SEQ ID NO: 284 - DNA, 24 bp, Artificial Sequence
  Description of Artificial Sequence:  Hypothetical Probe Sequence
ctcatcgtgcaacgttgaccacgg

SEQ ID NO: 285 - DNA, 24 bp, Artificial Sequence
  Description of Artificial Sequence:  Hypothetical Probe Sequence
ctcatcccggacaggagtgcacct

SEQ ID NO: 286 - DNA, 24 bp, Artificial Sequence
  Description of Artificial Sequence:  Hypothetical Probe Sequence
ctgtgatgcagccgaaatcgcagc

SEQ ID NO: 287 - DNA, 24 bp, Artificial Sequence
  Description of Artificial Sequence:  Hypothetical Probe Sequence
ctgttccctgcgttgaggtatgcg

SEQ ID NO: 288 - DNA, 24 bp, Artificial Sequence
  Description of Artificial Sequence:  Hypothetical Probe Sequence
ctgttgcgacgggcaaccattgat

SEQ ID NO: 289 - DNA, 24 bp, Artificial Sequence
  Description of Artificial Sequence:  Hypothetical Probe Sequence
ctgtgaccccatcttgatcggcaa

SEQ ID NO: 290 - DNA, 24 bp, Artificial Sequence
  Description of Artificial Sequence:  Hypothetical Probe Sequence
ctgtgtgcatcggaccaccttgcg

SEQ ID NO: 291 - DNA, 24 bp, Artificial Sequence
  Description of Artificial Sequence:  Hypothetical Probe Sequence
ctgtgtgccacgatacggaccgtt

SEQ ID NO: 292 - DNA, 24 bp, Artificial Sequence
  Description of Artificial Sequence:  Hypothetical Probe Sequence
ctgtggaccctaccattcccagcc

SEQ ID NO: 293 - DNA, 24 bp, Artificial Sequence
  Description of Artificial Sequence:  Hypothetical Probe Sequence
ctgtggaccacggtgcgatgctca

SEQ ID NO: 294 - DNA, 24 bp, Artificial Sequence
  Description of Artificial Sequence:  Hypothetical Probe Sequence
ccattgtccagcttgaacggctgt

SEQ ID NO: 295 - DNA, 24 bp, Artificial Sequence
  Description of Artificial Sequence:  Hypothetical Probe Sequence
ccattcgttcgtcgttgcttatcg

SEQ ID NO: 296 - DNA, 24 bp, Artificial Sequence
  Description of Artificial Sequence:  Hypothetical Probe Sequence
ccattcgtgagtcacgtgcgcagc

SEQ ID NO: 297 - DNA, 24 bp, Artificial Sequence
  Description of Artificial Sequence:  Hypothetical Probe Sequence
ccattgcgatacggacatcggcaa

SEQ ID NO: 298 - DNA, 24 bp, Artificial Sequence
  Description of Artificial Sequence:  Hypothetical Probe Sequence
ccattgcgcgaagatgctcacagc

SEQ ID NO: 299 - DNA, 24 bp, Artificial Sequence
  Description of Artificial Sequence:  Hypothetical Probe Sequence Abramites sp.
ccatcacgaatcgcttgtgcgctt

SEQ ID NO: 300 - DNA, 24 bp, Artificial Sequence
  Description of Artificial Sequence:  Hypothetical Probe Sequence
ccatcagcagccaaaggtcttccc

SEQ ID NO: 301 - DNA, 24 bp, Artificial Sequence
  Description of Artificial Sequence:  Hypothetical Probe Sequence
cgaattgatcccaatccgaatccc

SEQ ID NO: 302 - DNA, 24 bp, Artificial Sequence
  Description of Artificial Sequence:  Hypothetical Probe Sequence
cgaattagcacgggtacagcacgg

SEQ ID NO: 303 - DNA, 24 bp, Artificial Sequence
  Description of Artificial Sequence:  Hypothetical Probe Sequence
cgaatgtctcccgtgcccatagcc

SEQ ID NO: 304 - DNA, 24 bp, Artificial Sequence
  Description of Artificial Sequence:  Hypothetical Probe Sequence
cgaatcgtaccttgcggtctcgtt

SEQ ID NO: 305 - DNA, 24 bp, Artificial Sequence
  Description of Artificial Sequence:  Hypothetical Probe Sequence
cgaatcgtcctaaggatcccagcc

SEQ ID NO: 306 - DNA, 24 bp, Artificial Sequence
  Description of Artificial Sequence:  Hypothetical Probe Sequence
cgaactcacgttcacgcgtttgcg

SEQ ID NO: 307 - DNA, 24 bp, Artificial Sequence
  Description of Artificial Sequence:  Hypothetical Probe Sequence
cgaaccattgatcttgcacgcgtt

SEQ ID NO: 308 - DNA, 24 bp, Artificial Sequence
  Description of Artificial Sequence:  Hypothetical Probe Sequence
cgaaccatcagcgaccgtctagcc

SEQ ID NO: 309 - DNA, 24 bp, Artificial Sequence
  Description of Artificial Sequence:  Hypothetical Probe Sequence
cgaagcttctgttccccgtttccc

SEQ ID NO: 310 - DNA, 24 bp, Artificial Sequence
  Description of Artificial Sequence:  Hypothetical Probe Sequence
cgaaatcgaccttctggatgcagc

SEQ ID NO: 311 - DNA, 24 bp, Artificial Sequence
  Description of Artificial Sequence:  Hypothetical Probe Sequence
cgaaatcgacgggagttgtctgcg

SEQ ID NO: 312 - DNA, 24 bp, Artificial Sequence
  Description of Artificial Sequence:  Hypothetical Probe Sequence
cgaatgcggcttcgttaaagcttg

SEQ ID NO: 313 - DNA, 24 bp, Artificial Sequence
  Description of Artificial Sequence:  Hypothetical Probe Sequence
cgaatgcgggtaatactgcgtcgt

SEQ ID NO: 314 - DNA, 24 bp, Artificial Sequence
  Description of Artificial Sequence:  Hypothetical Probe Sequence
cgaaggacgtgcacctcctacgaa

SEQ ID NO: 315 - DNA, 24 bp, Artificial Sequence
  Description of Artificial Sequence:  Hypothetical Probe Sequence
cgaaacggttagctgtcagcacgg

SEQ ID NO: 316 - DNA, 24 bp, Artificial Sequence
  Description of Artificial Sequence:  Hypothetical Probe Sequence
cgaaacggagccgtctcgttgctt

SEQ ID NO: 317 - DNA, 24 bp, Artificial Sequence
  Description of Artificial Sequence:  Hypothetical Probe Sequence
cgaaagccgcaaagtgaatcgtgc

SEQ ID NO: 318 - DNA, 24 bp, Artificial Sequence
  Description of Artificial Sequence:  Hypothetical Probe Sequence
gctttcgtcgaagtctcacgccat

SEQ ID NO: 319 - DNA, 24 bp, Artificial Sequence
  Description of Artificial Sequence:  Hypothetical Probe Sequence
gcttcttgacggagccttgacacg

SEQ ID NO: 320 - DNA, 24 bp, Artificial Sequence
  Description of Artificial Sequence:  Hypothetical Probe Sequence
gtctcttgcgtttgcgcctagcaa

SEQ ID NO: 321 - DNA, 24 bp, Artificial Sequence
  Description of Artificial Sequence:  Hypothetical Probe Sequence
gtctgtgcggaccctaacggctca

SEQ ID NO: 322 - DNA, 24 bp, Artificial Sequence
  Description of Artificial Sequence:  Hypothetical Probe Sequence
gagtgacccagctgtcggaccacg

SEQ ID NO: 323 - DNA, 24 bp, Artificial Sequence
  Description of Artificial Sequence:  Hypothetical Probe Sequence
gagtgtgccttgtgcgcgaacgtt

SEQ ID NO: 324 - DNA, 24 bp, Artificial Sequence
  Description of Artificial Sequence:  Hypothetical Probe Sequence
gcaatacatcccggacacgggcaa

SEQ ID NO: 325 - DNA, 24 bp, Artificial Sequence
  Description of Artificial Sequence:  Hypothetical Probe Sequence
gcaatcgtgatggtcttgcgtccc

SEQ ID NO: 326 - DNA, 24 bp, Artificial Sequence
  Description of Artificial Sequence:  Hypothetical Probe Sequence
gcaacgttggaccttgctgttccc

SEQ ID NO: 327 - DNA, 24 bp, Artificial Sequence
  Description of Artificial Sequence:  Hypothetical Probe Sequence
gcaactcaacctccattcgttccc

SEQ ID NO: 328 - DNA, 24 bp, Artificial Sequence
  Description of Artificial Sequence:  Hypothetical Probe Sequence
gcaactcatgcgcacgtctggtgc

SEQ ID NO: 329 - DNA, 24 bp, Artificial Sequence
  Description of Artificial Sequence:  Hypothetical Probe Sequence
gcaagcaattagcacgccatcgaa

SEQ ID NO: 330 - DNA, 24 bp, Artificial Sequence
  Description of Artificial Sequence:  Hypothetical Probe Sequence
gcaaagtgtcgtttgatgcgggac

SEQ ID NO: 331 - DNA, 24 bp, Artificial Sequence
  Description of Artificial Sequence:  Hypothetical Probe Sequence
gcaaacctctcatgcgtgattgcg

SEQ ID NO: 332 - DNA, 24 bp, Artificial Sequence
  Description of Artificial Sequence:  Hypothetical Probe Sequence
gcaaatcgatcgcgaacgaaggac

SEQ ID NO: 333 - DNA, 24 bp, Artificial Sequence
  Description of Artificial Sequence:  Hypothetical Probe Sequence
gcaaatcgagccaatcggtaacct

SEQ ID NO: 334 - DNA, 24 bp, Artificial Sequence
  Description of Artificial Sequence:  Hypothetical Probe Sequence
gcaaggacgtcttgtccgttcacg

SEQ ID NO: 335 - DNA, 24 bp, Artificial Sequence
  Description of Artificial Sequence:  Hypothetical Probe Sequence
gcaaagcccgttcagcaccttctg

SEQ ID NO: 336 - DNA, 24 bp, Artificial Sequence
  Description of Artificial Sequence:  Hypothetical Probe Sequence
agtgcgaacttgtctgggactgcg

SEQ ID NO: 337 - DNA, 24 bp, Artificial Sequence
  Description of Artificial Sequence:  Hypothetical Probe Sequence
acctttagcgtttgtctgcgtccc

SEQ ID NO: 338 - DNA, 24 bp, Artificial Sequence
  Description of Artificial Sequence:  Hypothetical Probe Sequence
acctcgaaccattacatgcggctt

SEQ ID NO: 339 - DNA, 24 bp, Artificial Sequence
  Description of Artificial Sequence:  Hypothetical Probe Sequence
acctgcttcgaagtgcctgtcagc

SEQ ID NO: 340 - DNA, 24 bp, Artificial Sequence
  Description of Artificial Sequence:  Hypothetical Probe Sequence
acctgtgcttgacacgatcgcacg

SEQ ID NO: 341 - DNA, 24 bp, Artificial Sequence
  Description of Artificial Sequence:  Hypothetical Probe Sequence
atcgaaagctcagtgcgcaagctt

SEQ ID NO: 342 - DNA, 24 bp, Artificial Sequence
  Description of Artificial Sequence:  Hypothetical Probe Sequence
atcgcttgtgtctgcgagcctctg

SEQ ID NO: 343 - DNA, 24 bp, Artificial Sequence
  Description of Artificial Sequence:  Hypothetical Probe Sequence
atcgcttgcgaaaaagctgtccat

SEQ ID NO: 344 - DNA, 24 bp, Artificial Sequence
  Description of Artificial Sequence:  Hypothetical Probe Sequence
atcgcgttgagtaggaggacggac

SEQ ID NO: 345 - DNA, 24 bp, Artificial Sequence
  Description of Artificial Sequence:  Hypothetical Probe Sequence
atcgctcatctggtgcggacgcaa

SEQ ID NO: 346 - DNA, 24 bp, Artificial Sequence
  Description of Artificial Sequence:  Hypothetical Probe Sequence
atcgctgtgatgcgttacggcacg

SEQ ID NO: 347 - DNA, 24 bp, Artificial Sequence
  Description of Artificial Sequence:  Hypothetical Probe Sequence
atcgccataatccagccagcacct

SEQ ID NO: 348 - DNA, 24 bp, Artificial Sequence
  Description of Artificial Sequence:  Hypothetical Probe Sequence
atcggcttcagcaaagtctgccat

SEQ ID NO: 349 - DNA, 24 bp, Artificial Sequence
  Description of Artificial Sequence:  Hypothetical Probe Sequence
atcggagtggaccacgcttgggac

SEQ ID NO: 350 - DNA, 24 bp, Artificial Sequence
  Description of Artificial Sequence:  Hypothetical Probe Sequence
atcgagtgctcaaggaatcggcaa

SEQ ID NO: 351 - DNA, 24 bp, Artificial Sequence
  Description of Artificial Sequence:  Hypothetical Probe Sequence
atcgcctagatgtgcgaggatccc

SEQ ID NO: 352 - DNA, 24 bp, Artificial Sequence
  Description of Artificial Sequence:  Hypothetical Probe Sequence
atcgtcccagccctgtgatggtgc

SEQ ID NO: 353 - DNA, 24 bp, Artificial Sequence
  Description of Artificial Sequence:  Hypothetical Probe Sequence
atcgggactacaatcgcagcgatg

SEQ ID NO: 354 - DNA, 24 bp, Artificial Sequence
  Description of Artificial Sequence:  Hypothetical Probe Sequence
atcgacggtgtccgaaccatgcaa

SEQ ID NO: 355 - DNA, 24 bp, Artificial Sequence
  Description of Artificial Sequence:  Hypothetical Probe Sequence
atcgagccgagtttgacgaacacg

SEQ ID NO: 356 - DNA, 24 bp, Artificial Sequence
  Description of Artificial Sequence:  Hypothetical Probe Sequence
aggatcgtgaccaggacagcacgg

SEQ ID NO: 357 - DNA, 24 bp, Artificial Sequence
  Description of Artificial Sequence:  Hypothetical Probe Sequence
aggagcttgatgtcccgcaatccc

SEQ ID NO: 358 - DNA, 24 bp, Artificial Sequence
  Description of Artificial Sequence:  Hypothetical Probe Sequence
aggaagtgggtagcaatccccacg

SEQ ID NO: 359 - DNA, 24 bp, Artificial Sequence
  Description of Artificial Sequence:  Hypothetical Probe Sequence
aggagtgcgtgccttggaccacct

SEQ ID NO: 360 - DNA, 24 bp, Artificial Sequence
  Description of Artificial Sequence:  Hypothetical Probe Sequence
cctacagcaggagaccgaccgcaa

SEQ ID NO: 361 - DNA, 24 bp, Artificial Sequence
  Description of Artificial Sequence:  Hypothetical Probe Sequence
gatgccatgcaacagcaggacagc

SEQ ID NO: 362 - DNA, 24 bp, Artificial Sequence
  Description of Artificial Sequence:  Hypothetical Probe Sequence
gatgggaccttgcacgtcgtcgaa

SEQ ID NO: 363 - DNA, 24 bp, Artificial Sequence
  Description of Artificial Sequence:  Hypothetical Probe Sequence
tccctgattccccgaacgttgatg

SEQ ID NO: 364 - DNA, 24 bp, Artificial Sequence
  Description of Artificial Sequence:  Hypothetical Probe Sequence
tccctacatgcgttaggacccacg

SEQ ID NO: 365 - DNA, 24 bp, Artificial Sequence
  Description of Artificial Sequence:  Hypothetical Probe Sequence
tccctctggatgcacgaatcgtgc

SEQ ID NO: 366 - DNA, 24 bp, Artificial Sequence
  Description of Artificial Sequence:  Hypothetical Probe Sequence
tccccttgtgcgatcgctgtctca

SEQ ID NO: 367 - DNA, 24 bp, Artificial Sequence
  Description of Artificial Sequence:  Hypothetical Probe Sequence
tccccgttacggagtggtctgcaa

SEQ ID NO: 368 - DNA, 24 bp, Artificial Sequence
  Description of Artificial Sequence:  Hypothetical Probe Sequence
tcccctcatacaacggccatgcaa

SEQ ID NO: 369 - DNA, 24 bp, Artificial Sequence
  Description of Artificial Sequence:  Hypothetical Probe Sequence
tcccctcactgtcctatcccagcc

SEQ ID NO: 370 - DNA, 24 bp, Artificial Sequence
  Description of Artificial Sequence:  Hypothetical Probe Sequence
tcccctcacctaatacacggcgtt

SEQ ID NO: 371 - DNA, 24 bp, Artificial Sequence
  Description of Artificial Sequence:  Hypothetical Probe Sequence
tcccccatatacgcaacagcagcc

SEQ ID NO: 372 - DNA, 24 bp, Artificial Sequence
  Description of Artificial Sequence:  Hypothetical Probe Sequence
tccccgaatgatgcttcgttttga

SEQ ID NO: 373 - DNA, 24 bp, Artificial Sequence
  Description of Artificial Sequence:  Hypothetical Probe Sequence
tcccggtagaccccatgaccacct

SEQ ID NO: 374 - DNA, 24 bp, Artificial Sequence
  Description of Artificial Sequence:  Hypothetical Probe Sequence
tcccgtctctgtgatgagcccgtt

SEQ ID NO: 375 - DNA, 24 bp, Artificial Sequence
  Description of Artificial Sequence:  Hypothetical Probe Sequence
tcccgagttgtcgaccccattgcg

SEQ ID NO: 376 - DNA, 24 bp, Artificial Sequence
  Description of Artificial Sequence:  Hypothetical Probe Sequence
tcccgcaaaggagagtgatgcgaa

SEQ ID NO: 377 - DNA, 24 bp, Artificial Sequence
  Description of Artificial Sequence:  Hypothetical Probe Sequence
tcccatcgtgtctgatagccagcc

SEQ ID NO: 378 - DNA, 24 bp, Artificial Sequence
  Description of Artificial Sequence:  Hypothetical Probe Sequence
tcccaggactgtttgacacggcaa

SEQ ID NO: 379 - DNA, 24 bp, Artificial Sequence
  Description of Artificial Sequence:  Hypothetical Probe Sequence
tccccacgtacaggacaatcagcc

SEQ ID NO: 380 - DNA, 24 bp, Artificial Sequence
  Description of Artificial Sequence:  Hypothetical Probe Sequence
tccccacggcttcttgacctcgaa

SEQ ID NO: 381 - DNA, 24 bp, Artificial Sequence
  Description of Artificial Sequence:  Hypothetical Probe Sequence
tcccgaccgcttggtaccatgtgc

SEQ ID NO: 382 - DNA, 24 bp, Artificial Sequence
  Description of Artificial Sequence:  Hypothetical Probe Sequence
tcccggactgatcgttgatgcttg

SEQ ID NO: 383 - DNA, 24 bp, Artificial Sequence
  Description of Artificial Sequence:  Hypothetical Probe Sequence
tcccggacttagcgaacttgtccc

SEQ ID NO: 384 - DNA, 24 bp, Artificial Sequence
  Description of Artificial Sequence:  Hypothetical Probe Sequence
tcccacggcgaatgtccctacgtt

SEQ ID NO: 385 - DNA, 24 bp, Artificial Sequence
  Description of Artificial Sequence:  Hypothetical Probe Sequence
tcccacggtcccgagtggtaacgg

SEQ ID NO: 386 - DNA, 24 bp, Artificial Sequence
  Description of Artificial Sequence:  Hypothetical Probe Sequence
tcccagcctacatgtcacgggatg

SEQ ID NO: 387 - DNA, 24 bp, Artificial Sequence
  Description of Artificial Sequence:  Hypothetical Probe Sequence
tcccagccgatggatgatcgggta

SEQ ID NO: 388 - DNA, 24 bp, Artificial Sequence
  Description of Artificial Sequence:  Hypothetical Probe Sequence
tgcgttgacttgagtgacggcacg

SEQ ID NO: 389 - DNA, 24 bp, Artificial Sequence
  Description of Artificial Sequence:  Hypothetical Probe Sequence
tgcgttgaacctacggggactgat

SEQ ID NO: 390 - DNA, 24 bp, Artificial Sequence
  Description of Artificial Sequence:  Hypothetical Probe Sequence
tgcgtgatcgttctcacagccgaa

SEQ ID NO: 391 - DNA, 24 bp, Artificial Sequence
  Description of Artificial Sequence:  Hypothetical Probe Sequence
tgcgtgatgtctcacgcgaacagc

SEQ ID NO: 392 - DNA, 24 bp, Artificial Sequence
  Description of Artificial Sequence:  Hypothetical Probe Sequence
tgcgtgatgatgtgtccgaagtgc

SEQ ID NO: 393 - DNA, 24 bp, Artificial Sequence
  Description of Artificial Sequence:  Hypothetical Probe Sequence
tgcgaatcctgttgtccagcgtct

SEQ ID NO: 394 - DNA, 24 bp, Artificial Sequence
  Description of Artificial Sequence:  Hypothetical Probe Sequence
tgcgatacgtctgagtagcccgaa

SEQ ID NO: 395 - DNA, 24 bp, Artificial Sequence
  Description of Artificial Sequence:  Hypothetical Probe Sequence
tgcgaaagtgatagccagtggcaa

SEQ ID NO: 396 - DNA, 24 bp, Artificial Sequence
  Description of Artificial Sequence:  Hypothetical Probe Sequence
tgcgaaaggtgcaggagagttccc

SEQ ID NO: 397 - DNA, 24 bp, Artificial Sequence
  Description of Artificial Sequence:  Hypothetical Probe Sequence
tgcgtacatcgtacggctcacacg

SEQ ID NO: 398 - DNA, 24 bp, Artificial Sequence
  Description of Artificial Sequence:  Hypothetical Probe Sequence
tgcgtacaggactgcgaaagtgcg

SEQ ID NO: 399 - DNA, 24 bp, Artificial Sequence
  Description of Artificial Sequence:  Hypothetical Probe Sequence
tgcgtcgtggtacctatgtcgctt

SEQ ID NO: 400 - DNA, 24 bp, Artificial Sequence
  Description of Artificial Sequence:  Hypothetical Probe Sequence
tgcgcgttcctaaaagccatctgt

SEQ ID NO: 401 - DNA, 24 bp, Artificial Sequence
  Description of Artificial Sequence:  Hypothetical Probe Sequence
tgcgctcactcagaccaaaggcaa

SEQ ID NO: 402 - DNA, 24 bp, Artificial Sequence
  Description of Artificial Sequence:  Hypothetical Probe Sequence
tgcgctcacgaaccatcgttttga

SEQ ID NO: 403 - DNA, 24 bp, Artificial Sequence
  Description of Artificial Sequence:  Hypothetical Probe Sequence
tgcgctcagagtttagcacgacgg

SEQ ID NO: 404 - DNA, 24 bp, Artificial Sequence
  Description of Artificial Sequence:  Hypothetical Probe Sequence
tgcgctcaagccaggagcttggta

SEQ ID NO: 405 - DNA, 24 bp, Artificial Sequence
  Description of Artificial Sequence:  Hypothetical Probe Sequence
tgcgctgtttgagtgctcgtatcg

SEQ ID NO: 406 - DNA, 24 bp, Artificial Sequence
  Description of Artificial Sequence:  Hypothetical Probe Sequence
tgcgctgtcgttaggatctgtccc

SEQ ID NO: 407 - DNA, 24 bp, Artificial Sequence
  Description of Artificial Sequence:  Hypothetical Probe Sequence
tgcgctgtgagtctgtcgaaagcc

SEQ ID NO: 408 - DNA, 24 bp, Artificial Sequence
  Description of Artificial Sequence:  Hypothetical Probe Sequence
tgcgccatctgtagcctgatcagc

SEQ ID NO: 409 - DNA, 24 bp, Artificial Sequence
  Description of Artificial Sequence:  Hypothetical Probe Sequence
tgcgcgaagaccacctctgtacgg

SEQ ID NO: 410 - DNA, 24 bp, Artificial Sequence
  Description of Artificial Sequence:  Hypothetical Probe Sequence
tgcgcgaaggacgcaattagtccc

SEQ ID NO: 411 - DNA, 24 bp, Artificial Sequence
  Description of Artificial Sequence:  Hypothetical Probe Sequence
tgcggcttaatcctcagcaacgaa

SEQ ID NO: 412 - DNA, 24 bp, Artificial Sequence
  Description of Artificial Sequence:  Hypothetical Probe Sequence
tgcgggtatctgctgtgacccagc

SEQ ID NO: 413 - DNA, 24 bp, Artificial Sequence
  Description of Artificial Sequence:  Hypothetical Probe Sequence
tgcgggtagatgcctagaccgacc

SEQ ID NO: 414 - DNA, 24 bp, Artificial Sequence
  Description of Artificial Sequence:  Hypothetical Probe Sequence
tgcggagtgagtgcttcagcacgg

SEQ ID NO: 415 - DNA, 24 bp, Artificial Sequence
  Description of Artificial Sequence:  Hypothetical Probe Sequence
tgcggagttgcgagtgcgaactgt

SEQ ID NO: 416 - DNA, 24 bp, Artificial Sequence
  Description of Artificial Sequence:  Hypothetical Probe Sequence
tgcggagtcacgtccctacaagcc

SEQ ID NO: 417 - DNA, 24 bp, Artificial Sequence
  Description of Artificial Sequence:  Hypothetical Probe Sequence
tgcgagtgaatcggacggacgtgc

SEQ ID NO: 418 - DNA, 24 bp, Artificial Sequence
  Description of Artificial Sequence:  Hypothetical Probe Sequence
tgcgaccttctgtacagtgctgcg

SEQ ID NO: 419 - DNA, 24 bp, Artificial Sequence
  Description of Artificial Sequence:  Hypothetical Probe Sequence
tgcgatcggtgcgagtttgaagcc

SEQ ID NO: 420 - DNA, 24 bp, Artificial Sequence
  Description of Artificial Sequence:  Hypothetical Probe Sequence
tgcgcctattagagccgtgcctgt

SEQ ID NO: 421 - DNA, 24 bp, Artificial Sequence
  Description of Artificial Sequence:  Hypothetical Probe Sequence
tgcgcctaaatcctgtcttgcgaa

SEQ ID NO: 422 - DNA, 24 bp, Artificial Sequence
  Description of Artificial Sequence:  Hypothetical Probe Sequence
tgcgcctaagtgcgaaacctttga

SEQ ID NO: 423 - DNA, 24 bp, Artificial Sequence
  Description of Artificial Sequence:  Hypothetical Probe Sequence
tgcggatgaggattgatcgttcgt

SEQ ID NO: 424 - DNA, 24 bp, Artificial Sequence
  Description of Artificial Sequence:  Hypothetical Probe Sequence
tgcgtcccatactgatgtgccacg

SEQ ID NO: 425 - DNA, 24 bp, Artificial Sequence
  Description of Artificial Sequence:  Hypothetical Probe Sequence
tgcgtcccaggagtgcttagagcc

SEQ ID NO: 426 - DNA, 24 bp, Artificial Sequence
  Description of Artificial Sequence:  Hypothetical Probe Sequence
tgcggaccttagctcaccattccc

SEQ ID NO: 427 - DNA, 24 bp, Artificial Sequence
  Description of Artificial Sequence:  Hypothetical Probe Sequence
tgcggtgcagtgggtatctggctt

SEQ ID NO: 428 - DNA, 24 bp, Artificial Sequence
  Description of Artificial Sequence:  Hypothetical Probe Sequence
tgcgggacggtaacggtgatccta

SEQ ID NO: 429 - DNA, 24 bp, Artificial Sequence
  Description of Artificial Sequence:  Hypothetical Probe Sequence
tgcgacggaaagggtatgtcacgg

SEQ ID NO: 430 - DNA, 24 bp, Artificial Sequence
  Description of Artificial Sequence:  Hypothetical Probe Sequence
tgcgagccctgtttaggatgtccc

SEQ ID NO: 431 - DNA, 24 bp, Artificial Sequence
  Description of Artificial Sequence:  Hypothetical Probe Sequence
cacggagtgatgagcccttgcgaa

SEQ ID NO: 432 - DNA, 24 bp, Artificial Sequence
  Description of Artificial Sequence:  Hypothetical Probe Sequence
cacggcaaatactctggagttgcg

SEQ ID NO: 433 - DNA, 24 bp, Artificial Sequence
  Description of Artificial Sequence:  Hypothetical Probe Sequence
cacgatcggcaaatcgtcgtcttg

SEQ ID NO: 434 - DNA, 24 bp, Artificial Sequence
  Description of Artificial Sequence:  Hypothetical Probe Sequence
cacgaggaagtggcaacacgcagc

SEQ ID NO: 435 - DNA, 24 bp, Artificial Sequence
  Description of Artificial Sequence:  Hypothetical Probe Sequence
cacgaggagaccctcacgaatgcg

SEQ ID NO: 436 - DNA, 24 bp, Artificial Sequence
  Description of Artificial Sequence:  Hypothetical Probe Sequence
cacgcagcgcttgctttctgagga

SEQ ID NO: 437 - DNA, 24 bp, Artificial Sequence
  Description of Artificial Sequence:  Hypothetical Probe Sequence
cacgagccggtacgttggtaggac

SEQ ID NO: 438 - DNA, 24 bp, Artificial Sequence
  Description of Artificial Sequence:  Hypothetical Probe Sequence
cagcatacgtgctcccaggagcaa

SEQ ID NO: 439 - DNA, 24 bp, Artificial Sequence
  Description of Artificial Sequence:  Hypothetical Probe Sequence
cagcgagtccatggacagtgcgaa

SEQ ID NO: 440 - DNA, 24 bp, Artificial Sequence
  Description of Artificial Sequence:  Hypothetical Probe Sequence
cagcgagtggtaatcgtcccctca

SEQ ID NO: 441 - DNA, 24 bp, Artificial Sequence
  Description of Artificial Sequence:  Hypothetical Probe Sequence
cagcagtgatcgcttgagcctgcg

SEQ ID NO: 442 - DNA, 24 bp, Artificial Sequence
  Description of Artificial Sequence:  Hypothetical Probe Sequence
cagccagcaaagcctaaggagcaa

SEQ ID NO: 443 - DNA, 24 bp, Artificial Sequence
  Description of Artificial Sequence:  Hypothetical Probe Sequence
cagccagctacaagccaggacgaa

SEQ ID NO: 444 - DNA, 24 bp, Artificial Sequence
  Description of Artificial Sequence:  Hypothetical Probe Sequence
gaccgcaaacctgtctatcgcgaa

SEQ ID NO: 445 - DNA, 24 bp, Artificial Sequence
  Description of Artificial Sequence:  Hypothetical Probe Sequence
gaccgatgcgaatacagacccgaa

SEQ ID NO: 446 - DNA, 24 bp, Artificial Sequence
  Description of Artificial Sequence:  Hypothetical Probe Sequence
gaccgatggagtgatggaccacgg

SEQ ID NO: 447 - DNA, 24 bp, Artificial Sequence
  Description of Artificial Sequence:  Hypothetical Probe Sequence
gacctcccgcaagtctggaccgaa

SEQ ID NO: 448 - DNA, 24 bp, Artificial Sequence
  Description of Artificial Sequence:  Hypothetical Probe Sequence
gtgcgcttcctaacgggatgaaag

SEQ ID NO: 449 - DNA, 24 bp, Artificial Sequence
  Description of Artificial Sequence:  Hypothetical Probe Sequence
gtgcgcaacgttgcttttagcgtt

SEQ ID NO: 450 - DNA, 24 bp, Artificial Sequence
  Description of Artificial Sequence:  Hypothetical Probe Sequence
gtgcaggacctaagccatcgacgg

SEQ ID NO: 451 - DNA, 24 bp, Artificial Sequence
  Description of Artificial Sequence:  Hypothetical Probe Sequence
ggaccttgaggatgtcgatggcaa

SEQ ID NO: 452 - DNA, 24 bp, Artificial Sequence
  Description of Artificial Sequence:  Hypothetical Probe Sequence
ggaccagccgttttgagatgccat

SEQ ID NO: 453 - DNA, 24 bp, Artificial Sequence
  Description of Artificial Sequence:  Hypothetical Probe Sequence
acggttgattgaatcgcgtttgcg

SEQ ID NO: 454 - DNA, 24 bp, Artificial Sequence
  Description of Artificial Sequence:  Hypothetical Probe Sequence
acggctcaggacatacccattgcg

SEQ ID NO: 455 - DNA, 24 bp, Artificial Sequence
  Description of Artificial Sequence:  Hypothetical Probe Sequence
acggctgtggtactcatcgttccc

SEQ ID NO: 456 - DNA, 24 bp, Artificial Sequence
  Description of Artificial Sequence:  Hypothetical Probe Sequence
acggagtggcttgtctgaccagcc

SEQ ID NO: 457 - DNA, 24 bp, Artificial Sequence
  Description of Artificial Sequence:  Hypothetical Probe Sequence
acggatcgtctgtctggacccgaa

SEQ ID NO: 458 - DNA, 24 bp, Artificial Sequence
  Description of Artificial Sequence:  Hypothetical Probe Sequence
acggaggatgatacctcacggtgc

SEQ ID NO: 459 - DNA, 24 bp, Artificial Sequence
  Description of Artificial Sequence:  Hypothetical Probe Sequence
agccttagccattctgcgaacgaa

SEQ ID NO: 460 - DNA, 24 bp, Artificial Sequence
  Description of Artificial Sequence:  Hypothetical Probe Sequence
agcctgtcgcaaataccgttcgtt

SEQ ID NO: 461 - DNA, 24 bp, Artificial Sequence
  Description of Artificial Sequence:  Hypothetical Probe Sequence
agcctcgtttagtcgttgcggtct

SEQ ID NO: 462 - DNA, 24 bp, Artificial Sequence
  Description of Artificial Sequence:  Hypothetical Probe Sequence
agccgtctggactgattctgcacg

SEQ ID NO: 463 - DNA, 24 bp, Artificial Sequence
  Description of Artificial Sequence:  Hypothetical Probe Sequence
agccgagtttagcctacacgtgcg

SEQ ID NO: 464 - DNA, 24 bp, Artificial Sequence
  Description of Artificial Sequence:  Hypothetical Probe Sequence
agcctgcgtacactgtccattccc

SEQ ID NO: 465 - DNA, 24 bp, Artificial Sequence
  Description of Artificial Sequence:  Hypothetical Probe Sequence
agccgaccagccttagggacgagt

SEQ ID NO: 466 - DNA, 24 bp, Artificial Sequence
  Description of Artificial Sequence:  Hypothetical Probe Sequence
ttgattgaagccatcggctttccc

SEQ ID NO: 467 - DNA, 24 bp, Artificial Sequence
  Description of Artificial Sequence:  Hypothetical Probe Sequence
ttgaaatccacgtccccgaaacgg

SEQ ID NO: 468 - DNA, 24 bp, Artificial Sequence
  Description of Artificial Sequence:  Hypothetical Probe Sequence
ttgaaaagcgttctcatgcgcgtt

SEQ ID NO: 469 - DNA, 24 bp, Artificial Sequence
  Description of Artificial Sequence:  Hypothetical Probe Sequence
ttgatcgtcagccacgacggacgg

SEQ ID NO: 470 - DNA, 24 bp, Artificial Sequence
  Description of Artificial Sequence:  Hypothetical Probe Sequence
ttgatcgtgtgcacggtgcgatcg

SEQ ID NO: 471 - DNA, 24 bp, Artificial Sequence
  Description of Artificial Sequence:  Hypothetical Probe Sequence
ttgacttgcgaagtgcgtgccgtt

SEQ ID NO: 472 - DNA, 24 bp, Artificial Sequence
  Description of Artificial Sequence:  Hypothetical Probe Sequence
ttgacgtttccccacgagtgcgtt

SEQ ID NO: 473 - DNA, 24 bp, Artificial Sequence
  Description of Artificial Sequence:  Hypothetical Probe Sequence
ttgaccatgtgcacggcacgccat

SEQ ID NO: 474 - DNA, 24 bp, Artificial Sequence
  Description of Artificial Sequence:  Hypothetical Probe Sequence
ttgacgaaacggctcacagccacg

SEQ ID NO: 475 - DNA, 24 bp, Artificial Sequence
  Description of Artificial Sequence:  Hypothetical Probe Sequence
ttgagctttcccggtatcccggac

SEQ ID NO: 476 - DNA, 24 bp, Artificial Sequence
  Description of Artificial Sequence:  Hypothetical Probe Sequence
ttgaagtgcgaaatcggtgcacct

SEQ ID NO: 477 - DNA, 24 bp, Artificial Sequence
  Description of Artificial Sequence:  Hypothetical Probe Sequence
ttgaacctcagccacgagccagga

SEQ ID NO: 478 - DNA, 24 bp, Artificial Sequence
  Description of Artificial Sequence:  Hypothetical Probe Sequence
ttgaacctagcctgcgtcccgacc

SEQ ID NO: 479 - DNA, 24 bp, Artificial Sequence
  Description of Artificial Sequence:  Hypothetical Probe Sequence
ttgatcccaaaggcaaagccatcg

SEQ ID NO: 480 - DNA, 24 bp, Artificial Sequence
  Description of Artificial Sequence:  Hypothetical Probe Sequence
ttgatccctccccctacacgcgtt

SEQ ID NO: 481 - DNA, 24 bp, Artificial Sequence
  Description of Artificial Sequence:  Hypothetical Probe Sequence
ttgatgcgttgacagcggacgcaa

SEQ ID NO: 482 - DNA, 24 bp, Artificial Sequence
  Description of Artificial Sequence:  Hypothetical Probe Sequence
ttgatgcgcgaacctagatgcacg

SEQ ID NO: 483 - DNA, 24 bp, Artificial Sequence
  Description of Artificial Sequence:  Hypothetical Probe Sequence
ttgatgcgggtattagcacggacc

SEQ ID NO: 484 - DNA, 24 bp, Artificial Sequence
  Description of Artificial Sequence:  Hypothetical Probe Sequence
ttgatgcgagtgacgggtgctccc

SEQ ID NO: 485 - DNA, 24 bp, Artificial Sequence
  Description of Artificial Sequence:  Hypothetical Probe Sequence
ttgatgcgcctatctgacggcttg

SEQ ID NO: 486 - DNA, 24 bp, Artificial Sequence
  Description of Artificial Sequence:  Hypothetical Probe Sequence
ttgatgcggatgcagctacatgcg

SEQ ID NO: 487 - DNA, 24 bp, Artificial Sequence
  Description of Artificial Sequence:  Hypothetical Probe Sequence
ttgacacgcttgcacgatcggtgc

SEQ ID NO: 488 - DNA, 24 bp, Artificial Sequence
  Description of Artificial Sequence:  Hypothetical Probe Sequence
ttgacacggtgcccatctgttgcg

SEQ ID NO: 489 - DNA, 24 bp, Artificial Sequence
  Description of Artificial Sequence:  Hypothetical Probe Sequence
ttgacacgacggaaaggcaaatcg

SEQ ID NO: 490 - DNA, 24 bp, Artificial Sequence
  Description of Artificial Sequence:  Hypothetical Probe Sequence
ttgacagcagccagtggtgctccc

SEQ ID NO: 491 - DNA, 24 bp, Artificial Sequence
  Description of Artificial Sequence:  Hypothetical Probe Sequence
ttgagacctgcgcagccgaaggta

SEQ ID NO: 492 - DNA, 24 bp, Artificial Sequence
  Description of Artificial Sequence:  Hypothetical Probe Sequence
ttgaggacacggtccctgtctgcg

SEQ ID NO: 493 - DNA, 24 bp, Artificial Sequence
  Description of Artificial Sequence:  Hypothetical Probe Sequence
ttgaacggcttgcttgccatatcg

SEQ ID NO: 494 - DNA, 24 bp, Artificial Sequence
  Description of Artificial Sequence:  Hypothetical Probe Sequence
ttgaacgggagtacggcacgcttg

SEQ ID NO: 495 - DNA, 24 bp, Artificial Sequence
  Description of Artificial Sequence:  Hypothetical Probe Sequence
ttgaagcccttgaggaacggggta

SEQ ID NO: 496 - DNA, 24 bp, Artificial Sequence
  Description of Artificial Sequence:  Hypothetical Probe Sequence
tgatttgaagccctcaagccgcaa

SEQ ID NO: 497 - DNA, 24 bp, Artificial Sequence
  Description of Artificial Sequence:  Hypothetical Probe Sequence
tgattgattgcggcaacttgcacg

SEQ ID NO: 498 - DNA, 24 bp, Artificial Sequence
  Description of Artificial Sequence:  Hypothetical Probe Sequence
tgattctgccatggacacgggtgc

SEQ ID NO: 499 - DNA, 24 bp, Artificial Sequence
  Description of Artificial Sequence:  Hypothetical Probe Sequence
tgattctgcagcaggaccattgcg

SEQ ID NO: 500 - DNA, 24 bp, Artificial Sequence
  Description of Artificial Sequence:  Hypothetical Probe Sequence
tgattcgtcagccagcgtgcgatg

SEQ ID NO: 501 - DNA, 24 bp, Artificial Sequence
  Description of Artificial Sequence:  Hypothetical Probe Sequence
tgatcttgccattcccggaccagc

SEQ ID NO: 502 - DNA, 24 bp, Artificial Sequence
  Description of Artificial Sequence:  Hypothetical Probe Sequence
tgatcgaagcttagcccctatgcg

SEQ ID NO: 503 - DNA, 24 bp, Artificial Sequence
  Description of Artificial Sequence:  Hypothetical Probe Sequence
tgatggtatgcgtcgttcgttccc

SEQ ID NO: 504 - DNA, 24 bp, Artificial Sequence
  Description of Artificial Sequence:  Hypothetical Probe Sequence
tgatgcaagatggatgtcccagcc

SEQ ID NO: 505 - DNA, 24 bp, Artificial Sequence
  Description of Artificial Sequence:  Hypothetical Probe Sequence
tgatgatggcaacagctcccccat

SEQ ID NO: 506 - DNA, 24 bp, Artificial Sequence
  Description of Artificial Sequence:  Hypothetical Probe Sequence
tgatgatgacgggacccacgtgcg

SEQ ID NO: 507 - DNA, 24 bp, Artificial Sequence
  Description of Artificial Sequence:  Hypothetical Probe Sequence
tgattcccgagtagcccacgtcgt

SEQ ID NO: 508 - DNA, 24 bp, Artificial Sequence
  Description of Artificial Sequence:  Hypothetical Probe Sequence
tgattcccgtgcaaagacggacct

SEQ ID NO: 509 - DNA, 24 bp, Artificial Sequence
  Description of Artificial Sequence:  Hypothetical Probe Sequence
tgattgcggagtcttgacggggac

SEQ ID NO: 510 - DNA, 24 bp, Artificial Sequence
  Description of Artificial Sequence:  Hypothetical Probe Sequence
tgattgcggatgaatcatcgtgcg

SEQ ID NO: 511 - DNA, 24 bp, Artificial Sequence
  Description of Artificial Sequence:  Hypothetical Probe Sequence
tgatcagcatcgtcccgcaaatcg

SEQ ID NO: 512 - DNA, 24 bp, Artificial Sequence
  Description of Artificial Sequence:  Hypothetical Probe Sequence
tgatgaccgatgcacgacgggcaa

SEQ ID NO: 513 - DNA, 24 bp, Artificial Sequence
  Description of Artificial Sequence:  Hypothetical Probe Sequence
tgatgaccgtgcagccggtactca

SEQ ID NO: 514 - DNA, 24 bp, Artificial Sequence
  Description of Artificial Sequence:  Hypothetical Probe Sequence
tgatgtgctccctacatccctgcg

SEQ ID NO: 515 - DNA, 24 bp, Artificial Sequence
  Description of Artificial Sequence:  Hypothetical Probe Sequence
tgatgtgcggacgatgagccggta

SEQ ID NO: 516 - DNA, 24 bp, Artificial Sequence
  Description of Artificial Sequence:  Hypothetical Probe Sequence
tgatggacggacatcggaccgctt

SEQ ID NO: 517 - DNA, 24 bp, Artificial Sequence
  Description of Artificial Sequence:  Hypothetical Probe Sequence
tgatacggtcgtcagccgtttgcg

SEQ ID NO: 518 - DNA, 24 bp, Artificial Sequence
  Description of Artificial Sequence:  Hypothetical Probe Sequence
tgatacggcttgcacgacggagga

SEQ ID NO: 519 - DNA, 24 bp, Artificial Sequence
  Description of Artificial Sequence:  Hypothetical Probe Sequence
tgatacggcgttttagcacgtgcg

SEQ ID NO: 520 - DNA, 24 bp, Artificial Sequence
  Description of Artificial Sequence:  Hypothetical Probe Sequence
tgatacggcctagatgacggcgtt

SEQ ID NO: 521 - DNA, 24 bp, Artificial Sequence
  Description of Artificial Sequence:  Hypothetical Probe Sequence
ttagcttggcaactcacagcgcaa

SEQ ID NO: 522 - DNA, 24 bp, Artificial Sequence
  Description of Artificial Sequence:  Hypothetical Probe Sequence
ttagcgttagcctctgcagcgcaa

SEQ ID NO: 523 - DNA, 24 bp, Artificial Sequence
  Description of Artificial Sequence:  Hypothetical Probe Sequence
ttagccatagccttgaagccggac

SEQ ID NO: 524 - DNA, 24 bp, Artificial Sequence
  Description of Artificial Sequence:  Hypothetical Probe Sequence
ttagcgaaacctagccagccccta

SEQ ID NO: 525 - DNA, 24 bp, Artificial Sequence
  Description of Artificial Sequence:  Hypothetical Probe Sequence
ttagaggatgcgctcatccccgtt

SEQ ID NO: 526 - DNA, 24 bp, Artificial Sequence
  Description of Artificial Sequence:  Hypothetical Probe Sequence
ttaggatgcgaacacggatgtgcg

SEQ ID NO: 527 - DNA, 24 bp, Artificial Sequence
  Description of Artificial Sequence:  Hypothetical Probe Sequence
ttagtccccgttcgaagatgcgaa

SEQ ID NO: 528 - DNA, 24 bp, Artificial Sequence
  Description of Artificial Sequence:  Hypothetical Probe Sequence
ttagtcccatcgacggtgcgggta

SEQ ID NO: 529 - DNA, 24 bp, Artificial Sequence
  Description of Artificial Sequence:  Hypothetical Probe Sequence
ttagtcccagcccgaaagcccagc

SEQ ID NO: 530 - DNA, 24 bp, Artificial Sequence
  Description of Artificial Sequence:  Hypothetical Probe Sequence
ttagtgcgcttgtgcggtgcatcg

SEQ ID NO: 531 - DNA, 24 bp, Artificial Sequence
  Description of Artificial Sequence:  Hypothetical Probe Sequence
ttagcagccctatctgcagcgacc

SEQ ID NO: 532 - DNA, 24 bp, Artificial Sequence
  Description of Artificial Sequence:  Hypothetical Probe Sequence
ttagcagcacggtacacacggctt

SEQ ID NO: 533 - DNA, 24 bp, Artificial Sequence
  Description of Artificial Sequence:  Hypothetical Probe Sequence
ttaggaccgatggcttcacgtgcg

SEQ ID NO: 534 - DNA, 24 bp, Artificial Sequence
  Description of Artificial Sequence:  Hypothetical Probe Sequence
ttaggtgcgaccgtgccgtttgat

SEQ ID NO: 535 - DNA, 24 bp, Artificial Sequence
  Description of Artificial Sequence:  Hypothetical Probe Sequence
ttagggacatcgcctaagcccgaa

SEQ ID NO: 536 - DNA, 24 bp, Artificial Sequence
  Description of Artificial Sequence:  Hypothetical Probe Sequence
ttagggaccctatccccgaatccc

SEQ ID NO: 537 - DNA, 24 bp, Artificial Sequence
  Description of Artificial Sequence:  Hypothetical Probe Sequence
ttagggactccctctgacggcagc

SEQ ID NO: 538 - DNA, 24 bp, Artificial Sequence
  Description of Artificial Sequence:  Hypothetical Probe Sequence
ttagggaccacgtcgtatcgagcc

SEQ ID NO: 539 - DNA, 24 bp, Artificial Sequence
  Description of Artificial Sequence:  Hypothetical Probe Sequence
ttagacggatcgatcgagccggac

SEQ ID NO: 540 - DNA, 24 bp, Artificial Sequence
  Description of Artificial Sequence:  Hypothetical Probe Sequence
ttagacggaggaacggcacggcaa

SEQ ID NO: 541 - DNA, 24 bp, Artificial Sequence
  Description of Artificial Sequence:  Hypothetical Probe Sequence
ttagagccgcaagagtgtgccacg

SEQ ID NO: 542 - DNA, 24 bp, Artificial Sequence
  Description of Artificial Sequence:  Hypothetical Probe Sequence
aatcaaagcgtttcccagcccttg

SEQ ID NO: 543 - DNA, 24 bp, Artificial Sequence
  Description of Artificial Sequence:  Hypothetical Probe Sequence
aatccgttgcaactgtagcccacg

SEQ ID NO: 544 - DNA, 24 bp, Artificial Sequence
  Description of Artificial Sequence:  Hypothetical Probe Sequence
aatcctcaacggtcccatacacgg

SEQ ID NO: 545 - DNA, 24 bp, Artificial Sequence
  Description of Artificial Sequence:  Hypothetical Probe Sequence
aatccgaaaatcagcctgcgcgtt

SEQ ID NO: 546 - DNA, 24 bp, Artificial Sequence
  Description of Artificial Sequence:  Hypothetical Probe Sequence
aatccgaaaaaggatgcgaatgcg

SEQ ID NO: 547 - DNA, 24 bp, Artificial Sequence
  Description of Artificial Sequence:  Hypothetical Probe Sequence
aatccgaactcaacgggcaagtgc

SEQ ID NO: 548 - DNA, 24 bp, Artificial Sequence
  Description of Artificial Sequence:  Hypothetical Probe Sequence
aatccgaaagtgcacgcacggtgc

SEQ ID NO: 549 - DNA, 24 bp, Artificial Sequence
  Description of Artificial Sequence:  Hypothetical Probe Sequence
aatcggtagcaaaaagggacgcaa

SEQ ID NO: 550 - DNA, 24 bp, Artificial Sequence
  Description of Artificial Sequence:  Hypothetical Probe Sequence
aatccctatgcgtgtcatcggctt

SEQ ID NO: 551 - DNA, 24 bp, Artificial Sequence
  Description of Artificial Sequence:  Hypothetical Probe Sequence
aatctcccgtctcgaagacccgaa

SEQ ID NO: 552 - DNA, 24 bp, Artificial Sequence
  Description of Artificial Sequence:  Hypothetical Probe Sequence
aatctgcggctttacaggacgctt

SEQ ID NO: 553 - DNA, 24 bp, Artificial Sequence
  Description of Artificial Sequence:  Hypothetical Probe Sequence
aatctgcgaggagacctcccacgg

SEQ ID NO: 554 - DNA, 24 bp, Artificial Sequence
  Description of Artificial Sequence:  Hypothetical Probe Sequence
aatctgcggaccggtatcccacct

SEQ ID NO: 555 - DNA, 24 bp, Artificial Sequence
  Description of Artificial Sequence:  Hypothetical Probe Sequence
aatctgcggtgctctgacggtcgt

SEQ ID NO: 556 - DNA, 24 bp, Artificial Sequence
  Description of Artificial Sequence:  Hypothetical Probe Sequence
aatccacgtcgtacgggcaacagc

SEQ ID NO: 557 - DNA, 24 bp, Artificial Sequence
  Description of Artificial Sequence:  Hypothetical Probe Sequence
aatccagccttgcttgggacggac

SEQ ID NO: 558 - DNA, 24 bp, Artificial Sequence
  Description of Artificial Sequence:  Hypothetical Probe Sequence
aatccagccctaaggaggacagcc

SEQ ID NO: 559 - DNA, 24 bp, Artificial Sequence
  Description of Artificial Sequence:  Hypothetical Probe Sequence
aatccagctgcgcgttcgaactgt

SEQ ID NO: 560 - DNA, 24 bp, Artificial Sequence
  Description of Artificial Sequence:  Hypothetical Probe Sequence
aatccagcacgggtctagccgatg

SEQ ID NO: 561 - DNA, 24 bp, Artificial Sequence
  Description of Artificial Sequence:  Hypothetical Probe Sequence
aatcgaccaatcgcttgaccgcaa

SEQ ID NO: 562 - DNA, 24 bp, Artificial Sequence
  Description of Artificial Sequence:  Hypothetical Probe Sequence
aatcgaccccatcgttagtgtgcg

SEQ ID NO: 563 - DNA, 24 bp, Artificial Sequence
  Description of Artificial Sequence:  Hypothetical Probe Sequence
aatcgacccctaacggaaagcgtt

SEQ ID NO: 564 - DNA, 24 bp, Artificial Sequence
  Description of Artificial Sequence:  Hypothetical Probe Sequence
aatcgaccgatgccattcgtcgaa

SEQ ID NO: 565 - DNA, 24 bp, Artificial Sequence
  Description of Artificial Sequence:  Hypothetical Probe Sequence
aatcgaccggacaggatgattgcg

SEQ ID NO: 566 - DNA, 24 bp, Artificial Sequence
  Description of Artificial Sequence:  Hypothetical Probe Sequence
aatcgtgcctcaataccagcacgg

SEQ ID NO: 567 - DNA, 24 bp, Artificial Sequence
  Description of Artificial Sequence:  Hypothetical Probe Sequence
aatcgtgcgatgcagcgtctgcaa

SEQ ID NO: 568 - DNA, 24 bp, Artificial Sequence
  Description of Artificial Sequence:  Hypothetical Probe Sequence
aatcggacagccaggaatcgatcg

SEQ ID NO: 569 - DNA, 24 bp, Artificial Sequence
  Description of Artificial Sequence:  Hypothetical Probe Sequence
aatcacggctcactcatcccctca

SEQ ID NO: 570 - DNA, 24 bp, Artificial Sequence
  Description of Artificial Sequence:  Hypothetical Probe Sequence
aatcacggacctctcaagccgacc

SEQ ID NO: 571 - DNA, 24 bp, Artificial Sequence
  Description of Artificial Sequence:  Hypothetical Probe Sequence
aatcacgggatgcgaacgaagtgc

SEQ ID NO: 572 - DNA, 24 bp, Artificial Sequence
  Description of Artificial Sequence:  Hypothetical Probe Sequence
aatcagcccgttaaagtgcggatg

SEQ ID NO: 573 - DNA, 24 bp, Artificial Sequence
  Description of Artificial Sequence:  Hypothetical Probe Sequence
aatcagccctcaatcgcagcagcc

SEQ ID NO: 574 - DNA, 24 bp, Artificial Sequence
  Description of Artificial Sequence:  Hypothetical Probe Sequence
aatcagccggtaccatagcctgcg

SEQ ID NO: 575 - DNA, 24 bp, Artificial Sequence
  Description of Artificial Sequence:  Hypothetical Probe Sequence
aatcagccaggatgtccctatgcg

SEQ ID NO: 576 - DNA, 24 bp, Artificial Sequence
  Description of Artificial Sequence:  Hypothetical Probe Sequence
atacccatcgaaggactgcgcagc

SEQ ID NO: 577 - DNA, 24 bp, Artificial Sequence
  Description of Artificial Sequence:  Hypothetical Probe Sequence
atacgcaaacggctcatcccggta

SEQ ID NO: 578 - DNA, 24 bp, Artificial Sequence
  Description of Artificial Sequence:  Hypothetical Probe Sequence
ataccctaacggcagctgcgctgt

SEQ ID NO: 579 - DNA, 24 bp, Artificial Sequence
  Description of Artificial Sequence:  Hypothetical Probe Sequence
atacgatgacggcagctcccgcaa

SEQ ID NO: 580 - DNA, 24 bp, Artificial Sequence
  Description of Artificial Sequence:  Hypothetical Probe Sequence
atactgcgctgttccccacgagcc

SEQ ID NO: 581 - DNA, 24 bp, Artificial Sequence
  Description of Artificial Sequence:  Hypothetical Probe Sequence
atactgcgcgaattaggcaaagcc

SEQ ID NO: 582 - DNA, 24 bp, Artificial Sequence
  Description of Artificial Sequence:  Hypothetical Probe Sequence
ataccacgatcgtccccgaacgaa

SEQ ID NO: 583 - DNA, 24 bp, Artificial Sequence
  Description of Artificial Sequence:  Hypothetical Probe Sequence
ataccagcggaccctaagccagcc

SEQ ID NO: 584 - DNA, 24 bp, Artificial Sequence
  Description of Artificial Sequence:  Hypothetical Probe Sequence
atacgaccgagttgcgtcccgatg

SEQ ID NO: 585 - DNA, 24 bp, Artificial Sequence
  Description of Artificial Sequence:  Hypothetical Probe Sequence
atacgtgctgcgggtaccatggac

SEQ ID NO: 586 - DNA, 24 bp, Artificial Sequence
  Description of Artificial Sequence:  Hypothetical Probe Sequence
atacgtgccacgatcgcttgtccc

SEQ ID NO: 587 - DNA, 24 bp, Artificial Sequence
  Description of Artificial Sequence:  Hypothetical Probe Sequence
atacggacgacctgtcggacgcaa

SEQ ID NO: 588 - DNA, 24 bp, Artificial Sequence
  Description of Artificial Sequence:  Hypothetical Probe Sequence
atacacggcctaacggtgtccgtt

SEQ ID NO: 589 - DNA, 24 bp, Artificial Sequence
  Description of Artificial Sequence:  Hypothetical Probe Sequence
atacacggtccccgttggaccagc

SEQ ID NO: 590 - DNA, 24 bp, Artificial Sequence
  Description of Artificial Sequence:  Hypothetical Probe Sequence
atacagcccgaacagctccctcgt

SEQ ID NO: 591 - DNA, 24 bp, Artificial Sequence
  Description of Artificial Sequence:  Hypothetical Probe Sequence
aaagtcgtagccatcgcacgcagc

SEQ ID NO: 592 - DNA, 24 bp, Artificial Sequence
  Description of Artificial Sequence:  Hypothetical Probe Sequence
aaagcgttttgacgttagcctgcg

SEQ ID NO: 593 - DNA, 24 bp, Artificial Sequence
  Description of Artificial Sequence:  Hypothetical Probe Sequence
aaagcgttatcgtcccgacctctg

SEQ ID NO: 594 - DNA, 24 bp, Artificial Sequence
  Description of Artificial Sequence:  Hypothetical Probe Sequence
aaagcgttgaccgatgacggccat

SEQ ID NO: 595 - DNA, 24 bp, Artificial Sequence
  Description of Artificial Sequence:  Hypothetical Probe Sequence
aaagccatgctttccctcccaaag

SEQ ID NO: 596 - DNA, 24 bp, Artificial Sequence
  Description of Artificial Sequence:  Hypothetical Probe Sequence
aaagcgaatcgttcgtcttgcacg

SEQ ID NO: 597 - DNA, 24 bp, Artificial Sequence
  Description of Artificial Sequence:  Hypothetical Probe Sequence
aaagcgaacgaagatgccatcagc

SEQ ID NO: 598 - DNA, 24 bp, Artificial Sequence
  Description of Artificial Sequence:  Hypothetical Probe Sequence
aaagcgaacagcgacccctacagc

SEQ ID NO: 599 - DNA, 24 bp, Artificial Sequence
  Description of Artificial Sequence:  Hypothetical Probe Sequence
aaaggcttatcgtgcgtcgtgctt

SEQ ID NO: 600 - DNA, 24 bp, Artificial Sequence
  Description of Artificial Sequence:  Hypothetical Probe Sequence
aaaggcaaaaagtgtccagcggac

SEQ ID NO: 601 - DNA, 24 bp, Artificial Sequence
  Description of Artificial Sequence:  Hypothetical Probe Sequence
aaaggcaatcgttgtcggtatgcg

SEQ ID NO: 602 - DNA, 24 bp, Artificial Sequence
  Description of Artificial Sequence:  Hypothetical Probe Sequence
aaaggcaaagtgcgaacacggcaa

SEQ ID NO: 603 - DNA, 24 bp, Artificial Sequence
  Description of Artificial Sequence:  Hypothetical Probe Sequence
aaaggcaacagcgcaagcaaggac

SEQ ID NO: 604 - DNA, 24 bp, Artificial Sequence
  Description of Artificial Sequence:  Hypothetical Probe Sequence
aaagatcggcaaaaagtccccgaa

SEQ ID NO: 605 - DNA, 24 bp, Artificial Sequence
  Description of Artificial Sequence:  Hypothetical Probe Sequence
aaagatcgcagcgcttgatgtgcg

SEQ ID NO: 606 - DNA, 24 bp, Artificial Sequence
  Description of Artificial Sequence:  Hypothetical Probe Sequence
aaaggatgctcaagcccagcacgg

SEQ ID NO: 607 - DNA, 24 bp, Artificial Sequence
  Description of Artificial Sequence:  Hypothetical Probe Sequence
aaagtcccgagttgcgtgcgttag

SEQ ID NO: 608 - DNA, 24 bp, Artificial Sequence
  Description of Artificial Sequence:  Hypothetical Probe Sequence
aaagtgcgagccatcgacctacgg

SEQ ID NO: 609 - DNA, 24 bp, Artificial Sequence
  Description of Artificial Sequence:  Hypothetical Probe Sequence
aaagcacggcttggtagtgcgacc

SEQ ID NO: 610 - DNA, 24 bp, Artificial Sequence
  Description of Artificial Sequence:  Hypothetical Probe Sequence
aaagcacggcaatgatcacggacc

SEQ ID NO: 611 - DNA, 24 bp, Artificial Sequence
  Description of Artificial Sequence:  Hypothetical Probe Sequence
aaagcacgagtgggacgtgcatcg

SEQ ID NO: 612 - DNA, 24 bp, Artificial Sequence
  Description of Artificial Sequence:  Hypothetical Probe Sequence
aaagcagcgcttggtaatcgggta

SEQ ID NO: 613 - DNA, 24 bp, Artificial Sequence
  Description of Artificial Sequence:  Hypothetical Probe Sequence
aaaggaccggtaaaagcgaagcaa

SEQ ID NO: 614 - DNA, 24 bp, Artificial Sequence
  Description of Artificial Sequence:  Hypothetical Probe Sequence
aaaggtgctcgtcagcagtgcgtt

SEQ ID NO: 615 - DNA, 24 bp, Artificial Sequence
  Description of Artificial Sequence:  Hypothetical Probe Sequence
aaaggtgccttggtgcgatgccta

SEQ ID NO: 616 - DNA, 24 bp, Artificial Sequence
  Description of Artificial Sequence:  Hypothetical Probe Sequence
aaaggtgcctcatgtcacgggtgc

SEQ ID NO: 617 - DNA, 24 bp, Artificial Sequence
  Description of Artificial Sequence:  Hypothetical Probe Sequence
aaaggtgccgaaatcgggacttga

SEQ ID NO: 618 - DNA, 24 bp, Artificial Sequence
  Description of Artificial Sequence:  Hypothetical Probe Sequence
aaaggtgccagcggtaggaccagc

SEQ ID NO: 619 - DNA, 24 bp, Artificial Sequence
  Description of Artificial Sequence:  Hypothetical Probe Sequence
aaagggacttgaacgggcttgcaa

SEQ ID NO: 620 - DNA, 24 bp, Artificial Sequence
  Description of Artificial Sequence:  Hypothetical Probe Sequence
aaagggacctcagcaaagccccat

SEQ ID NO: 621 - DNA, 24 bp, Artificial Sequence
  Description of Artificial Sequence:  Hypothetical Probe Sequence
aaagggacccatgcttccatgacc

SEQ ID NO: 622 - DNA, 24 bp, Artificial Sequence
  Description of Artificial Sequence:  Hypothetical Probe Sequence
aaagacggtctggcttacgggtgc

SEQ ID NO: 623 - DNA, 24 bp, Artificial Sequence
  Description of Artificial Sequence:  Hypothetical Probe Sequence
aaagacggcgttgtgcaaagtccc

SEQ ID NO: 624 - DNA, 24 bp, Artificial Sequence
  Description of Artificial Sequence:  Hypothetical Probe Sequence
aaagacggatcgcacgcctagcaa

SEQ ID NO: 625 - DNA, 24 bp, Artificial Sequence
  Description of Artificial Sequence:  Hypothetical Probe Sequence
aaagagccgagtggacatcgtgcg

SEQ ID NO: 626 - DNA, 24 bp, Artificial Sequence
  Description of Artificial Sequence:  Hypothetical Probe Sequence
aaagagccagtgacggccatcacg

SEQ ID NO: 627 - DNA, 24 bp, Artificial Sequence
  Description of Artificial Sequence:  Hypothetical Probe Sequence
tacatccccgaaggtaacggcagc

SEQ ID NO: 628 - DNA, 24 bp, Artificial Sequence
  Description of Artificial Sequence:  Hypothetical Probe Sequence
tacatcccatcggagttcccgacc

SEQ ID NO: 629 - DNA, 24 bp, Artificial Sequence
  Description of Artificial Sequence:  Hypothetical Probe Sequence
tacatgcgggacgagtgacccacg

SEQ ID NO: 630 - DNA, 24 bp, Artificial Sequence
  Description of Artificial Sequence:  Hypothetical Probe Sequence
tacacagctgcgtacatgcgccat

SEQ ID NO: 631 - DNA, 24 bp, Artificial Sequence
  Description of Artificial Sequence:  Hypothetical Probe Sequence
tacagaccgcaacgaaagcctccc

SEQ ID NO: 632 - DNA, 24 bp, Artificial Sequence
  Description of Artificial Sequence:  Hypothetical Probe Sequence
tacagtgcacgggcaagaccgtgc

SEQ ID NO: 633 - DNA, 24 bp, Artificial Sequence
  Description of Artificial Sequence:  Hypothetical Probe Sequence
tacaacggtcgtatcgcttgccat

SEQ ID NO: 634 - DNA, 24 bp, Artificial Sequence
  Description of Artificial Sequence:  Hypothetical Probe Sequence
tacaacggcttgctcagaccgcaa

SEQ ID NO: 635 - DNA, 24 bp, Artificial Sequence
  Description of Artificial Sequence:  Hypothetical Probe Sequence
tacaacgggagttgcgcagcctca

SEQ ID NO: 636 - DNA, 24 bp, Artificial Sequence
  Description of Artificial Sequence:  Hypothetical Probe Sequence
tacaacggacctgatgcagcgcaa

SEQ ID NO: 637 - DNA, 24 bp, Artificial Sequence
  Description of Artificial Sequence:  Hypothetical Probe Sequence
tacaacggcacgtgcgacctttag

SEQ ID NO: 638 - DNA, 24 bp, Artificial Sequence
  Description of Artificial Sequence:  Hypothetical Probe Sequence
tacaagccgcaagtcttgcgttga

SEQ ID NO: 639 - DNA, 24 bp, Artificial Sequence
  Description of Artificial Sequence:  Hypothetical Probe Sequence
tacaagccatcgcagccttggcaa

SEQ ID NO: 640 - DNA, 24 bp, Artificial Sequence
  Description of Artificial Sequence:  Hypothetical Probe Sequence
tctgtctgcgtttgcggcaaagcc

SEQ ID NO: 641 - DNA, 24 bp, Artificial Sequence
  Description of Artificial Sequence:  Hypothetical Probe Sequence
tctgtctgcgaatgcggaccgtct

SEQ ID NO: 642 - DNA, 24 bp, Artificial Sequence
  Description of Artificial Sequence:  Hypothetical Probe Sequence
tctgtcgtgcttgaccagcctgtc

SEQ ID NO: 643 - DNA, 24 bp, Artificial Sequence
  Description of Artificial Sequence:  Hypothetical Probe Sequence
tctgcttgcgttgctttgtccgtt

SEQ ID NO: 644 - DNA, 24 bp, Artificial Sequence
  Description of Artificial Sequence:  Hypothetical Probe Sequence
tctgcgttttgagtgcagcccagc

SEQ ID NO: 645 - DNA, 24 bp, Artificial Sequence
  Description of Artificial Sequence:  Hypothetical Probe Sequence
tctgcgttcgttcttgcgaaacct

SEQ ID NO: 646 - DNA, 24 bp, Artificial Sequence
  Description of Artificial Sequence:  Hypothetical Probe Sequence
tctgcgttgatgaggacagctgcg

SEQ ID NO: 647 - DNA, 24 bp, Artificial Sequence
  Description of Artificial Sequence:  Hypothetical Probe Sequence
tctgctcagcaaacctgtgcacgg

SEQ ID NO: 648 - DNA, 24 bp, Artificial Sequence
  Description of Artificial Sequence:  Hypothetical Probe Sequence
tctgctcacagcacgggtgcgatg

SEQ ID NO: 649 - DNA, 24 bp, Artificial Sequence
  Description of Artificial Sequence:  Hypothetical Probe Sequence
tctgctgtcacggacccagccgtt

SEQ ID NO: 650 - DNA, 24 bp, Artificial Sequence
  Description of Artificial Sequence:  Hypothetical Probe Sequence
tctgccatcgaaagtggtgccttg

SEQ ID NO: 651 - DNA, 24 bp, Artificial Sequence
  Description of Artificial Sequence:  Hypothetical Probe Sequence
tctgccatggtacgtttgcggacc

SEQ ID NO: 652 - DNA, 24 bp, Artificial Sequence
  Description of Artificial Sequence:  Hypothetical Probe Sequence
tctgccattcccatcgtctgcacg

SEQ ID NO: 653 - DNA, 24 bp, Artificial Sequence
  Description of Artificial Sequence:  Hypothetical Probe Sequence
tctgcgaatctgcgtttgattgcg

SEQ ID NO: 654 - DNA, 24 bp, Artificial Sequence
  Description of Artificial Sequence:  Hypothetical Probe Sequence
tctgcgaaagtgacggagcccgtt

SEQ ID NO: 655 - DNA, 24 bp, Artificial Sequence
  Description of Artificial Sequence:  Hypothetical Probe Sequence
tctgcgaagtgccttgtcgttccc

SEQ ID NO: 656 - DNA, 24 bp, Artificial Sequence
  Description of Artificial Sequence:  Hypothetical Probe Sequence
tctggcttaggaacgggcttcttg

SEQ ID NO: 657 - DNA, 24 bp, Artificial Sequence
  Description of Artificial Sequence:  Hypothetical Probe Sequence
tctggctttgcgaatccttggctt

SEQ ID NO: 658 - DNA, 24 bp, Artificial Sequence
  Description of Artificial Sequence:  Hypothetical Probe Sequence
tctggcttgaccgacccgaagatg

SEQ ID NO: 659 - DNA, 24 bp, Artificial Sequence
  Description of Artificial Sequence:  Hypothetical Probe Sequence
tctgggtatccccgaatgtccacg

SEQ ID NO: 660 - DNA, 24 bp, Artificial Sequence
  Description of Artificial Sequence:  Hypothetical Probe Sequence
tctggcaatgatatcgcacggtgc

SEQ ID NO: 661 - DNA, 24 bp, Artificial Sequence
  Description of Artificial Sequence:  Hypothetical Probe Sequence
tctggcaaaaaggctttccccttg

SEQ ID NO: 662 - DNA, 24 bp, Artificial Sequence
  Description of Artificial Sequence:  Hypothetical Probe Sequence
tctggcaactgtcagcgcttcgaa

SEQ ID NO: 663 - DNA, 24 bp, Artificial Sequence
  Description of Artificial Sequence:  Hypothetical Probe Sequence
tctggcaaggtatctgcagccagc

SEQ ID NO: 664 - DNA, 24 bp, Artificial Sequence
  Description of Artificial Sequence:  Hypothetical Probe Sequence
tctgagtggcaatccctccctgcg

SEQ ID NO: 665 - DNA, 24 bp, Artificial Sequence
  Description of Artificial Sequence:  Hypothetical Probe Sequence
tctgatcggtgctgcgaatcgtgc

SEQ ID NO: 666 - DNA, 24 bp, Artificial Sequence
  Description of Artificial Sequence:  Hypothetical Probe Sequence
tctgcctacagccgaatcccgctt

SEQ ID NO: 667 - DNA, 24 bp, Artificial Sequence
  Description of Artificial Sequence:  Hypothetical Probe Sequence
tctggatgccatgtgccgaacagc

SEQ ID NO: 668 - DNA, 24 bp, Artificial Sequence
  Description of Artificial Sequence:  Hypothetical Probe Sequence
tctggatgcgaaaaagtgcgccta

SEQ ID NO: 669 - DNA, 24 bp, Artificial Sequence
  Description of Artificial Sequence:  Hypothetical Probe Sequence
tctggatgggacggtatgcgcttg

SEQ ID NO: 670 - DNA, 24 bp, Artificial Sequence
  Description of Artificial Sequence:  Hypothetical Probe Sequence
tctgtcccccattcgtgatggtgc

SEQ ID NO: 671 - DNA, 24 bp, Artificial Sequence
  Description of Artificial Sequence:  Hypothetical Probe Sequence
tctgtcccgctttctggatgtgcg

SEQ ID NO: 672 - DNA, 24 bp, Artificial Sequence
  Description of Artificial Sequence:  Hypothetical Probe Sequence
tctgtcccggtaccatatcgcgaa

SEQ ID NO: 673 - DNA, 24 bp, Artificial Sequence
  Description of Artificial Sequence:  Hypothetical Probe Sequence
tctgtcccgagtggacgcaaccat

SEQ ID NO: 674 - DNA, 24 bp, Artificial Sequence
  Description of Artificial Sequence:  Hypothetical Probe Sequence
tctgtcccagcccctatcccacct

SEQ ID NO: 675 - DNA, 24 bp, Artificial Sequence
  Description of Artificial Sequence:  Hypothetical Probe Sequence
tctgtgcgtctgtccccgaagcaa

SEQ ID NO: 676 - DNA, 24 bp, Artificial Sequence
  Description of Artificial Sequence:  Hypothetical Probe Sequence
tctgtgcgtgcggatgacctacgg

SEQ ID NO: 677 - DNA, 24 bp, Artificial Sequence
  Description of Artificial Sequence:  Hypothetical Probe Sequence
tctgtgcggacctcgttgatcacg

SEQ ID NO: 678 - DNA, 24 bp, Artificial Sequence
  Description of Artificial Sequence:  Hypothetical Probe Sequence
tctgcacgcttgttagcagcacct

SEQ ID NO: 679 - DNA, 24 bp, Artificial Sequence
  Description of Artificial Sequence:  Hypothetical Probe Sequence
tctgcacgccatgtgccgtttaca

SEQ ID NO: 680 - DNA, 24 bp, Artificial Sequence
  Description of Artificial Sequence:  Hypothetical Probe Sequence
tctgcacggagttgtcggacgtgc

SEQ ID NO: 681 - DNA, 24 bp, Artificial Sequence
  Description of Artificial Sequence:  Hypothetical Probe Sequence
tctgcacgcctaagccctgtgacc

SEQ ID NO: 682 - DNA, 24 bp, Artificial Sequence
  Description of Artificial Sequence:  Hypothetical Probe Sequence
tctgcacggatgacggacctcgaa

SEQ ID NO: 683 - DNA, 24 bp, Artificial Sequence
  Description of Artificial Sequence:  Hypothetical Probe Sequence
tctgcagcctgtggtacacgcgtt

SEQ ID NO: 684 - DNA, 24 bp, Artificial Sequence
  Description of Artificial Sequence:  Hypothetical Probe Sequence
tctgcagccgaagcttgcaaacgg

SEQ ID NO: 685 - DNA, 24 bp, Artificial Sequence
  Description of Artificial Sequence:  Hypothetical Probe Sequence
tctgcagcgtgcgcaaagcctaca

SEQ ID NO: 686 - DNA, 24 bp, Artificial Sequence
  Description of Artificial Sequence:  Hypothetical Probe Sequence
tctggacctgcgccatctcagcaa

SEQ ID NO: 687 - DNA, 24 bp, Artificial Sequence
  Description of Artificial Sequence:  Hypothetical Probe Sequence
tctggacccacggacctgtccagc

SEQ ID NO: 688 - DNA, 24 bp, Artificial Sequence
  Description of Artificial Sequence:  Hypothetical Probe Sequence
tctggaccgaccagtgcgttccat

SEQ ID NO: 689 - DNA, 24 bp, Artificial Sequence
  Description of Artificial Sequence:  Hypothetical Probe Sequence
tctggtgctcgtctgtgtgcacgg

SEQ ID NO: 690 - DNA, 24 bp, Artificial Sequence
  Description of Artificial Sequence:  Hypothetical Probe Sequence
tctggtgcggtacagcctcaatcg

SEQ ID NO: 691 - DNA, 24 bp, Artificial Sequence
  Description of Artificial Sequence:  Hypothetical Probe Sequence
tctggtgcatcgggacatcggtgc

SEQ ID NO: 692 - DNA, 24 bp, Artificial Sequence
  Description of Artificial Sequence:  Hypothetical Probe Sequence
tctgggaccgttgtctagcccgtt

SEQ ID NO: 693 - DNA, 24 bp, Artificial Sequence
  Description of Artificial Sequence:  Hypothetical Probe Sequence
tctgggaccctaatcgacggcgtt

SEQ ID NO: 694 - DNA, 24 bp, Artificial Sequence
  Description of Artificial Sequence:  Hypothetical Probe Sequence
tctgacgggagtgcaacacggacc

SEQ ID NO: 695 - DNA, 24 bp, Artificial Sequence
  Description of Artificial Sequence:  Hypothetical Probe Sequence
tctgacgggcaacttgatcgctca

SEQ ID NO: 696 - DNA, 24 bp, Artificial Sequence
  Description of Artificial Sequence:  Hypothetical Probe Sequence
tctgacgggatgacctagccgatg

SEQ ID NO: 697 - DNA, 24 bp, Artificial Sequence
  Description of Artificial Sequence:  Hypothetical Probe Sequence
tctgacggacgggcttagtgtgcg

SEQ ID NO: 698 - DNA, 24 bp, Artificial Sequence
  Description of Artificial Sequence:  Hypothetical Probe Sequence
tctgagccaaaggtgcccatcgtt

SEQ ID NO: 699 - DNA, 24 bp, Artificial Sequence
  Description of Artificial Sequence:  Hypothetical Probe Sequence
tctgagccgcaaggtaacggacct

SEQ ID NO: 700 - DNA, 24 bp, Artificial Sequence
  Description of Artificial Sequence:  Hypothetical Probe Sequence
tgtcttgaagccccattgcgccta

SEQ ID NO: 701 - DNA, 24 bp, Artificial Sequence
  Description of Artificial Sequence:  Hypothetical Probe Sequence
tgtcaatccagcgtgctgcgtgcg

SEQ ID NO: 702 - DNA, 24 bp, Artificial Sequence
  Description of Artificial Sequence:  Hypothetical Probe Sequence
tgtcaatcacggagcccacgggac

SEQ ID NO: 703 - DNA, 24 bp, Artificial Sequence
  Description of Artificial Sequence:  Hypothetical Probe Sequence
tgtcaatcagccagcccagctccc

SEQ ID NO: 704 - DNA, 24 bp, Artificial Sequence
  Description of Artificial Sequence:  Hypothetical Probe Sequence
tgtcaaagccatacggcagcgatg

SEQ ID NO: 705 - DNA, 24 bp, Artificial Sequence
  Description of Artificial Sequence:  Hypothetical Probe Sequence
tgtcaaagcagccacgtgattgcg

SEQ ID NO: 706 - DNA, 24 bp, Artificial Sequence
  Description of Artificial Sequence:  Hypothetical Probe Sequence
tgtctgtccgaaggaccagctccc

SEQ ID NO: 707 - DNA, 24 bp, Artificial Sequence
  Description of Artificial Sequence:  Hypothetical Probe Sequence
tgtctgtcgcaaagccaaagtccc

SEQ ID NO: 708 - DNA, 24 bp, Artificial Sequence
  Description of Artificial Sequence:  Hypothetical Probe Sequence
tgtctcgtcacgtgcggacctgcg

SEQ ID NO: 709 - DNA, 24 bp, Artificial Sequence
  Description of Artificial Sequence:  Hypothetical Probe Sequence
tgtctcgtacggcgttttgatgcg

SEQ ID NO: 710 - DNA, 24 bp, Artificial Sequence
  Description of Artificial Sequence:  Hypothetical Probe Sequence
tgtccttgctcaatcggtgcgtgc

SEQ ID NO: 711 - DNA, 24 bp, Artificial Sequence
  Description of Artificial Sequence:  Hypothetical Probe Sequence
tgtccttgcacgttaggacccgaa

SEQ ID NO: 712 - DNA, 24 bp, Artificial Sequence
  Description of Artificial Sequence:  Hypothetical Probe Sequence
tgtccttggacccgaagtgcccta

SEQ ID NO: 713 - DNA, 24 bp, Artificial Sequence
  Description of Artificial Sequence:  Hypothetical Probe Sequence
tgtccgttaccttcccgaccgacc

SEQ ID NO: 714 - DNA, 24 bp, Artificial Sequence
  Description of Artificial Sequence:  Hypothetical Probe Sequence
tgtcctcagcaatgtcggacagcc

SEQ ID NO: 715 - DNA, 24 bp, Artificial Sequence
  Description of Artificial Sequence:  Hypothetical Probe Sequence
tgtcctcatcccacctcacgagcc

SEQ ID NO: 716 - DNA, 24 bp, Artificial Sequence
  Description of Artificial Sequence:  Hypothetical Probe Sequence
tgtcctgtacggaatcagccgacc

SEQ ID NO: 717 - DNA, 24 bp, Artificial Sequence
  Description of Artificial Sequence:  Hypothetical Probe Sequence
tgtcccatcttggacccagcacgg

SEQ ID NO: 718 - DNA, 24 bp, Artificial Sequence
  Description of Artificial Sequence:  Hypothetical Probe Sequence
tgtcccatcgaaaatccgaaccat

SEQ ID NO: 719 - DNA, 24 bp, Artificial Sequence
  Description of Artificial Sequence:  Hypothetical Probe Sequence
tgtcccatgcaaaggaaggagcaa

SEQ ID NO: 720 - DNA, 24 bp, Artificial Sequence
  Description of Artificial Sequence:  Hypothetical Probe Sequence
tgtcccatcctacgttgtgcgcaa

SEQ ID NO: 721 - DNA, 24 bp, Artificial Sequence
  Description of Artificial Sequence:  Hypothetical Probe Sequence
tgtcccatgatggcaagtgccagc

SEQ ID NO: 722 - DNA, 24 bp, Artificial Sequence
  Description of Artificial Sequence:  Hypothetical Probe Sequence
tgtcccatcagcacgggatgagga

SEQ ID NO: 723 - DNA, 24 bp, Artificial Sequence
  Description of Artificial Sequence:  Hypothetical Probe Sequence
tgtcccatagccatactgcggtgc

SEQ ID NO: 724 - DNA, 24 bp, Artificial Sequence
  Description of Artificial Sequence:  Hypothetical Probe Sequence
tgtccgaacgttgcttggacgatg

SEQ ID NO: 725 - DNA, 24 bp, Artificial Sequence
  Description of Artificial Sequence:  Hypothetical Probe Sequence
tgtccgaagcttcttgggacggta

SEQ ID NO: 726 - DNA, 24 bp, Artificial Sequence
  Description of Artificial Sequence:  Hypothetical Probe Sequence
tgtccgaaacctcgaatgcgagtg

SEQ ID NO: 727 - DNA, 24 bp, Artificial Sequence
  Description of Artificial Sequence:  Hypothetical Probe Sequence
tgtccgaaaggaaggaggacgcaa

SEQ ID NO: 728 - DNA, 24 bp, Artificial Sequence
  Description of Artificial Sequence:  Hypothetical Probe Sequence
tgtccgaacctactcatccccacg

SEQ ID NO: 729 - DNA, 24 bp, Artificial Sequence
  Description of Artificial Sequence:  Hypothetical Probe Sequence
tgtccgaacagcggacaaagagcc

SEQ ID NO: 730 - DNA, 24 bp, Artificial Sequence
  Description of Artificial Sequence:  Hypothetical Probe Sequence
tgtcgcttcgttcgttatcggcaa

SEQ ID NO: 731 - DNA, 24 bp, Artificial Sequence
  Description of Artificial Sequence:  Hypothetical Probe Sequence
tgtcgcttccatcgttgatgacgg

SEQ ID NO: 732 - DNA, 24 bp, Artificial Sequence
  Description of Artificial Sequence:  Hypothetical Probe Sequence
tgtcgcttgcttccattgtcgctt

SEQ ID NO: 733 - DNA, 24 bp, Artificial Sequence
  Description of Artificial Sequence:  Hypothetical Probe Sequence
tgtcgcttatcgacctagccgtgc

SEQ ID NO: 734 - DNA, 24 bp, Artificial Sequence
  Description of Artificial Sequence:  Hypothetical Probe Sequence
tgtcgcttaggaagccacggcttg

SEQ ID NO: 735 - DNA, 24 bp, Artificial Sequence
  Description of Artificial Sequence:  Hypothetical Probe Sequence
tgtcggtatcgttccctcccgtgc

SEQ ID NO: 736 - DNA, 24 bp, Artificial Sequence
  Description of Artificial Sequence:  Hypothetical Probe Sequence
tgtcggtagcaaacctacggcagc

SEQ ID NO: 737 - DNA, 24 bp, Artificial Sequence
  Description of Artificial Sequence:  Hypothetical Probe Sequence
tgtcggtacagccagcgcaagctt

SEQ ID NO: 738 - DNA, 24 bp, Artificial Sequence
  Description of Artificial Sequence:  Hypothetical Probe Sequence
tgtcgtcttcgtggaccgtttccc

SEQ ID NO: 739 - DNA, 24 bp, Artificial Sequence
  Description of Artificial Sequence:  Hypothetical Probe Sequence
tgtcgtctcgaatcccgaccacgg

SEQ ID NO: 740 - DNA, 24 bp, Artificial Sequence
  Description of Artificial Sequence:  Hypothetical Probe Sequence
tgtcgagtcagcagcccgaaccat

SEQ ID NO: 741 - DNA, 24 bp, Artificial Sequence
  Description of Artificial Sequence:  Hypothetical Probe Sequence
tgtcgcaattgaccatagccgacc

SEQ ID NO: 742 - DNA, 24 bp, Artificial Sequence
  Description of Artificial Sequence:  Hypothetical Probe Sequence
tgtcgcaaaatctcgtgatgtgcg

SEQ ID NO: 743 - DNA, 24 bp, Artificial Sequence
  Description of Artificial Sequence:  Hypothetical Probe Sequence
tgtcgcaatcgtgcttgatgccat

SEQ ID NO: 744 - DNA, 24 bp, Artificial Sequence
  Description of Artificial Sequence:  Hypothetical Probe Sequence
tgtcgcaagagttgcgcacgatcg

SEQ ID NO: 745 - DNA, 24 bp, Artificial Sequence
  Description of Artificial Sequence:  Hypothetical Probe Sequence
tgtcgcaaagtggtctgtgccgaa

SEQ ID NO: 746 - DNA, 24 bp, Artificial Sequence
  Description of Artificial Sequence:  Hypothetical Probe Sequence
tgtcgcaatgcggacccctatcgt

SEQ ID NO: 747 - DNA, 24 bp, Artificial Sequence
  Description of Artificial Sequence:  Hypothetical Probe Sequence
tgtcagtgcagcagccggactgcg

SEQ ID NO: 748 - DNA, 24 bp, Artificial Sequence
  Description of Artificial Sequence:  Hypothetical Probe Sequence
tgtcacctcacgcgaaacggcgtt

SEQ ID NO: 749 - DNA, 24 bp, Artificial Sequence
  Description of Artificial Sequence:  Hypothetical Probe Sequence
tgtcatcgtcgtcagcgcaaagcc

SEQ ID NO: 750 - DNA, 24 bp, Artificial Sequence
  Description of Artificial Sequence:  Hypothetical Probe Sequence
tgtcatcggatggcaaacgggtgc

SEQ ID NO: 751 - DNA, 24 bp, Artificial Sequence
  Description of Artificial Sequence:  Hypothetical Probe Sequence
tgtcatcgtgcgcagcgtgcaatc

SEQ ID NO: 752 - DNA, 24 bp, Artificial Sequence
  Description of Artificial Sequence:  Hypothetical Probe Sequence
tgtccctacagcagcccagcgtgc

SEQ ID NO: 753 - DNA, 24 bp, Artificial Sequence
  Description of Artificial Sequence:  Hypothetical Probe Sequence
tgtccctaacgggacctgcggtct

SEQ ID NO: 754 - DNA, 24 bp, Artificial Sequence
  Description of Artificial Sequence:  Hypothetical Probe Sequence
tgtcgatggtgcccatcttgccat

SEQ ID NO: 755 - DNA, 24 bp, Artificial Sequence
  Description of Artificial Sequence:  Hypothetical Probe Sequence
tgtcgatgggacgatgcgtttccc

SEQ ID NO: 756 - DNA, 24 bp, Artificial Sequence
  Description of Artificial Sequence:  Hypothetical Probe Sequence
tgtctccccgttaggattgatgcg

SEQ ID NO: 757 - DNA, 24 bp, Artificial Sequence
  Description of Artificial Sequence:  Hypothetical Probe Sequence
tgtctcccaggaggacgaccgctt

SEQ ID NO: 758 - DNA, 24 bp, Artificial Sequence
  Description of Artificial Sequence:  Hypothetical Probe Sequence
tgtctgcgttgaacgggaccacct

SEQ ID NO: 759 - DNA, 24 bp, Artificial Sequence
  Description of Artificial Sequence:  Hypothetical Probe Sequence
tgtctgcgaatcgacccagcccat

SEQ ID NO: 760 - DNA, 24 bp, Artificial Sequence
  Description of Artificial Sequence:  Hypothetical Probe Sequence
tgtctgcgaaagcagccttggctt

SEQ ID NO: 761 - DNA, 24 bp, Artificial Sequence
  Description of Artificial Sequence:  Hypothetical Probe Sequence
tgtctgcgggtacgaacctaacgg

SEQ ID NO: 762 - DNA, 24 bp, Artificial Sequence
  Description of Artificial Sequence:  Hypothetical Probe Sequence
tgtctgcgagtggcaatgcggcaa

SEQ ID NO: 763 - DNA, 24 bp, Artificial Sequence
  Description of Artificial Sequence:  Hypothetical Probe Sequence
tgtctgcgaggacgaacacgacct

SEQ ID NO: 764 - DNA, 24 bp, Artificial Sequence
  Description of Artificial Sequence:  Hypothetical Probe Sequence
tgtctgcgtgcggtgccctatgat

SEQ ID NO: 765 - DNA, 24 bp, Artificial Sequence
  Description of Artificial Sequence:  Hypothetical Probe Sequence
tgtctgcggtgccagctctggtgc

SEQ ID NO: 766 - DNA, 24 bp, Artificial Sequence
  Description of Artificial Sequence:  Hypothetical Probe Sequence
tgtccacgtcgtgacccttgccat

SEQ ID NO: 767 - DNA, 24 bp, Artificial Sequence
  Description of Artificial Sequence:  Hypothetical Probe Sequence
tgtccacgcttggacccacgttga

SEQ ID NO: 768 - DNA, 24 bp, Artificial Sequence
  Description of Artificial Sequence:  Hypothetical Probe Sequence
tgtccacggcttcctagcaacgaa

SEQ ID NO: 769 - DNA, 24 bp, Artificial Sequence
  Description of Artificial Sequence:  Hypothetical Probe Sequence
tgtccacgggtactgtcacgacgg

SEQ ID NO: 770 - DNA, 24 bp, Artificial Sequence
  Description of Artificial Sequence:  Hypothetical Probe Sequence
tgtccacggacctcgtgcttggta

SEQ ID NO: 771 - DNA, 24 bp, Artificial Sequence
  Description of Artificial Sequence:  Hypothetical Probe Sequence
tgtccagcaccttcgtacggtccc

SEQ ID NO: 772 - DNA, 24 bp, Artificial Sequence
  Description of Artificial Sequence:  Hypothetical Probe Sequence
tgtccagcgaccttgaggaccagc

SEQ ID NO: 773 - DNA, 24 bp, Artificial Sequence
  Description of Artificial Sequence:  Hypothetical Probe Sequence
tgtcgaccaatctcccgtgccttg

SEQ ID NO: 774 - DNA, 24 bp, Artificial Sequence
  Description of Artificial Sequence:  Hypothetical Probe Sequence
tgtcgaccaggactcatgcggcaa

SEQ ID NO: 775 - DNA, 24 bp, Artificial Sequence
  Description of Artificial Sequence:  Hypothetical Probe Sequence
tgtcgtgcaatcaatccacgccat

SEQ ID NO: 776 - DNA, 24 bp, Artificial Sequence
  Description of Artificial Sequence:  Hypothetical Probe Sequence
tgtcgtgctcgtgcaagaccgtct

SEQ ID NO: 777 - DNA, 24 bp, Artificial Sequence
  Description of Artificial Sequence:  Hypothetical Probe Sequence
tgtcgtgccttgctgtcacgcacg

SEQ ID NO: 778 - DNA, 24 bp, Artificial Sequence
  Description of Artificial Sequence:  Hypothetical Probe Sequence
tgtcgtgcggtatctggcaaagga

SEQ ID NO: 779 - DNA, 24 bp, Artificial Sequence
  Description of Artificial Sequence:  Hypothetical Probe Sequence
tgtcgtgcgtcttctgggacggac

SEQ ID NO: 780 - DNA, 24 bp, Artificial Sequence
  Description of Artificial Sequence:  Hypothetical Probe Sequence
tgtcgtgcacctacctgtgcggta

SEQ ID NO: 781 - DNA, 24 bp, Artificial Sequence
  Description of Artificial Sequence:  Hypothetical Probe Sequence
tgtcgtgcaggactgtcgaaacgg

SEQ ID NO: 782 - DNA, 24 bp, Artificial Sequence
  Description of Artificial Sequence:  Hypothetical Probe Sequence
tgtcgtgctccccgaaaatcctgt

SEQ ID NO: 783 - DNA, 24 bp, Artificial Sequence
  Description of Artificial Sequence:  Hypothetical Probe Sequence
tgtcggacctgtgcttagcccttg

SEQ ID NO: 784 - DNA, 24 bp, Artificial Sequence
  Description of Artificial Sequence:  Hypothetical Probe Sequence
tgtcggacgtctggtaagccgctt

SEQ ID NO: 785 - DNA, 24 bp, Artificial Sequence
  Description of Artificial Sequence:  Hypothetical Probe Sequence
tgtcggacacctcgttacggcttg

SEQ ID NO: 786 - DNA, 24 bp, Artificial Sequence
  Description of Artificial Sequence:  Hypothetical Probe Sequence
tgtcggaccctaaatcgcttcgtt

SEQ ID NO: 787 - DNA, 24 bp, Artificial Sequence
  Description of Artificial Sequence:  Hypothetical Probe Sequence
tgtcggacgatgagtgcctaagcc

SEQ ID NO: 788 - DNA, 24 bp, Artificial Sequence
  Description of Artificial Sequence:  Hypothetical Probe Sequence
tgtcggactcccgaccagtggtgc

SEQ ID NO: 789 - DNA, 24 bp, Artificial Sequence
  Description of Artificial Sequence:  Hypothetical Probe Sequence
tgtcacggttgatcccacggacct

SEQ ID NO: 790 - DNA, 24 bp, Artificial Sequence
  Description of Artificial Sequence:  Hypothetical Probe Sequence
tgtcacggcttgcgttgcaaagtg

SEQ ID NO: 791 - DNA, 24 bp, Artificial Sequence
  Description of Artificial Sequence:  Hypothetical Probe Sequence
tgtcacgggcttacctgatgccat

SEQ ID NO: 792 - DNA, 24 bp, Artificial Sequence
  Description of Artificial Sequence:  Hypothetical Probe Sequence
tgtcacgggagtaggacgtttgcg

SEQ ID NO: 793 - DNA, 24 bp, Artificial Sequence
  Description of Artificial Sequence:  Hypothetical Probe Sequence
tgtcacgggcaaaaagcgaaaaag

SEQ ID NO: 794 - DNA, 24 bp, Artificial Sequence
  Description of Artificial Sequence:  Hypothetical Probe Sequence
tgtcacggtccccttgggacagga

SEQ ID NO: 795 - DNA, 24 bp, Artificial Sequence
  Description of Artificial Sequence:  Hypothetical Probe Sequence
tgtcagccctgtataccgaatgcg

SEQ ID NO: 796 - DNA, 24 bp, Artificial Sequence
  Description of Artificial Sequence:  Hypothetical Probe Sequence
tgtcagccgcttttgacgtttcgt

SEQ ID NO: 797 - DNA, 24 bp, Artificial Sequence
  Description of Artificial Sequence:  Hypothetical Probe Sequence
tgtcagccacctgcaagatggctt

SEQ ID NO: 798 - DNA, 24 bp, Artificial Sequence
  Description of Artificial Sequence:  Hypothetical Probe Sequence
tgtcagccatcgttagcagccagc

SEQ ID NO: 799 - DNA, 24 bp, Artificial Sequence
  Description of Artificial Sequence:  Hypothetical Probe Sequence
tgtcagccgaccgctttcgttctg

SEQ ID NO: 800 - DNA, 24 bp, Artificial Sequence
  Description of Artificial Sequence:  Hypothetical Probe Sequence
tcgttgatgcttcttggtgcgctt

SEQ ID NO: 801 - DNA, 24 bp, Artificial Sequence
  Description of Artificial Sequence:  Hypothetical Probe Sequence
tcgtttagggacagccagccacgg

SEQ ID NO: 802 - DNA, 24 bp, Artificial Sequence
  Description of Artificial Sequence:  Hypothetical Probe Sequence
tcgtaatccacgcgttggtaacgg

SEQ ID NO: 803 - DNA, 24 bp, Artificial Sequence
  Description of Artificial Sequence:  Hypothetical Probe Sequence
tcgtaaagggacaggatccctgcg

SEQ ID NO: 804 - DNA, 24 bp, Artificial Sequence
  Description of Artificial Sequence:  Hypothetical Probe Sequence
tcgtaaagagccaaagcacgccat

SEQ ID NO: 805 - DNA, 24 bp, Artificial Sequence
  Description of Artificial Sequence:  Hypothetical Probe Sequence
tcgttctgtgcgcgaagtgcttga

SEQ ID NO: 806 - DNA, 24 bp, Artificial Sequence
  Description of Artificial Sequence:  Hypothetical Probe Sequence
tcgttctgcacgatacgaccgctt

SEQ ID NO: 807 - DNA, 24 bp, Artificial Sequence
  Description of Artificial Sequence:  Hypothetical Probe Sequence
tcgttgtccgttgagttgcgagga

SEQ ID NO: 808 - DNA, 24 bp, Artificial Sequence
  Description of Artificial Sequence:  Hypothetical Probe Sequence
tcgttgtcctcaacggtgcggctt

SEQ ID NO: 809 - DNA, 24 bp, Artificial Sequence
  Description of Artificial Sequence:  Hypothetical Probe Sequence
tcgttgtcgagttgcgcttggacc

SEQ ID NO: 810 - DNA, 24 bp, Artificial Sequence
  Description of Artificial Sequence:  Hypothetical Probe Sequence
tcgttgtccacgagcccgttacct

SEQ ID NO: 811 - DNA, 24 bp, Artificial Sequence
  Description of Artificial Sequence:  Hypothetical Probe Sequence
tcgttgtcacggtcgtgcaaagga

SEQ ID NO: 812 - DNA, 24 bp, Artificial Sequence
  Description of Artificial Sequence:  Hypothetical Probe Sequence
tcgttcgtggtatgcgcctaatcg

SEQ ID NO: 813 - DNA, 24 bp, Artificial Sequence
  Description of Artificial Sequence:  Hypothetical Probe Sequence
tcgttcgttgcgatcgtacatgcg

SEQ ID NO: 814 - DNA, 24 bp, Artificial Sequence
  Description of Artificial Sequence:  Hypothetical Probe Sequence
tcgtcttgcgttcttgcttgcagc

SEQ ID NO: 815 - DNA, 24 bp, Artificial Sequence
  Description of Artificial Sequence:  Hypothetical Probe Sequence
tcgtcttgtcccggactcccgagt

SEQ ID NO: 816 - DNA, 24 bp, Artificial Sequence
  Description of Artificial Sequence:  Hypothetical Probe Sequence
tcgtcttggaccagccacctgacc

SEQ ID NO: 817 - DNA, 24 bp, Artificial Sequence
  Description of Artificial Sequence:  Hypothetical Probe Sequence
tcgtcttgagccagccatacacgg

SEQ ID NO: 818 - DNA, 24 bp, Artificial Sequence
  Description of Artificial Sequence:  Hypothetical Probe Sequence
tcgtcgtttgatgcaacagcgtgc

SEQ ID NO: 819 - DNA, 24 bp, Artificial Sequence
  Description of Artificial Sequence:  Hypothetical Probe Sequence
tcgtcgtttgtcaatcgtgcgtgc

SEQ ID NO: 820 - DNA, 24 bp, Artificial Sequence
  Description of Artificial Sequence:  Hypothetical Probe Sequence
tcgtcgttcgaaggtagcaatgcg

SEQ ID NO: 821 - DNA, 24 bp, Artificial Sequence
  Description of Artificial Sequence:  Hypothetical Probe Sequence
tcgtcgttacctcgttcgaatgcg

SEQ ID NO: 822 - DNA, 24 bp, Artificial Sequence
  Description of Artificial Sequence:  Hypothetical Probe Sequence
tcgtcgttgacccacgcacgagtg

SEQ ID NO: 823 - DNA, 24 bp, Artificial Sequence
  Description of Artificial Sequence:  Hypothetical Probe Sequence
tcgtcgttagccagccttgaccat

SEQ ID NO: 824 - DNA, 24 bp, Artificial Sequence
  Description of Artificial Sequence:  Hypothetical Probe Sequence
tcgtctcacagcgtgccgttcgtt

SEQ ID NO: 825 - DNA, 24 bp, Artificial Sequence
  Description of Artificial Sequence:  Hypothetical Probe Sequence
tcgtctcaagccttaggtgccacg

SEQ ID NO: 826 - DNA, 24 bp, Artificial Sequence
  Description of Artificial Sequence:  Hypothetical Probe Sequence
tcgtctgtagcccagctgcggctt

SEQ ID NO: 827 - DNA, 24 bp, Artificial Sequence
  Description of Artificial Sequence:  Hypothetical Probe Sequence
tcgtccatctcaagccccatgcaa

SEQ ID NO: 828 - DNA, 24 bp, Artificial Sequence
  Description of Artificial Sequence:  Hypothetical Probe Sequence
tcgtccatcagcggtaacgggacc

SEQ ID NO: 829 - DNA, 24 bp, Artificial Sequence
  Description of Artificial Sequence:  Hypothetical Probe Sequence
tcgtccatgacccacgcttgcttg

SEQ ID NO: 830 - DNA, 24 bp, Artificial Sequence
  Description of Artificial Sequence:  Hypothetical Probe Sequence
tcgtcgaaaatcacggtgtcgctt

SEQ ID NO: 831 - DNA, 24 bp, Artificial Sequence
  Description of Artificial Sequence:  Hypothetical Probe Sequence
tcgtcgaaaaaggaccacggagga

SEQ ID NO: 832 - DNA, 24 bp, Artificial Sequence
  Description of Artificial Sequence:  Hypothetical Probe Sequence
tcgtcgaatctgtgcgggaccacg

SEQ ID NO: 833 - DNA, 24 bp, Artificial Sequence
  Description of Artificial Sequence:  Hypothetical Probe Sequence
tcgtcgaaaccttcccggacctgt

SEQ ID NO: 834 - DNA, 24 bp, Artificial Sequence
  Description of Artificial Sequence:  Hypothetical Probe Sequence
tcgtcgaaaggaatcggatggatg

SEQ ID NO: 835 - DNA, 24 bp, Artificial Sequence
  Description of Artificial Sequence:  Hypothetical Probe Sequence
tcgtcgaagtgcgcaatcccagtg

SEQ ID NO: 836 - DNA, 24 bp, Artificial Sequence
  Description of Artificial Sequence:  Hypothetical Probe Sequence
tcgtgcttctcagacctgcgagga

SEQ ID NO: 837 - DNA, 24 bp, Artificial Sequence
  Description of Artificial Sequence:  Hypothetical Probe Sequence
tcgtggtaagcccacggagtcagc

SEQ ID NO: 838 - DNA, 24 bp, Artificial Sequence
  Description of Artificial Sequence:  Hypothetical Probe Sequence
tcgtgtctcgtttcccacggagcc

SEQ ID NO: 839 - DNA, 24 bp, Artificial Sequence
  Description of Artificial Sequence:  Hypothetical Probe Sequence
tcgtgtctgcaaagccagccgtgc

SEQ ID NO: 840 - DNA, 24 bp, Artificial Sequence
  Description of Artificial Sequence:  Hypothetical Probe Sequence
tcgtgtctgtgcatcgtgcgggac

SEQ ID NO: 841 - DNA, 24 bp, Artificial Sequence
  Description of Artificial Sequence:  Hypothetical Probe Sequence
tcgtgagttcgtcagcggacgacc

SEQ ID NO: 842 - DNA, 24 bp, Artificial Sequence
  Description of Artificial Sequence:  Hypothetical Probe Sequence
tcgtgagtccattgcggtcttccc

SEQ ID NO: 843 - DNA, 24 bp, Artificial Sequence
  Description of Artificial Sequence:  Hypothetical Probe Sequence
tcgtgcaattgatgtcgtgcatcg

SEQ ID NO: 844 - DNA, 24 bp, Artificial Sequence
  Description of Artificial Sequence:  Hypothetical Probe Sequence
tcgtgcaagcttcttggatggacc

SEQ ID NO: 845 - DNA, 24 bp, Artificial Sequence
  Description of Artificial Sequence:  Hypothetical Probe Sequence
tcgtgcaatgcggtgctcgttctg

SEQ ID NO: 846 - DNA, 24 bp, Artificial Sequence
  Description of Artificial Sequence:  Hypothetical Probe Sequence
tcgtgcaaggacagcctcgttgat

SEQ ID NO: 847 - DNA, 24 bp, Artificial Sequence
  Description of Artificial Sequence:  Hypothetical Probe Sequence
tcgtagtgtgcgggtaacgggtgc

SEQ ID NO: 848 - DNA, 24 bp, Artificial Sequence
  Description of Artificial Sequence:  Hypothetical Probe Sequence
tcgtagtggtgcgatggtgcgtgc

SEQ ID NO: 849 - DNA, 24 bp, Artificial Sequence
  Description of Artificial Sequence:  Hypothetical Probe Sequence
tcgtacctcagcacggacggggac

SEQ ID NO: 850 - DNA, 24 bp, Artificial Sequence
  Description of Artificial Sequence:  Hypothetical Probe Sequence
tcgtatcggcttatcgcacgtgtc

SEQ ID NO: 851 - DNA, 24 bp, Artificial Sequence
  Description of Artificial Sequence:  Hypothetical Probe Sequence
tcgtatcgggacgacctcccagga

SEQ ID NO: 852 - DNA, 24 bp, Artificial Sequence
  Description of Artificial Sequence:  Hypothetical Probe Sequence
tcgtaggagacctctgagccagcc

SEQ ID NO: 853 - DNA, 24 bp, Artificial Sequence
  Description of Artificial Sequence:  Hypothetical Probe Sequence
tcgtaggaagccccatccatgtgc

SEQ ID NO: 854 - DNA, 24 bp, Artificial Sequence
  Description of Artificial Sequence:  Hypothetical Probe Sequence
tcgtcctaaaagtgcgtgcgagcc

SEQ ID NO: 855 - DNA, 24 bp, Artificial Sequence
  Description of Artificial Sequence:  Hypothetical Probe Sequence
tcgtgatgagccgcaacagcctca

SEQ ID NO: 856 - DNA, 24 bp, Artificial Sequence
  Description of Artificial Sequence:  Hypothetical Probe Sequence
tcgttcccctgtttagcgaaagga

SEQ ID NO: 857 - DNA, 24 bp, Artificial Sequence
  Description of Artificial Sequence:  Hypothetical Probe Sequence
tcgttcccccataaaggtgcacct

SEQ ID NO: 858 - DNA, 24 bp, Artificial Sequence
  Description of Artificial Sequence:  Hypothetical Probe Sequence
tcgttcccgtctgcaacctagcaa

SEQ ID NO: 859 - DNA, 24 bp, Artificial Sequence
  Description of Artificial Sequence:  Hypothetical Probe Sequence
tcgttcccgagtccatcttggcaa

SEQ ID NO: 860 - DNA, 24 bp, Artificial Sequence
  Description of Artificial Sequence:  Hypothetical Probe Sequence
tcgttccctgcgtcgtacggtctg

SEQ ID NO: 861 - DNA, 24 bp, Artificial Sequence
  Description of Artificial Sequence:  Hypothetical Probe Sequence
tcgttcccggactgtcgtgcctgt

SEQ ID NO: 862 - DNA, 24 bp, Artificial Sequence
  Description of Artificial Sequence:  Hypothetical Probe Sequence
tcgttgcgaatcaatcgcaaccat

SEQ ID NO: 863 - DNA, 24 bp, Artificial Sequence
  Description of Artificial Sequence:  Hypothetical Probe Sequence
tcgttgcgtcgtagtggagttgcg

SEQ ID NO: 864 - DNA, 24 bp, Artificial Sequence
  Description of Artificial Sequence:  Hypothetical Probe Sequence
tcgttgcgctcattgatgcgaatc

SEQ ID NO: 865 - DNA, 24 bp, Artificial Sequence
  Description of Artificial Sequence:  Hypothetical Probe Sequence
tcgttgcggagtggtagacccacg

SEQ ID NO: 866 - DNA, 24 bp, Artificial Sequence
  Description of Artificial Sequence:  Hypothetical Probe Sequence
tcgttgcgagtgaaagcgaattga

SEQ ID NO: 867 - DNA, 24 bp, Artificial Sequence
  Description of Artificial Sequence:  Hypothetical Probe Sequence
tcgttgcggatgggtaggacagcc

SEQ ID NO: 868 - DNA, 24 bp, Artificial Sequence
  Description of Artificial Sequence:  Hypothetical Probe Sequence
tcgttgcgcagctgtccacgtctg

SEQ ID NO: 869 - DNA, 24 bp, Artificial Sequence
  Description of Artificial Sequence:  Hypothetical Probe Sequence
tcgttgcggaccaaaggtgcagtg

SEQ ID NO: 870 - DNA, 24 bp, Artificial Sequence
  Description of Artificial Sequence:  Hypothetical Probe Sequence
tcgttgcgagccaatctcgtagcc

SEQ ID NO: 871 - DNA, 24 bp, Artificial Sequence
  Description of Artificial Sequence:  Hypothetical Probe Sequence
tcgtcacgaaagatacacggcagc

SEQ ID NO: 872 - DNA, 24 bp, Artificial Sequence
  Description of Artificial Sequence:  Hypothetical Probe Sequence
tcgtcacgtctgtccctgcgagcc

SEQ ID NO: 873 - DNA, 24 bp, Artificial Sequence
  Description of Artificial Sequence:  Hypothetical Probe Sequence
tcgtcacgcttgctcacagctccc

SEQ ID NO: 874 - DNA, 24 bp, Artificial Sequence
  Description of Artificial Sequence:  Hypothetical Probe Sequence
tcgtcacgcgtttctgggtagcaa

SEQ ID NO: 875 - DNA, 24 bp, Artificial Sequence
  Description of Artificial Sequence:  Hypothetical Probe Sequence
tcgtcacgctgtagcccctaggac

SEQ ID NO: 876 - DNA, 24 bp, Artificial Sequence
  Description of Artificial Sequence:  Hypothetical Probe Sequence
tcgtcacgccatgatggatgcttg

SEQ ID NO: 877 - DNA, 24 bp, Artificial Sequence
  Description of Artificial Sequence:  Hypothetical Probe Sequence
tcgtcacggcaatacagaccggac

SEQ ID NO: 878 - DNA, 24 bp, Artificial Sequence
  Description of Artificial Sequence:  Hypothetical Probe Sequence
tcgtcacgagtgaaaggcttgtgc

SEQ ID NO: 879 - DNA, 24 bp, Artificial Sequence
  Description of Artificial Sequence:  Hypothetical Probe Sequence
tcgtcacgatcgtctgacggccta

SEQ ID NO: 880 - DNA, 24 bp, Artificial Sequence
  Description of Artificial Sequence:  Hypothetical Probe Sequence
tcgtcacgacgggatgacggtcgt

SEQ ID NO: 881 - DNA, 24 bp, Artificial Sequence
  Description of Artificial Sequence:  Hypothetical Probe Sequence
tcgtcagcctcatgtcagccgtct

SEQ ID NO: 882 - DNA, 24 bp, Artificial Sequence
  Description of Artificial Sequence:  Hypothetical Probe Sequence
tcgtcagcccatgacctgtcagcc

SEQ ID NO: 883 - DNA, 24 bp, Artificial Sequence
  Description of Artificial Sequence:  Hypothetical Probe Sequence
tcgtcagcggtattgaggaccgtt

SEQ ID NO: 884 - DNA, 24 bp, Artificial Sequence
  Description of Artificial Sequence:  Hypothetical Probe Sequence
tcgtcagcgagtagtgcagcgtgc

SEQ ID NO: 885 - DNA, 24 bp, Artificial Sequence
  Description of Artificial Sequence:  Hypothetical Probe Sequence
tcgtcagcgaccgagttcgttccc

SEQ ID NO: 886 - DNA, 24 bp, Artificial Sequence
  Description of Artificial Sequence:  Hypothetical Probe Sequence
tcgtgaccaatccgttggactgcg

SEQ ID NO: 887 - DNA, 24 bp, Artificial Sequence
  Description of Artificial Sequence:  Hypothetical Probe Sequence
tcgtgaccaaagcttgagccgtgc

SEQ ID NO: 888 - DNA, 24 bp, Artificial Sequence
  Description of Artificial Sequence:  Hypothetical Probe Sequence
tcgtgacccgttaccttctgacgg

SEQ ID NO: 889 - DNA, 24 bp, Artificial Sequence
  Description of Artificial Sequence:  Hypothetical Probe Sequence
tcgtgaccctgtttgaagccgctt

SEQ ID NO: 890 - DNA, 24 bp, Artificial Sequence
  Description of Artificial Sequence:  Hypothetical Probe Sequence
tcgtgaccgcttccatgagttccc

SEQ ID NO: 891 - DNA, 24 bp, Artificial Sequence
  Description of Artificial Sequence:  Hypothetical Probe Sequence
tcgtgaccgtctggacgtgcgacc

SEQ ID NO: 892 - DNA, 24 bp, Artificial Sequence
  Description of Artificial Sequence:  Hypothetical Probe Sequence
tcgtgaccatcgtcgtaggatgcg

SEQ ID NO: 893 - DNA, 24 bp, Artificial Sequence
  Description of Artificial Sequence:  Hypothetical Probe Sequence
tcgtgtgcaatctctgccatcagc

SEQ ID NO: 894 - DNA, 24 bp, Artificial Sequence
  Description of Artificial Sequence:  Hypothetical Probe Sequence
tcgtgtgctctgccatagccgcaa

SEQ ID NO: 895 - DNA, 24 bp, Artificial Sequence
  Description of Artificial Sequence:  Hypothetical Probe Sequence
tcgtgtgctgtcgcaatcccgatg

SEQ ID NO: 896 - DNA, 24 bp, Artificial Sequence
  Description of Artificial Sequence:  Hypothetical Probe Sequence
tcgtgtgccttgataccacgcagc

SEQ ID NO: 897 - DNA, 24 bp, Artificial Sequence
  Description of Artificial Sequence:  Hypothetical Probe Sequence
tcgtgtgcctgtgcttccatatcg

SEQ ID NO: 898 - DNA, 24 bp, Artificial Sequence
  Description of Artificial Sequence:  Hypothetical Probe Sequence
tcgtgtgcggtaacctacggacgg

SEQ ID NO: 899 - DNA, 24 bp, Artificial Sequence
  Description of Artificial Sequence:  Hypothetical Probe Sequence
tcgtgtgcgtctggacagtgcgtt

SEQ ID NO: 900 - DNA, 24 bp, Artificial Sequence
  Description of Artificial Sequence:  Hypothetical Probe Sequence
tcgtgtgcgagtcacgaggagtgc

SEQ ID NO: 901 - DNA, 24 bp, Artificial Sequence
  Description of Artificial Sequence:  Hypothetical Probe Sequence
tcgtgtgcgcaaaaagagcctctg

SEQ ID NO: 902 - DNA, 24 bp, Artificial Sequence
  Description of Artificial Sequence:  Hypothetical Probe Sequence
tcgtggacttgatccctgcgcgtt

SEQ ID NO: 903 - DNA, 24 bp, Artificial Sequence
  Description of Artificial Sequence:  Hypothetical Probe Sequence
tcgtggacaatccagcgacccgtt

SEQ ID NO: 904 - DNA, 24 bp, Artificial Sequence
  Description of Artificial Sequence:  Hypothetical Probe Sequence
tcgtggacaaaggcaagtgccgaa

SEQ ID NO: 905 - DNA, 24 bp, Artificial Sequence
  Description of Artificial Sequence:  Hypothetical Probe Sequence
tcgtggaccttggaccgtctacgg

SEQ ID NO: 906 - DNA, 24 bp, Artificial Sequence
  Description of Artificial Sequence:  Hypothetical Probe Sequence
tcgtggacctgttgcgcctaaaag

SEQ ID NO: 907 - DNA, 24 bp, Artificial Sequence
  Description of Artificial Sequence:  Hypothetical Probe Sequence
tcgtggacgagttctggtgcgacc

SEQ ID NO: 908 - DNA, 24 bp, Artificial Sequence
  Description of Artificial Sequence:  Hypothetical Probe Sequence
tcgtggacgatgcctacagcccat

SEQ ID NO: 909 - DNA, 24 bp, Artificial Sequence
  Description of Artificial Sequence:  Hypothetical Probe Sequence
tcgtggactccctcccatacagcc

SEQ ID NO: 910 - DNA, 24 bp, Artificial Sequence
  Description of Artificial Sequence:  Hypothetical Probe Sequence
tcgtggactgcggtgcctcagacc

SEQ ID NO: 911 - DNA, 24 bp, Artificial Sequence
  Description of Artificial Sequence:  Hypothetical Probe Sequence
tcgtggaccacgttagatcggcaa

SEQ ID NO: 912 - DNA, 24 bp, Artificial Sequence
  Description of Artificial Sequence:  Hypothetical Probe Sequence
tcgtggacagccccatagtgcgaa

SEQ ID NO: 913 - DNA, 24 bp, Artificial Sequence
  Description of Artificial Sequence:  Hypothetical Probe Sequence
tcgtacggtcgttctgatcgcgtt

SEQ ID NO: 914 - DNA, 24 bp, Artificial Sequence
  Description of Artificial Sequence:  Hypothetical Probe Sequence
tcgtacggccatggtatcgtgcaa

SEQ ID NO: 915 - DNA, 24 bp, Artificial Sequence
  Description of Artificial Sequence:  Hypothetical Probe Sequence
tcgtacggcctaatcgctcaatcg

SEQ ID NO: 916 - DNA, 24 bp, Artificial Sequence
  Description of Artificial Sequence:  Hypothetical Probe Sequence
tcgtagccttgacagcgcaaccta

SEQ ID NO: 917 - DNA, 24 bp, Artificial Sequence
  Description of Artificial Sequence:  Hypothetical Probe Sequence
tcgtagcctgtcggtaagcctgcg

SEQ ID NO: 918 - DNA, 24 bp, Artificial Sequence
  Description of Artificial Sequence:  Hypothetical Probe Sequence
tcgtagcctcgtaggactgttgcg

SEQ ID NO: 919 - DNA, 24 bp, Artificial Sequence
  Description of Artificial Sequence:  Hypothetical Probe Sequence
tcgtagcccgtttctgttgatgcg

SEQ ID NO: 920 - DNA, 24 bp, Artificial Sequence
  Description of Artificial Sequence:  Hypothetical Probe Sequence
tcgtagccccatgagtgaccccat

SEQ ID NO: 921 - DNA, 24 bp, Artificial Sequence
  Description of Artificial Sequence:  Hypothetical Probe Sequence
tcgtagcctgcgatactccccacg

SEQ ID NO: 922 - DNA, 24 bp, Artificial Sequence
  Description of Artificial Sequence:  Hypothetical Probe Sequence
cttgttgaagccgaccggtaacgg

SEQ ID NO: 923 - DNA, 24 bp, Artificial Sequence
  Description of Artificial Sequence:  Hypothetical Probe Sequence
cttgaatcgaccacgggtgcacgg

SEQ ID NO: 924 - DNA, 24 bp, Artificial Sequence
  Description of Artificial Sequence:  Hypothetical Probe Sequence
cttgaaagtcccggaccgaatgcg

SEQ ID NO: 925 - DNA, 24 bp, Artificial Sequence
  Description of Artificial Sequence:  Hypothetical Probe Sequence
cttgtctgcacggacccctatgcg

SEQ ID NO: 926 - DNA, 24 bp, Artificial Sequence
  Description of Artificial Sequence:  Hypothetical Probe Sequence
cttgcttgacctgcaaacggttga

SEQ ID NO: 927 - DNA, 24 bp, Artificial Sequence
  Description of Artificial Sequence:  Hypothetical Probe Sequence
cttgcttgatcgttagtgcgacgg

SEQ ID NO: 928 - DNA, 24 bp, Artificial Sequence
  Description of Artificial Sequence:  Hypothetical Probe Sequence
cttgcttgcctacttgcacggcaa

SEQ ID NO: 929 - DNA, 24 bp, Artificial Sequence
  Description of Artificial Sequence:  Hypothetical Probe Sequence
cttgcttggatgggacatcgcgaa

SEQ ID NO: 930 - DNA, 24 bp, Artificial Sequence
  Description of Artificial Sequence:  Hypothetical Probe Sequence
cttgcgttttgaagccggtaacgg

SEQ ID NO: 931 - DNA, 24 bp, Artificial Sequence
  Description of Artificial Sequence:  Hypothetical Probe Sequence
cttgcgttaccttgcggaccacct

SEQ ID NO: 932 - DNA, 24 bp, Artificial Sequence
  Description of Artificial Sequence:  Hypothetical Probe Sequence
cttgctcacacgggacaggaagcc

SEQ ID NO: 933 - DNA, 24 bp, Artificial Sequence
  Description of Artificial Sequence:  Hypothetical Probe Sequence
cttgctcagtgccagcgaccacgg

SEQ ID NO: 934 - DNA, 24 bp, Artificial Sequence
  Description of Artificial Sequence:  Hypothetical Probe Sequence
cttgctgtgcaagtgccgttacgg

SEQ ID NO: 935 - DNA, 24 bp, Artificial Sequence
  Description of Artificial Sequence:  Hypothetical Probe Sequence
cttgccatccatcacggcaaccat

SEQ ID NO: 936 - DNA, 24 bp, Artificial Sequence
  Description of Artificial Sequence:  Hypothetical Probe Sequence
cttgccatgcttagtggtgcagcc

SEQ ID NO: 937 - DNA, 24 bp, Artificial Sequence
  Description of Artificial Sequence:  Hypothetical Probe Sequence
cttgcgaattgaatcggtgcccta

SEQ ID NO: 938 - DNA, 24 bp, Artificial Sequence
  Description of Artificial Sequence:  Hypothetical Probe Sequence
cttgcgaagcttcctaggacgctt

SEQ ID NO: 939 - DNA, 24 bp, Artificial Sequence
  Description of Artificial Sequence:  Hypothetical Probe Sequence
cttggcttccatcacgtcccagtg

SEQ ID NO: 940 - DNA, 24 bp, Artificial Sequence
  Description of Artificial Sequence:  Hypothetical Probe Sequence
cttggcttgtcttcccgaccggac

SEQ ID NO: 941 - DNA, 24 bp, Artificial Sequence
  Description of Artificial Sequence:  Hypothetical Probe Sequence
cttggcttcagcggacctgttccc

SEQ ID NO: 942 - DNA, 24 bp, Artificial Sequence
  Description of Artificial Sequence:  Hypothetical Probe Sequence
cttggcttgtgccttgcttggctt

SEQ ID NO: 943 - DNA, 24 bp, Artificial Sequence
  Description of Artificial Sequence:  Hypothetical Probe Sequence
cttggcttacggcgttagccagga

SEQ ID NO: 944 - DNA, 24 bp, Artificial Sequence
  Description of Artificial Sequence:  Hypothetical Probe Sequence
cttggtcttcgtcctatcccacgg

SEQ ID NO: 945 - DNA, 24 bp, Artificial Sequence
  Description of Artificial Sequence:  Hypothetical Probe Sequence
cttggtctcacggcaagacccagc

SEQ ID NO: 946 - DNA, 24 bp, Artificial Sequence
  Description of Artificial Sequence:  Hypothetical Probe Sequence
cttggcaagctttgattcccccat

SEQ ID NO: 947 - DNA, 24 bp, Artificial Sequence
  Description of Artificial Sequence:  Hypothetical Probe Sequence
cttggcaagagtggacaggatgcg

SEQ ID NO: 948 - DNA, 24 bp, Artificial Sequence
  Description of Artificial Sequence:  Hypothetical Probe Sequence
cttggcaaacctttagcacgcgtt

SEQ ID NO: 949 - DNA, 24 bp, Artificial Sequence
  Description of Artificial Sequence:  Hypothetical Probe Sequence
cttggcaaatcgaaaggatggctt

SEQ ID NO: 950 - DNA, 24 bp, Artificial Sequence
  Description of Artificial Sequence:  Hypothetical Probe Sequence
cttggcaaaggaagccctgttcgt

SEQ ID NO: 951 - DNA, 24 bp, Artificial Sequence
  Description of Artificial Sequence:  Hypothetical Probe Sequence
cttggcaagaccagccgtgcgacc

SEQ ID NO: 952 - DNA, 24 bp, Artificial Sequence
  Description of Artificial Sequence:  Hypothetical Probe Sequence
cttgagtgcgaagaccatcgacgg

SEQ ID NO: 953 - DNA, 24 bp, Artificial Sequence
  Description of Artificial Sequence:  Hypothetical Probe Sequence
cttgacctgtgcggacagcccgaa

SEQ ID NO: 954 - DNA, 24 bp, Artificial Sequence
  Description of Artificial Sequence:  Hypothetical Probe Sequence
cttgaggatgcgacctcagcggac

SEQ ID NO: 955 - DNA, 24 bp, Artificial Sequence
  Description of Artificial Sequence:  Hypothetical Probe Sequence
cttgaggacacgagcccagccgaa

SEQ ID NO: 956 - DNA, 24 bp, Artificial Sequence
  Description of Artificial Sequence:  Hypothetical Probe Sequence
cttgcctaatcgaggatgcggtct

SEQ ID NO: 957 - DNA, 24 bp, Artificial Sequence
  Description of Artificial Sequence:  Hypothetical Probe Sequence
cttgcctaacggtcccaatcctca

SEQ ID NO: 958 - DNA, 24 bp, Artificial Sequence
  Description of Artificial Sequence:  Hypothetical Probe Sequence
cttggatgtcgtgaccagcctctg

SEQ ID NO: 959 - DNA, 24 bp, Artificial Sequence
  Description of Artificial Sequence:  Hypothetical Probe Sequence
cttggatgcttgcagcagccccta

SEQ ID NO: 960 - DNA, 24 bp, Artificial Sequence
  Description of Artificial Sequence:  Hypothetical Probe Sequence
cttggatgcgttgcttgaccgagt

SEQ ID NO: 961 - DNA, 24 bp, Artificial Sequence
  Description of Artificial Sequence:  Hypothetical Probe Sequence
cttggatgctgttcgtcagccgaa

SEQ ID NO: 962 - DNA, 24 bp, Artificial Sequence
  Description of Artificial Sequence:  Hypothetical Probe Sequence
cttggatggcaaagccgagtgctt

SEQ ID NO: 963 - DNA, 24 bp, Artificial Sequence
  Description of Artificial Sequence:  Hypothetical Probe Sequence
cttgtcccctgtcttgagccccat

SEQ ID NO: 964 - DNA, 24 bp, Artificial Sequence
  Description of Artificial Sequence:  Hypothetical Probe Sequence
cttgtcccacgggcaattgaatcg

SEQ ID NO: 965 - DNA, 24 bp, Artificial Sequence
  Description of Artificial Sequence:  Hypothetical Probe Sequence
cttgtgcgtgtccagcgtgctccc

SEQ ID NO: 966 - DNA, 24 bp, Artificial Sequence
  Description of Artificial Sequence:  Hypothetical Probe Sequence
cttgtgcgtcgtttgacagccagc

SEQ ID NO: 967 - DNA, 24 bp, Artificial Sequence
  Description of Artificial Sequence:  Hypothetical Probe Sequence
cttgtgcgtgcgccattctgctgt

SEQ ID NO: 968 - DNA, 24 bp, Artificial Sequence
  Description of Artificial Sequence:  Hypothetical Probe Sequence
cttgtgcgcagcagtgcacgaatc

SEQ ID NO: 969 - DNA, 24 bp, Artificial Sequence
  Description of Artificial Sequence:  Hypothetical Probe Sequence
cttgcacgaatctctggaccgtgc

SEQ ID NO: 970 - DNA, 24 bp, Artificial Sequence
  Description of Artificial Sequence:  Hypothetical Probe Sequence
cttgcacgcttgttgagcaatcgt

SEQ ID NO: 971 - DNA, 24 bp, Artificial Sequence
  Description of Artificial Sequence:  Hypothetical Probe Sequence
cttgcacgagtggcaaagcccttg

SEQ ID NO: 972 - DNA, 24 bp, Artificial Sequence
  Description of Artificial Sequence:  Hypothetical Probe Sequence
cttgcacgaggacctacacgccat

SEQ ID NO: 973 - DNA, 24 bp, Artificial Sequence
  Description of Artificial Sequence:  Hypothetical Probe Sequence
cttgcagctgatacgggcaaggac

SEQ ID NO: 974 - DNA, 24 bp, Artificial Sequence
  Description of Artificial Sequence:  Hypothetical Probe Sequence
cttgcagcaatcgtgcatcgagcc

SEQ ID NO: 975 - DNA, 24 bp, Artificial Sequence
  Description of Artificial Sequence:  Hypothetical Probe Sequence
cttgcagcctcaggtatcccccat

SEQ ID NO: 976 - DNA, 24 bp, Artificial Sequence
  Description of Artificial Sequence:  Hypothetical Probe Sequence
cttgcagcggtaatcgtgcgtgtc

SEQ ID NO: 977 - DNA, 24 bp, Artificial Sequence
  Description of Artificial Sequence:  Hypothetical Probe Sequence
cttgcagcgtctaaagacggctca

SEQ ID NO: 978 - DNA, 24 bp, Artificial Sequence
  Description of Artificial Sequence:  Hypothetical Probe Sequence
cttgcagcgacctacagtgccagc

SEQ ID NO: 979 - DNA, 24 bp, Artificial Sequence
  Description of Artificial Sequence:  Hypothetical Probe Sequence
cttggaccttgagaccacgggcaa

SEQ ID NO: 980 - DNA, 24 bp, Artificial Sequence
  Description of Artificial Sequence:  Hypothetical Probe Sequence
cttggaccaggacctaacggacgg

SEQ ID NO: 981 - DNA, 24 bp, Artificial Sequence
  Description of Artificial Sequence:  Hypothetical Probe Sequence
cttggaccggaccctagatgccat

SEQ ID NO: 982 - DNA, 24 bp, Artificial Sequence
  Description of Artificial Sequence:  Hypothetical Probe Sequence
cttggtgcggtactcaagcccttg

SEQ ID NO: 983 - DNA, 24 bp, Artificial Sequence
  Description of Artificial Sequence:  Hypothetical Probe Sequence
cttggtgcgtcttcgtgtgccgaa

SEQ ID NO: 984 - DNA, 24 bp, Artificial Sequence
  Description of Artificial Sequence:  Hypothetical Probe Sequence
cttggtgcgagtaatcgacccgtt

SEQ ID NO: 985 - DNA, 24 bp, Artificial Sequence
  Description of Artificial Sequence:  Hypothetical Probe Sequence
cttggtgcggactctgtgcgttga

SEQ ID NO: 986 - DNA, 24 bp, Artificial Sequence
  Description of Artificial Sequence:  Hypothetical Probe Sequence
cttgggacatcgaggagcttgcaa

SEQ ID NO: 987 - DNA, 24 bp, Artificial Sequence
  Description of Artificial Sequence:  Hypothetical Probe Sequence
cttgggacgacccgttgcttctca

SEQ ID NO: 988 - DNA, 24 bp, Artificial Sequence
  Description of Artificial Sequence:  Hypothetical Probe Sequence
cttgacgggagtagccacggggta

SEQ ID NO: 989 - DNA, 24 bp, Artificial Sequence
  Description of Artificial Sequence:  Hypothetical Probe Sequence
cttgacggacctcacggaccctgt

SEQ ID NO: 990 - DNA, 24 bp, Artificial Sequence
  Description of Artificial Sequence:  Hypothetical Probe Sequence
cttgacggaggatcgtagccggac

SEQ ID NO: 991 - DNA, 24 bp, Artificial Sequence
  Description of Artificial Sequence:  Hypothetical Probe Sequence
cttgacgggatgggtaaggatgcg

SEQ ID NO: 992 - DNA, 24 bp, Artificial Sequence
  Description of Artificial Sequence:  Hypothetical Probe Sequence
cttgagccttgactcatcccgcaa

SEQ ID NO: 993 - DNA, 24 bp, Artificial Sequence
  Description of Artificial Sequence:  Hypothetical Probe Sequence
cttgagcctgatagcctgcgacgg

SEQ ID NO: 994 - DNA, 24 bp, Artificial Sequence
  Description of Artificial Sequence:  Hypothetical Probe Sequence
cttgagccgagtgtgctgattgcg

SEQ ID NO: 995 - DNA, 24 bp, Artificial Sequence
  Description of Artificial Sequence:  Hypothetical Probe Sequence
cttgagcctccctgatccatacgg

SEQ ID NO: 996 - DNA, 24 bp, Artificial Sequence
  Description of Artificial Sequence:  Hypothetical Probe Sequence
cttgagcccagcggactacatgcg

SEQ ID NO: 997 - DNA, 24 bp, Artificial Sequence
  Description of Artificial Sequence:  Hypothetical Probe Sequence
cttgagccggacgagttcgtagcc

SEQ ID NO: 998 - DNA, 24 bp, Artificial Sequence
  Description of Artificial Sequence:  Hypothetical Probe Sequence
cgttttgaatcgggacgtgcagga

SEQ ID NO: 999 - DNA, 24 bp, Artificial Sequence
  Description of Artificial Sequence:  Hypothetical Probe Sequence
cgtttgatcacgctcatgcgcagc

SEQ ID NO: 1000 - DNA, 24 bp, Artificial Sequence
  Description of Artificial Sequence:  Hypothetical Probe Sequence
cgttttaggcaagatgggaccgtt

SEQ ID NO: 1001 - DNA, 24 bp, Artificial Sequence
  Description of Artificial Sequence:  Hypothetical Probe Sequence
cgttaatcgcaagctttgtcgtgc

SEQ ID NO: 1002 - DNA, 24 bp, Artificial Sequence
  Description of Artificial Sequence:  Hypothetical Probe Sequence
cgttaatctccccacgtcccgtgc

SEQ ID NO: 1003 - DNA, 24 bp, Artificial Sequence
  Description of Artificial Sequence:  Hypothetical Probe Sequence
cgttaatccacgctcaagccagcc

SEQ ID NO: 1004 - DNA, 24 bp, Artificial Sequence
  Description of Artificial Sequence:  Hypothetical Probe Sequence
cgttaaagccattcccaaagcacg

SEQ ID NO: 1005 - DNA, 24 bp, Artificial Sequence
  Description of Artificial Sequence:  Hypothetical Probe Sequence
cgtttctgcgttggtaaggagcaa

SEQ ID NO: 1006 - DNA, 24 bp, Artificial Sequence
  Description of Artificial Sequence:  Hypothetical Probe Sequence
cgtttctggcaattagcttgcgaa

SEQ ID NO: 1007 - DNA, 24 bp, Artificial Sequence
  Description of Artificial Sequence:  Hypothetical Probe Sequence
cgtttctgggacaatcgcaatccc

SEQ ID NO: 1008 - DNA, 24 bp, Artificial Sequence
  Description of Artificial Sequence:  Hypothetical Probe Sequence
cgtttctgagccggacagccaaag

SEQ ID NO: 1009 - DNA, 24 bp, Artificial Sequence
  Description of Artificial Sequence:  Hypothetical Probe Sequence
cgtttgtcccatcacgtgtctgcg

SEQ ID NO: 1010 - DNA, 24 bp, Artificial Sequence
  Description of Artificial Sequence:  Hypothetical Probe Sequence
cgtttgtcgtcttgcgggtatgcg

SEQ ID NO: 1011 - DNA, 24 bp, Artificial Sequence
  Description of Artificial Sequence:  Hypothetical Probe Sequence
cgtttgtcatcgcgttcacgtccc

SEQ ID NO: 1012 - DNA, 24 bp, Artificial Sequence
  Description of Artificial Sequence:  Hypothetical Probe Sequence
cgtttgtcgatgccataccttgcg

SEQ ID NO: 1013 - DNA, 24 bp, Artificial Sequence
  Description of Artificial Sequence:  Hypothetical Probe Sequence
cgtttcgtaaagcgaatgcgacct

SEQ ID NO: 1014 - DNA, 24 bp, Artificial Sequence
  Description of Artificial Sequence:  Hypothetical Probe Sequence
cgtttcgtggtaacggcgttatcg

SEQ ID NO: 1015 - DNA, 24 bp, Artificial Sequence
  Description of Artificial Sequence:  Hypothetical Probe Sequence
cgtttcgtacggaaagcttgccat

SEQ ID NO: 1016 - DNA, 24 bp, Artificial Sequence
  Description of Artificial Sequence:  Hypothetical Probe Sequence
cgttcttgcagccgttccatgcaa

SEQ ID NO: 1017 - DNA, 24 bp, Artificial Sequence
  Description of Artificial Sequence:  Hypothetical Probe Sequence
cgttcgttttgagcaatcccatcg

SEQ ID NO: 1018 - DNA, 24 bp, Artificial Sequence
  Description of Artificial Sequence:  Hypothetical Probe Sequence
cgttcgttaaagacggtcccgtgc

SEQ ID NO: 1019 - DNA, 24 bp, Artificial Sequence
  Description of Artificial Sequence:  Hypothetical Probe Sequence
cgttcgttcgaaaaagaggatgcg

SEQ ID NO: 1020 - DNA, 24 bp, Artificial Sequence
  Description of Artificial Sequence:  Hypothetical Probe Sequence
cgttcgttgtcttgcgtgcgctgt

SEQ ID NO: 1021 - DNA, 24 bp, Artificial Sequence
  Description of Artificial Sequence:  Hypothetical Probe Sequence
cgttctcaatcggacccacgcgaa

SEQ ID NO: 1022 - DNA, 24 bp, Artificial Sequence
  Description of Artificial Sequence:  Hypothetical Probe Sequence
cgttctcaacgggacccttgatcg

SEQ ID NO: 1023 - DNA, 24 bp, Artificial Sequence
  Description of Artificial Sequence:  Hypothetical Probe Sequence
cgttctgttcgtaggaacggacgg

SEQ ID NO: 1024 - DNA, 24 bp, Artificial Sequence
  Description of Artificial Sequence:  Hypothetical Probe Sequence
cgttccattgtcgaccagcccagc

SEQ ID NO: 1025 - DNA, 24 bp, Artificial Sequence
  Description of Artificial Sequence:  Hypothetical Probe Sequence
cgttccatccatcgaactgttgcg

SEQ ID NO: 1026 - DNA, 24 bp, Artificial Sequence
  Description of Artificial Sequence:  Hypothetical Probe Sequence
cgttccatatcgccattgcggatg

SEQ ID NO: 1027 - DNA, 24 bp, Artificial Sequence
  Description of Artificial Sequence:  Hypothetical Probe Sequence
cgttccatgatgtgatcagcgcaa

SEQ ID NO: 1028 - DNA, 24 bp, Artificial Sequence
  Description of Artificial Sequence:  Hypothetical Probe Sequence
cgttccatgaccaatcgatgcgaa

SEQ ID NO: 1029 - DNA, 24 bp, Artificial Sequence
  Description of Artificial Sequence:  Hypothetical Probe Sequence
cgttccatggacgcaaacctcgtt

SEQ ID NO: 1030 - DNA, 24 bp, Artificial Sequence
  Description of Artificial Sequence:  Hypothetical Probe Sequence
cgttccatacggagcctctgagga

SEQ ID NO: 1031 - DNA, 24 bp, Artificial Sequence
  Description of Artificial Sequence:  Hypothetical Probe Sequence
cgttcgaatcgtagccgatgctgt

SEQ ID NO: 1032 - DNA, 24 bp, Artificial Sequence
  Description of Artificial Sequence:  Hypothetical Probe Sequence
cgttcgaacttgcacggcttgacc

SEQ ID NO: 1033 - DNA, 24 bp, Artificial Sequence
  Description of Artificial Sequence:  Hypothetical Probe Sequence
cgttcgaactcagatgtcccgtgc

SEQ ID NO: 1034 - DNA, 24 bp, Artificial Sequence
  Description of Artificial Sequence:  Hypothetical Probe Sequence
cgttcgaagagttgcggcttacct

SEQ ID NO: 1035 - DNA, 24 bp, Artificial Sequence
  Description of Artificial Sequence:  Hypothetical Probe Sequence
cgttcgaaatcgtacaacggagcc

SEQ ID NO: 1036 - DNA, 24 bp, Artificial Sequence
  Description of Artificial Sequence:  Hypothetical Probe Sequence
cgttcgaagaccgacccacgggta

SEQ ID NO: 1037 - DNA, 24 bp, Artificial Sequence
  Description of Artificial Sequence:  Hypothetical Probe Sequence
cgttgcttgtctacggggacgacc

SEQ ID NO: 1038 - DNA, 24 bp, Artificial Sequence
  Description of Artificial Sequence:  Hypothetical Probe Sequence
cgttgtctcgttatcggtcttgcg

SEQ ID NO: 1039 - DNA, 24 bp, Artificial Sequence
  Description of Artificial Sequence:  Hypothetical Probe Sequence
cgttgagttcgtgcaaacgggcaa

SEQ ID NO: 1040 - DNA, 24 bp, Artificial Sequence
  Description of Artificial Sequence:  Hypothetical Probe Sequence
cgttgagtcagccgaacgtttccc

SEQ ID NO: 1041 - DNA, 24 bp, Artificial Sequence
  Description of Artificial Sequence:  Hypothetical Probe Sequence
cgttgagtggacgatgcagcaatc

SEQ ID NO: 1042 - DNA, 24 bp, Artificial Sequence
  Description of Artificial Sequence:  Hypothetical Probe Sequence
cgttgcaatgatgctttgcggtct

SEQ ID NO: 1043 - DNA, 24 bp, Artificial Sequence
  Description of Artificial Sequence:  Hypothetical Probe Sequence
cgttgcaacgaacgaaaatcgacc

SEQ ID NO: 1044 - DNA, 24 bp, Artificial Sequence
  Description of Artificial Sequence:  Hypothetical Probe Sequence
cgttgcaaggtagacctgcggacc

SEQ ID NO: 1045 - DNA, 24 bp, Artificial Sequence
  Description of Artificial Sequence:  Hypothetical Probe Sequence
cgttgcaagagtaaagtgcgcgtt

SEQ ID NO: 1046 - DNA, 24 bp, Artificial Sequence
  Description of Artificial Sequence:  Hypothetical Probe Sequence
cgttgcaaacctcctagcaaacgg

SEQ ID NO: 1047 - DNA, 24 bp, Artificial Sequence
  Description of Artificial Sequence:  Hypothetical Probe Sequence
cgttgcaacagcacctctgtagcc

SEQ ID NO: 1048 - DNA, 24 bp, Artificial Sequence
  Description of Artificial Sequence:  Hypothetical Probe Sequence
cgttgcaaagccgctttacagcaa

SEQ ID NO: 1049 - DNA, 24 bp, Artificial Sequence
  Description of Artificial Sequence:  Hypothetical Probe Sequence
cgttagtgcacgggacaccttccc

SEQ ID NO: 1050 - DNA, 24 bp, Artificial Sequence
  Description of Artificial Sequence:  Hypothetical Probe Sequence
cgttagtgcagccagcggacgctt

SEQ ID NO: 1051 - DNA, 24 bp, Artificial Sequence
  Description of Artificial Sequence:  Hypothetical Probe Sequence
cgttagtggtgccacggacccgaa

SEQ ID NO: 1052 - DNA, 24 bp, Artificial Sequence
  Description of Artificial Sequence:  Hypothetical Probe Sequence
cgttacctgacctgcgcgttgcaa

SEQ ID NO: 1053 - DNA, 24 bp, Artificial Sequence
  Description of Artificial Sequence:  Hypothetical Probe Sequence
cgttatcgctgtcagcgtgcccat

SEQ ID NO: 1054 - DNA, 24 bp, Artificial Sequence
  Description of Artificial Sequence:  Hypothetical Probe Sequence
cgttatcgggtatcgtgacccgaa

SEQ ID NO: 1055 - DNA, 24 bp, Artificial Sequence
  Description of Artificial Sequence:  Hypothetical Probe Sequence
cgttatcggacctctgggacgctt

SEQ ID NO: 1056 - DNA, 24 bp, Artificial Sequence
  Description of Artificial Sequence:  Hypothetical Probe Sequence
cgttaggatgcgtacagtgcgtgc

SEQ ID NO: 1057 - DNA, 24 bp, Artificial Sequence
  Description of Artificial Sequence:  Hypothetical Probe Sequence
cgttaggaagccggtaggactgcg

SEQ ID NO: 1058 - DNA, 24 bp, Artificial Sequence
  Description of Artificial Sequence:  Hypothetical Probe Sequence
cgttgatgcgttaatcggactccc

SEQ ID NO: 1059 - DNA, 24 bp, Artificial Sequence
  Description of Artificial Sequence:  Hypothetical Probe Sequence
cgttgatggaccgtgccctagcaa

SEQ ID NO: 1060 - DNA, 24 bp, Artificial Sequence
  Description of Artificial Sequence:  Hypothetical Probe Sequence
cgttgatgggacgacccacgagga

SEQ ID NO: 1061 - DNA, 24 bp, Artificial Sequence
  Description of Artificial Sequence:  Hypothetical Probe Sequence
cgtttcccagtgggtacacggtgc

SEQ ID NO: 1062 - DNA, 24 bp, Artificial Sequence
  Description of Artificial Sequence:  Hypothetical Probe Sequence
cgtttccccctaaatcccatcagc

SEQ ID NO: 1063 - DNA, 24 bp, Artificial Sequence
  Description of Artificial Sequence:  Hypothetical Probe Sequence
cgtttccctccctcgtcgaagatg

SEQ ID NO: 1064 - DNA, 24 bp, Artificial Sequence
  Description of Artificial Sequence:  Hypothetical Probe Sequence
cgtttccctgcgccatggtacgaa

SEQ ID NO: 1065 - DNA, 24 bp, Artificial Sequence
  Description of Artificial Sequence:  Hypothetical Probe Sequence
cgtttgcgatacagcctcccctca

SEQ ID NO: 1066 - DNA, 24 bp, Artificial Sequence
  Description of Artificial Sequence:  Hypothetical Probe Sequence
cgtttgcgcgaatgcgttagcttg

SEQ ID NO: 1067 - DNA, 24 bp, Artificial Sequence
  Description of Artificial Sequence:  Hypothetical Probe Sequence
cgtttgcggcttgtgcctcagctt

SEQ ID NO: 1068 - DNA, 24 bp, Artificial Sequence
  Description of Artificial Sequence:  Hypothetical Probe Sequence
cgtttgcggtcttacacacgcgaa

SEQ ID NO: 1069 - DNA, 24 bp, Artificial Sequence
  Description of Artificial Sequence:  Hypothetical Probe Sequence
cgtttgcgaggaatcgttagcgaa

SEQ ID NO: 1070 - DNA, 24 bp, Artificial Sequence
  Description of Artificial Sequence:  Hypothetical Probe Sequence
cgtttgcggatgccatgcttgagt

SEQ ID NO: 1071 - DNA, 24 bp, Artificial Sequence
  Description of Artificial Sequence:  Hypothetical Probe Sequence
cgtttgcgtcccttgagcttcagc

SEQ ID NO: 1072 - DNA, 24 bp, Artificial Sequence
  Description of Artificial Sequence:  Hypothetical Probe Sequence
cgtttgcgcacgcgttgctttgat

SEQ ID NO: 1073 - DNA, 24 bp, Artificial Sequence
  Description of Artificial Sequence:  Hypothetical Probe Sequence
cgttcacgtcgttgtccagcggta

SEQ ID NO: 1074 - DNA, 24 bp, Artificial Sequence
  Description of Artificial Sequence:  Hypothetical Probe Sequence
cgttcacgcttgtgatccatcgaa

SEQ ID NO: 1075 - DNA, 24 bp, Artificial Sequence
  Description of Artificial Sequence:  Hypothetical Probe Sequence
cgttcacgctgtcttgtgcgggta

SEQ ID NO: 1076 - DNA, 24 bp, Artificial Sequence
  Description of Artificial Sequence:  Hypothetical Probe Sequence
cgttcacggatgttagcgaatccc

SEQ ID NO: 1077 - DNA, 24 bp, Artificial Sequence
  Description of Artificial Sequence:  Hypothetical Probe Sequence
cgttcacgcagcgcaatcgtggta

SEQ ID NO: 1078 - DNA, 24 bp, Artificial Sequence
  Description of Artificial Sequence:  Hypothetical Probe Sequence
cgttcacggaccaaagttagtgcg

SEQ ID NO: 1079 - DNA, 24 bp, Artificial Sequence
  Description of Artificial Sequence:  Hypothetical Probe Sequence
cgttcacgacgggtctgcaagctt

SEQ ID NO: 1080 - DNA, 24 bp, Artificial Sequence
  Description of Artificial Sequence:  Hypothetical Probe Sequence
cgttcacgagcctcgtcacgccta

SEQ ID NO: 1081 - DNA, 24 bp, Artificial Sequence
  Description of Artificial Sequence:  Hypothetical Probe Sequence
cgttcagctctggaccaaagctca

SEQ ID NO: 1082 - DNA, 24 bp, Artificial Sequence
  Description of Artificial Sequence:  Hypothetical Probe Sequence
cgttcagcgcttcgtttctgccta

SEQ ID NO: 1083 - DNA, 24 bp, Artificial Sequence
  Description of Artificial Sequence:  Hypothetical Probe Sequence
cgttcagccacgcagcaggactca

SEQ ID NO: 1084 - DNA, 24 bp, Artificial Sequence
  Description of Artificial Sequence:  Hypothetical Probe Sequence
cgttcagcgtgcttgaaatcgtgc

SEQ ID NO: 1085 - DNA, 24 bp, Artificial Sequence
  Description of Artificial Sequence:  Hypothetical Probe Sequence
cgttgacctctgtccccagcgagt

SEQ ID NO: 1086 - DNA, 24 bp, Artificial Sequence
  Description of Artificial Sequence:  Hypothetical Probe Sequence
cgttgaccctgtcgaacgaatccc

SEQ ID NO: 1087 - DNA, 24 bp, Artificial Sequence
  Description of Artificial Sequence:  Hypothetical Probe Sequence
cgttgaccatcgttagcacgccta

SEQ ID NO: 1088 - DNA, 24 bp, Artificial Sequence
  Description of Artificial Sequence:  Hypothetical Probe Sequence
cgttgacctgcgctcaggtaagcc

SEQ ID NO: 1089 - DNA, 24 bp, Artificial Sequence
  Description of Artificial Sequence:  Hypothetical Probe Sequence
cgttgacccagctcccgtctagga

SEQ ID NO: 1090 - DNA, 24 bp, Artificial Sequence
  Description of Artificial Sequence:  Hypothetical Probe Sequence
cgttgtgctgtccttgcagctgcg

SEQ ID NO: 1091 - DNA, 24 bp, Artificial Sequence
  Description of Artificial Sequence:  Hypothetical Probe Sequence
cgttgtgccttgtacacagcgacc

SEQ ID NO: 1092 - DNA, 24 bp, Artificial Sequence
  Description of Artificial Sequence:  Hypothetical Probe Sequence
cgttgtgcctcaaaagtccccagc

SEQ ID NO: 1093 - DNA, 24 bp, Artificial Sequence
  Description of Artificial Sequence:  Hypothetical Probe Sequence
cgttgtgcgatgtgtcgcttcagc

SEQ ID NO: 1094 - DNA, 24 bp, Artificial Sequence
  Description of Artificial Sequence:  Hypothetical Probe Sequence
cgttgtgcgaccgtctatcgtgcg

SEQ ID NO: 1095 - DNA, 24 bp, Artificial Sequence
  Description of Artificial Sequence:  Hypothetical Probe Sequence
cgttggaccgttggaccgaatgat

SEQ ID NO: 1096 - DNA, 24 bp, Artificial Sequence
  Description of Artificial Sequence:  Hypothetical Probe Sequence
cgttggacggtacgaagcttcacg

SEQ ID NO: 1097 - DNA, 24 bp, Artificial Sequence
  Description of Artificial Sequence:  Hypothetical Probe Sequence
cgttggacaggatgtcacggcagc

SEQ ID NO: 1098 - DNA, 24 bp, Artificial Sequence
  Description of Artificial Sequence:  Hypothetical Probe Sequence
cgttggacggacttgaagtgtgcg

SEQ ID NO: 1099 - DNA, 24 bp, Artificial Sequence
  Description of Artificial Sequence:  Hypothetical Probe Sequence
cgttggacacggccatctgtgcaa

SEQ ID NO: 1100 - DNA, 24 bp, Artificial Sequence
  Description of Artificial Sequence:  Hypothetical Probe Sequence
cgttacggttgaacctggacgtgc

SEQ ID NO: 1101 - DNA, 24 bp, Artificial Sequence
  Description of Artificial Sequence:  Hypothetical Probe Sequence
cgttacggaatccttgcacgctca

SEQ ID NO: 1102 - DNA, 24 bp, Artificial Sequence
  Description of Artificial Sequence:  Hypothetical Probe Sequence
cgttacggaaaggaccgaccatcg

SEQ ID NO: 1103 - DNA, 24 bp, Artificial Sequence
  Description of Artificial Sequence:  Hypothetical Probe Sequence
cgttacggtctggaccgcaaggac

SEQ ID NO: 1104 - DNA, 24 bp, Artificial Sequence
  Description of Artificial Sequence:  Hypothetical Probe Sequence
cgttacggctgtcttgtcccgacc

SEQ ID NO: 1105 - DNA, 24 bp, Artificial Sequence
  Description of Artificial Sequence:  Hypothetical Probe Sequence
cgttacgggagtttgattgatgcg

SEQ ID NO: 1106 - DNA, 24 bp, Artificial Sequence
  Description of Artificial Sequence:  Hypothetical Probe Sequence
cgttacgggatgcagcagtgcgaa

SEQ ID NO: 1107 - DNA, 24 bp, Artificial Sequence
  Description of Artificial Sequence:  Hypothetical Probe Sequence
cgttagccttgagtgccttgcacg

SEQ ID NO: 1108 - DNA, 24 bp, Artificial Sequence
  Description of Artificial Sequence:  Hypothetical Probe Sequence
cgttagcctgattgcgcagccttg

SEQ ID NO: 1109 - DNA, 24 bp, Artificial Sequence
  Description of Artificial Sequence:  Hypothetical Probe Sequence
cgttagccgacctgtcatcgcttg

SEQ ID NO: 1110 - DNA, 24 bp, Artificial Sequence
  Description of Artificial Sequence:  Hypothetical Probe Sequence
cgttagccacggctcaaatcgacc

SEQ ID NO: 1111 - DNA, 24 bp, Artificial Sequence
  Description of Artificial Sequence:  Hypothetical Probe Sequence
ctcattgaagcctcgtacggtgcg

SEQ ID NO: 1112 - DNA, 24 bp, Artificial Sequence
  Description of Artificial Sequence:  Hypothetical Probe Sequence
ctcaaatcgcttcagcagcctgcg

SEQ ID NO: 1113 - DNA, 24 bp, Artificial Sequence
  Description of Artificial Sequence:  Hypothetical Probe Sequence
ctcaaaagcgttgtgccagcagcc

SEQ ID NO: 1114 - DNA, 24 bp, Artificial Sequence
  Description of Artificial Sequence:  Hypothetical Probe Sequence
ctcatgtctgcgcagctgcggtct

SEQ ID NO: 1115 - DNA, 24 bp, Artificial Sequence
  Description of Artificial Sequence:  Hypothetical Probe Sequence
ctcatcgtcacgggactgcggcaa

SEQ ID NO: 1116 - DNA, 24 bp, Artificial Sequence
  Description of Artificial Sequence:  Hypothetical Probe Sequence
ctcatcgtagccaggagtgccgaa

SEQ ID NO: 1117 - DNA, 24 bp, Artificial Sequence
  Description of Artificial Sequence:  Hypothetical Probe Sequence
ctcacttgagtgcgttcgtttgcg

SEQ ID NO: 1118 - DNA, 24 bp, Artificial Sequence
  Description of Artificial Sequence:  Hypothetical Probe Sequence
ctcacgtttcgtgacctgtctgcg

SEQ ID NO: 1119 - DNA, 24 bp, Artificial Sequence
  Description of Artificial Sequence:  Hypothetical Probe Sequence
ctcacgttacggcgaaaggaacgg

SEQ ID NO: 1120 - DNA, 24 bp, Artificial Sequence
  Description of Artificial Sequence:  Hypothetical Probe Sequence
ctcactcaacggcgaatgcgccat

SEQ ID NO: 1121 - DNA, 24 bp, Artificial Sequence
  Description of Artificial Sequence:  Hypothetical Probe Sequence
ctcaccatgcttggacggacacgg

SEQ ID NO: 1122 - DNA, 24 bp, Artificial Sequence
  Description of Artificial Sequence:  Hypothetical Probe Sequence
ctcaccattgcgaaaggaccctgt

SEQ ID NO: 1123 - DNA, 24 bp, Artificial Sequence
  Description of Artificial Sequence:  Hypothetical Probe Sequence
ctcacgaaatcgatcgcagctgcg

SEQ ID NO: 1124 - DNA, 24 bp, Artificial Sequence
  Description of Artificial Sequence:  Hypothetical Probe Sequence
ctcacgaacacgaggaacggtccc

SEQ ID NO: 1125 - DNA, 24 bp, Artificial Sequence
  Description of Artificial Sequence:  Hypothetical Probe Sequence
ctcacgaacagcacggcacggtgc

SEQ ID NO: 1126 - DNA, 24 bp, Artificial Sequence
  Description of Artificial Sequence:  Hypothetical Probe Sequence
ctcagcaaacggacggaaagggac

SEQ ID NO: 1127 - DNA, 24 bp, Artificial Sequence
  Description of Artificial Sequence:  Hypothetical Probe Sequence
ctcaagtggtgccgaagtgctgcg

SEQ ID NO: 1128 - DNA, 24 bp, Artificial Sequence
  Description of Artificial Sequence:  Hypothetical Probe Sequence
ctcaacctacggtgcggaccgtgc

SEQ ID NO: 1129 - DNA, 24 bp, Artificial Sequence
  Description of Artificial Sequence:  Hypothetical Probe Sequence
ctcaatcgcttggcaaacggtctg

SEQ ID NO: 1130 - DNA, 24 bp, Artificial Sequence
  Description of Artificial Sequence:  Hypothetical Probe Sequence
ctcaatcgccatcacgcgtttgat

SEQ ID NO: 1131 - DNA, 24 bp, Artificial Sequence
  Description of Artificial Sequence:  Hypothetical Probe Sequence
ctcaatcgggtagcttcagcgtgc

SEQ ID NO: 1132 - DNA, 24 bp, Artificial Sequence
  Description of Artificial Sequence:  Hypothetical Probe Sequence
ctcaatcgacgggtctggacacgg

SEQ ID NO: 1133 - DNA, 24 bp, Artificial Sequence
  Description of Artificial Sequence:  Hypothetical Probe Sequence
ctcaaggagcttcagccagccgaa

SEQ ID NO: 1134 - DNA, 24 bp, Artificial Sequence
  Description of Artificial Sequence:  Hypothetical Probe Sequence
ctcaaggacacggtgccacgacgg

SEQ ID NO: 1135 - DNA, 24 bp, Artificial Sequence
  Description of Artificial Sequence:  Hypothetical Probe Sequence
ctcatcccgcttgcaaccatgacc

SEQ ID NO: 1136 - DNA, 24 bp, Artificial Sequence
  Description of Artificial Sequence:  Hypothetical Probe Sequence
ctcatgcgaatcatcgcagccacg

SEQ ID NO: 1137 - DNA, 24 bp, Artificial Sequence
  Description of Artificial Sequence:  Hypothetical Probe Sequence
ctcatgcgtctgagcctgcggtct

SEQ ID NO: 1138 - DNA, 24 bp, Artificial Sequence
  Description of Artificial Sequence:  Hypothetical Probe Sequence
ctcatgcgctcaggaccgtttgat

SEQ ID NO: 1139 - DNA, 24 bp, Artificial Sequence
  Description of Artificial Sequence:  Hypothetical Probe Sequence
ctcatgcggtctagcccttgtcgt

SEQ ID NO: 1140 - DNA, 24 bp, Artificial Sequence
  Description of Artificial Sequence:  Hypothetical Probe Sequence
ctcatgcgtccccctacctaacgg

SEQ ID NO: 1141 - DNA, 24 bp, Artificial Sequence
  Description of Artificial Sequence:  Hypothetical Probe Sequence
ctcatgcggaccgcttgacctcgt

SEQ ID NO: 1142 - DNA, 24 bp, Artificial Sequence
  Description of Artificial Sequence:  Hypothetical Probe Sequence
ctcacacgcctaggacacggcagc

SEQ ID NO: 1143 - DNA, 24 bp, Artificial Sequence
  Description of Artificial Sequence:  Hypothetical Probe Sequence
ctcacacgcagcgtgcctcacacg

SEQ ID NO: 1144 - DNA, 24 bp, Artificial Sequence
  Description of Artificial Sequence:  Hypothetical Probe Sequence
ctcacacggaccgtctgcaatgcg

SEQ ID NO: 1145 - DNA, 24 bp, Artificial Sequence
  Description of Artificial Sequence:  Hypothetical Probe Sequence
ctcacagcatcgagccacggcgaa

SEQ ID NO: 1146 - DNA, 24 bp, Artificial Sequence
  Description of Artificial Sequence:  Hypothetical Probe Sequence
ctcacagctgcgggacaggagcaa

SEQ ID NO: 1147 - DNA, 24 bp, Artificial Sequence
  Description of Artificial Sequence:  Hypothetical Probe Sequence
ctcagaccgatggtctccattgcg

SEQ ID NO: 1148 - DNA, 24 bp, Artificial Sequence
  Description of Artificial Sequence:  Hypothetical Probe Sequence
ctcagaccgtgcgagtagcctgcg

SEQ ID NO: 1149 - DNA, 24 bp, Artificial Sequence
  Description of Artificial Sequence:  Hypothetical Probe Sequence
ctcaggacgatgcacgtcccggac

SEQ ID NO: 1150 - DNA, 24 bp, Artificial Sequence
  Description of Artificial Sequence:  Hypothetical Probe Sequence
ctcaggacggacccatagccccat

SEQ ID NO: 1151 - DNA, 24 bp, Artificial Sequence
  Description of Artificial Sequence:  Hypothetical Probe Sequence
ctcaacggccataaaggcaagacc

SEQ ID NO: 1152 - DNA, 24 bp, Artificial Sequence
  Description of Artificial Sequence:  Hypothetical Probe Sequence
ctcaacgggtctccatttgaagcc

SEQ ID NO: 1153 - DNA, 24 bp, Artificial Sequence
  Description of Artificial Sequence:  Hypothetical Probe Sequence
ctcaacggatcggacctgtccacg

SEQ ID NO: 1154 - DNA, 24 bp, Artificial Sequence
  Description of Artificial Sequence:  Hypothetical Probe Sequence
ctcaacggaggaaaagtgcggcaa

SEQ ID NO: 1155 - DNA, 24 bp, Artificial Sequence
  Description of Artificial Sequence:  Hypothetical Probe Sequence
ctcaacggcctaggacgtgcgtct

SEQ ID NO: 1156 - DNA, 24 bp, Artificial Sequence
  Description of Artificial Sequence:  Hypothetical Probe Sequence
ctcaagccttgaaatcacggcgtt

SEQ ID NO: 1157 - DNA, 24 bp, Artificial Sequence
  Description of Artificial Sequence:  Hypothetical Probe Sequence
ctcaagcctctgagcccgttccat

SEQ ID NO: 1158 - DNA, 24 bp, Artificial Sequence
  Description of Artificial Sequence:  Hypothetical Probe Sequence
ctcaagcccgttggactcccaaag

SEQ ID NO: 1159 - DNA, 24 bp, Artificial Sequence
  Description of Artificial Sequence:  Hypothetical Probe Sequence
ctcaagccggtacgaaccatagcc

SEQ ID NO: 1160 - DNA, 24 bp, Artificial Sequence
  Description of Artificial Sequence:  Hypothetical Probe Sequence
ctcaagccgatgtccctgcgttag

SEQ ID NO: 1161 - DNA, 24 bp, Artificial Sequence
  Description of Artificial Sequence:  Hypothetical Probe Sequence
ctgtcgttcgttacggcagcggac

SEQ ID NO: 1162 - DNA, 24 bp, Artificial Sequence
  Description of Artificial Sequence:  Hypothetical Probe Sequence
ctgtcgttccattccctgcgggac

SEQ ID NO: 1163 - DNA, 24 bp, Artificial Sequence
  Description of Artificial Sequence:  Hypothetical Probe Sequence
ctgtcgttcagccctatgcgcagc

SEQ ID NO: 1164 - DNA, 24 bp, Artificial Sequence
  Description of Artificial Sequence:  Hypothetical Probe Sequence
ctgtcgaacgtttgcgcagcaatc

SEQ ID NO: 1165 - DNA, 24 bp, Artificial Sequence
  Description of Artificial Sequence:  Hypothetical Probe Sequence
ctgtcgaatccccgttgaccgagt

SEQ ID NO: 1166 - DNA, 24 bp, Artificial Sequence
  Description of Artificial Sequence:  Hypothetical Probe Sequence
ctgtgcttgtgcgagtccatcacg

SEQ ID NO: 1167 - DNA, 24 bp, Artificial Sequence
  Description of Artificial Sequence:  Hypothetical Probe Sequence
ctgtgcaaccatagccggacgcaa

SEQ ID NO: 1168 - DNA, 24 bp, Artificial Sequence
  Description of Artificial Sequence:  Hypothetical Probe Sequence
ctgtgcaacgaatgtcagccacgg

SEQ ID NO: 1169 - DNA, 24 bp, Artificial Sequence
  Description of Artificial Sequence:  Hypothetical Probe Sequence
ctgtgcaagcaatctgcagccttg

SEQ ID NO: 1170 - DNA, 24 bp, Artificial Sequence
  Description of Artificial Sequence:  Hypothetical Probe Sequence
ctgtgcaagaccgcaaatcgtgcg

SEQ ID NO: 1171 - DNA, 24 bp, Artificial Sequence
  Description of Artificial Sequence:  Hypothetical Probe Sequence
ctgtgatgtgcgaatcggacgcaa

SEQ ID NO: 1172 - DNA, 24 bp, Artificial Sequence
  Description of Artificial Sequence:  Hypothetical Probe Sequence
ctgttccccttgaggaccatcacg

SEQ ID NO: 1173 - DNA, 24 bp, Artificial Sequence
  Description of Artificial Sequence:  Hypothetical Probe Sequence
ctgttcccgcttcctagtgcgacc

SEQ ID NO: 1174 - DNA, 24 bp, Artificial Sequence
  Description of Artificial Sequence:  Hypothetical Probe Sequence
ctgttcccagtgcgaatcccggac

SEQ ID NO: 1175 - DNA, 24 bp, Artificial Sequence
  Description of Artificial Sequence:  Hypothetical Probe Sequence
ctgttgcgtgtccacgcctatgcg

SEQ ID NO: 1176 - DNA, 24 bp, Artificial Sequence
  Description of Artificial Sequence:  Hypothetical Probe Sequence
ctgttgcgcgaacttgccatggta

SEQ ID NO: 1177 - DNA, 24 bp, Artificial Sequence
  Description of Artificial Sequence:  Hypothetical Probe Sequence
ctgttgcggctttcgtgcttttga

SEQ ID NO: 1178 - DNA, 24 bp, Artificial Sequence
  Description of Artificial Sequence:  Hypothetical Probe Sequence
ctgttgcggagtccatcagcgctt

SEQ ID NO: 1179 - DNA, 24 bp, Artificial Sequence
  Description of Artificial Sequence:  Hypothetical Probe Sequence
ctgttgcgaggaaaagctgttgcg

SEQ ID NO: 1180 - DNA, 24 bp, Artificial Sequence
  Description of Artificial Sequence:  Hypothetical Probe Sequence
ctgttgcgcagcacggcctaatac

SEQ ID NO: 1181 - DNA, 24 bp, Artificial Sequence
  Description of Artificial Sequence:  Hypothetical Probe Sequence
ctgtcacgctgttcccgaccagga

SEQ ID NO: 1182 - DNA, 24 bp, Artificial Sequence
  Description of Artificial Sequence:  Hypothetical Probe Sequence
ctgtcacgccataatcgtgccacg

SEQ ID NO: 1183 - DNA, 24 bp, Artificial Sequence
  Description of Artificial Sequence:  Hypothetical Probe Sequence
ctgtcacgcgaaatacgcaacgaa

SEQ ID NO: 1184 - DNA, 24 bp, Artificial Sequence
  Description of Artificial Sequence:  Hypothetical Probe Sequence
ctgtcacgggtaacggcgaagcaa

SEQ ID NO: 1185 - DNA, 24 bp, Artificial Sequence
  Description of Artificial Sequence:  Hypothetical Probe Sequence
ctgtcacggatgggacgcaacagc

SEQ ID NO: 1186 - DNA, 24 bp, Artificial Sequence
  Description of Artificial Sequence:  Hypothetical Probe Sequence
ctgtcagcatcgcgttgcaatgcg

SEQ ID NO: 1187 - DNA, 24 bp, Artificial Sequence
  Description of Artificial Sequence:  Hypothetical Probe Sequence
ctgtcagcgatgtgcggtgcccat

SEQ ID NO: 1188 - DNA, 24 bp, Artificial Sequence
  Description of Artificial Sequence:  Hypothetical Probe Sequence
ctgtcagctgcgagtgagccgtgc

SEQ ID NO: 1189 - DNA, 24 bp, Artificial Sequence
  Description of Artificial Sequence:  Hypothetical Probe Sequence
ctgtgaccgcaaatacgaccgtgc

SEQ ID NO: 1190 - DNA, 24 bp, Artificial Sequence
  Description of Artificial Sequence:  Hypothetical Probe Sequence
ctgtgacctccccagctgcgtcgt

SEQ ID NO: 1191 - DNA, 24 bp, Artificial Sequence
  Description of Artificial Sequence:  Hypothetical Probe Sequence
ctgtgacctgcgcacgccattgtc

SEQ ID NO: 1192 - DNA, 24 bp, Artificial Sequence
  Description of Artificial Sequence:  Hypothetical Probe Sequence
ctgtgacccacgacctacggcttg

SEQ ID NO: 1193 - DNA, 24 bp, Artificial Sequence
  Description of Artificial Sequence:  Hypothetical Probe Sequence
ctgtgtgcgcttccatcttgggac

SEQ ID NO: 1194 - DNA, 24 bp, Artificial Sequence
  Description of Artificial Sequence:  Hypothetical Probe Sequence
ctgtgtgctgcggatgatcggcaa

SEQ ID NO: 1195 - DNA, 24 bp, Artificial Sequence
  Description of Artificial Sequence:  Hypothetical Probe Sequence
ctgtgtgcggactgatcacgtgcg

SEQ ID NO: 1196 - DNA, 24 bp, Artificial Sequence
  Description of Artificial Sequence:  Hypothetical Probe Sequence
ctgtggacggacatacggacgctt

SEQ ID NO: 1197 - DNA, 24 bp, Artificial Sequence
  Description of Artificial Sequence:  Hypothetical Probe Sequence
ctgtggacagccctcacacgtgcg

SEQ ID NO: 1198 - DNA, 24 bp, Artificial Sequence
  Description of Artificial Sequence:  Hypothetical Probe Sequence
ctgtacggcttggaccgtgcgatg

SEQ ID NO: 1199 - DNA, 24 bp, Artificial Sequence
  Description of Artificial Sequence:  Hypothetical Probe Sequence
ctgtacggacctacgggaccacgg

SEQ ID NO: 1200 - DNA, 24 bp, Artificial Sequence
  Description of Artificial Sequence:  Hypothetical Probe Sequence
ctgtagcctcgtgcttcacgcgaa

SEQ ID NO: 1201 - DNA, 24 bp, Artificial Sequence
  Description of Artificial Sequence:  Hypothetical Probe Sequence
ctgtagccgcttatcgtgtctgcg

SEQ ID NO: 1202 - DNA, 24 bp, Artificial Sequence
  Description of Artificial Sequence:  Hypothetical Probe Sequence
ctgtagccgtcttgcgggacgtgc

SEQ ID NO: 1203 - DNA, 24 bp, Artificial Sequence
  Description of Artificial Sequence:  Hypothetical Probe Sequence
ctgtagcctcccaaagctcaacgg

SEQ ID NO: 1204 - DNA, 24 bp, Artificial Sequence
  Description of Artificial Sequence:  Hypothetical Probe Sequence
ctgtagccgacctctgcttgcagc

SEQ ID NO: 1205 - DNA, 24 bp, Artificial Sequence
  Description of Artificial Sequence:  Hypothetical Probe Sequence
ccatttgaggaccgaacacgacgg

SEQ ID NO: 1206 - DNA, 24 bp, Artificial Sequence
  Description of Artificial Sequence:  Hypothetical Probe Sequence
ccattgatgaccggaccacggcaa

SEQ ID NO: 1207 - DNA, 24 bp, Artificial Sequence
  Description of Artificial Sequence:  Hypothetical Probe Sequence
ccatttaggaccaaagccattgcg

SEQ ID NO: 1208 - DNA, 24 bp, Artificial Sequence
  Description of Artificial Sequence:  Hypothetical Probe Sequence
ccataatccgttgcttgtgcccat

SEQ ID NO: 1209 - DNA, 24 bp, Artificial Sequence
  Description of Artificial Sequence:  Hypothetical Probe Sequence
ccataatctcccccatcacgcgaa

SEQ ID NO: 1210 - DNA, 24 bp, Artificial Sequence
  Description of Artificial Sequence:  Hypothetical Probe Sequence
ccataatcagcccgaatccctccc

SEQ ID NO: 1211 - DNA, 24 bp, Artificial Sequence
  Description of Artificial Sequence:  Hypothetical Probe Sequence
ccataaagcttgcagcatcggcaa

SEQ ID NO: 1212 - DNA, 24 bp, Artificial Sequence
  Description of Artificial Sequence:  Hypothetical Probe Sequence
ccataaagacggcgaagacccgtt

SEQ ID NO: 1213 - DNA, 24 bp, Artificial Sequence
  Description of Artificial Sequence:  Hypothetical Probe Sequence
ccattctgaggatgcgggacggac

SEQ ID NO: 1214 - DNA, 24 bp, Artificial Sequence
  Description of Artificial Sequence:  Hypothetical Probe Sequence
ccattctgagcctgtcatcgcgaa

SEQ ID NO: 1215 - DNA, 24 bp, Artificial Sequence
  Description of Artificial Sequence:  Hypothetical Probe Sequence
ccattgtcatcgccatgaccgtgc

SEQ ID NO: 1216 - DNA, 24 bp, Artificial Sequence
  Description of Artificial Sequence:  Hypothetical Probe Sequence
ccattgtctgcgccatcgttggac

SEQ ID NO: 1217 - DNA, 24 bp, Artificial Sequence
  Description of Artificial Sequence:  Hypothetical Probe Sequence
ccattgtcacggccatgatggacc

SEQ ID NO: 1218 - DNA, 24 bp, Artificial Sequence
  Description of Artificial Sequence:  Hypothetical Probe Sequence
ccattcgtgctttacaagccacgg

SEQ ID NO: 1219 - DNA, 24 bp, Artificial Sequence
  Description of Artificial Sequence:  Hypothetical Probe Sequence
ccatcttgcgaattaggtgctccc

SEQ ID NO: 1220 - DNA, 24 bp, Artificial Sequence
  Description of Artificial Sequence:  Hypothetical Probe Sequence
ccatcgttctcatccctgcgtgcg

SEQ ID NO: 1221 - DNA, 24 bp, Artificial Sequence
  Description of Artificial Sequence:  Hypothetical Probe Sequence
ccatcgttgcaaatacatcgtgcg

SEQ ID NO: 1222 - DNA, 24 bp, Artificial Sequence
  Description of Artificial Sequence:  Hypothetical Probe Sequence
ccatcgttacctagccaccttgcg

SEQ ID NO: 1223 - DNA, 24 bp, Artificial Sequence
  Description of Artificial Sequence:  Hypothetical Probe Sequence
ccatcgttatcgtgcgaaagctca

SEQ ID NO: 1224 - DNA, 24 bp, Artificial Sequence
  Description of Artificial Sequence:  Hypothetical Probe Sequence
ccatcgttgaccgcttaggatgcg

SEQ ID NO: 1225 - DNA, 24 bp, Artificial Sequence
  Description of Artificial Sequence:  Hypothetical Probe Sequence
ccatcgttgtgccctaggacggac

SEQ ID NO: 1226 - DNA, 24 bp, Artificial Sequence
  Description of Artificial Sequence:  Hypothetical Probe Sequence
ccatctcaacggcacgagcctgat

SEQ ID NO: 1227 - DNA, 24 bp, Artificial Sequence
  Description of Artificial Sequence:  Hypothetical Probe Sequence
ccatctgttcgtgcaatcgttgcg

SEQ ID NO: 1228 - DNA, 24 bp, Artificial Sequence
  Description of Artificial Sequence:  Hypothetical Probe Sequence
ccatctgttcccggtacacgtccc

SEQ ID NO: 1229 - DNA, 24 bp, Artificial Sequence
  Description of Artificial Sequence:  Hypothetical Probe Sequence
ccatctgtgtgcgtgcgatgtgcg

SEQ ID NO: 1230 - DNA, 24 bp, Artificial Sequence
  Description of Artificial Sequence:  Hypothetical Probe Sequence
ccatccatcctacagctgcgcagc

SEQ ID NO: 1231 - DNA, 24 bp, Artificial Sequence
  Description of Artificial Sequence:  Hypothetical Probe Sequence
ccatccatggacgacctgcgacct

SEQ ID NO: 1232 - DNA, 24 bp, Artificial Sequence
  Description of Artificial Sequence:  Hypothetical Probe Sequence
ccatcgaatcgtcgttgatggcaa

SEQ ID NO: 1233 - DNA, 24 bp, Artificial Sequence
  Description of Artificial Sequence:  Hypothetical Probe Sequence
ccatcgaacgttcacgagtgcagc

SEQ ID NO: 1234 - DNA, 24 bp, Artificial Sequence
  Description of Artificial Sequence:  Hypothetical Probe Sequence
ccatcgaacgaacctacgaatgcg

SEQ ID NO: 1235 - DNA, 24 bp, Artificial Sequence
  Description of Artificial Sequence:  Hypothetical Probe Sequence
ccatcgaaaccttgtcgaccacgg

SEQ ID NO: 1236 - DNA, 24 bp, Artificial Sequence
  Description of Artificial Sequence:  Hypothetical Probe Sequence
ccatcgaacagcccattcgtcacg

SEQ ID NO: 1237 - DNA, 24 bp, Artificial Sequence
  Description of Artificial Sequence:  Hypothetical Probe Sequence
ccatgcttctcaacggcagcatcg

SEQ ID NO: 1238 - DNA, 24 bp, Artificial Sequence
  Description of Artificial Sequence:  Hypothetical Probe Sequence
ccatgcttaggaaggaatcgcgtt

SEQ ID NO: 1239 - DNA, 24 bp, Artificial Sequence
  Description of Artificial Sequence:  Hypothetical Probe Sequence
ccatgcttcagctacatcccgtgc

SEQ ID NO: 1240 - DNA, 24 bp, Artificial Sequence
  Description of Artificial Sequence:  Hypothetical Probe Sequence
ccatgcttgacccgaagcttcagc

SEQ ID NO: 1241 - DNA, 24 bp, Artificial Sequence
  Description of Artificial Sequence:  Hypothetical Probe Sequence
ccatgcttgtgcgaccgaccttga

SEQ ID NO: 1242 - DNA, 24 bp, Artificial Sequence
  Description of Artificial Sequence:  Hypothetical Probe Sequence
ccatggtagcttgcaaatcgcgaa

SEQ ID NO: 1243 - DNA, 24 bp, Artificial Sequence
  Description of Artificial Sequence:  Hypothetical Probe Sequence
ccatggtacagctgcgacggggta

SEQ ID NO: 1244 - DNA, 24 bp, Artificial Sequence
  Description of Artificial Sequence:  Hypothetical Probe Sequence
ccatggtagtgcacggagccgtgc

SEQ ID NO: 1245 - DNA, 24 bp, Artificial Sequence
  Description of Artificial Sequence:  Hypothetical Probe Sequence
ccatgtctcacgtgcgcttgtccc

SEQ ID NO: 1246 - DNA, 24 bp, Artificial Sequence
  Description of Artificial Sequence:  Hypothetical Probe Sequence
ccatgcaatcgtgcaaatcgagga

SEQ ID NO: 1247 - DNA, 24 bp, Artificial Sequence
  Description of Artificial Sequence:  Hypothetical Probe Sequence
ccatgcaacgaatcccaatcccta

SEQ ID NO: 1248 - DNA, 24 bp, Artificial Sequence
  Description of Artificial Sequence:  Hypothetical Probe Sequence
ccatgcaagtcttcccagccggac

SEQ ID NO: 1249 - DNA, 24 bp, Artificial Sequence
  Description of Artificial Sequence:  Hypothetical Probe Sequence
ccatgcaagagttccccagccacg

SEQ ID NO: 1250 - DNA, 24 bp, Artificial Sequence
  Description of Artificial Sequence:  Hypothetical Probe Sequence
ccatgcaaatcgttagggacgtgc

SEQ ID NO: 1251 - DNA, 24 bp, Artificial Sequence
  Description of Artificial Sequence:  Hypothetical Probe Sequence
ccatgcaacacgatcgatcggatg

SEQ ID NO: 1252 - DNA, 24 bp, Artificial Sequence
  Description of Artificial Sequence:  Hypothetical Probe Sequence
ccatgcaagacccgttagccccta

SEQ ID NO: 1253 - DNA, 24 bp, Artificial Sequence
  Description of Artificial Sequence:  Hypothetical Probe Sequence
ccatgcaaggacgagttccctctg

SEQ ID NO: 1254 - DNA, 24 bp, Artificial Sequence
  Description of Artificial Sequence:  Hypothetical Probe Sequence
ccatgcaaagccctcagcaagtgc

SEQ ID NO: 1255 - DNA, 24 bp, Artificial Sequence
  Description of Artificial Sequence:  Hypothetical Probe Sequence
ccatagtggacccttgctgttgcg

SEQ ID NO: 1256 - DNA, 24 bp, Artificial Sequence
  Description of Artificial Sequence:  Hypothetical Probe Sequence
ccataccttcccataccagctgcg

SEQ ID NO: 1257 - DNA, 24 bp, Artificial Sequence
  Description of Artificial Sequence:  Hypothetical Probe Sequence
ccatatcgggtatctggaccacgg

SEQ ID NO: 1258 - DNA, 24 bp, Artificial Sequence
  Description of Artificial Sequence:  Hypothetical Probe Sequence
ccatatcggagtgatgtgcgggac

SEQ ID NO: 1259 - DNA, 24 bp, Artificial Sequence
  Description of Artificial Sequence:  Hypothetical Probe Sequence
ccatatcgtccccgttcacgagga

SEQ ID NO: 1260 - DNA, 24 bp, Artificial Sequence
  Description of Artificial Sequence:  Hypothetical Probe Sequence
ccataggaaggatccccacgcacg

SEQ ID NO: 1261 - DNA, 24 bp, Artificial Sequence
  Description of Artificial Sequence:  Hypothetical Probe Sequence
ccatgatgcgttcagcgtctagcc

SEQ ID NO: 1262 - DNA, 24 bp, Artificial Sequence
  Description of Artificial Sequence:  Hypothetical Probe Sequence
ccatgatgatcggatggtgcacgg

SEQ ID NO: 1263 - DNA, 24 bp, Artificial Sequence
  Description of Artificial Sequence:  Hypothetical Probe Sequence
ccatgatgcctaggacgacccttg

SEQ ID NO: 1264 - DNA, 24 bp, Artificial Sequence
  Description of Artificial Sequence:  Hypothetical Probe Sequence
ccatgatgtcccgatgcgaacagc

SEQ ID NO: 1265 - DNA, 24 bp, Artificial Sequence
  Description of Artificial Sequence:  Hypothetical Probe Sequence
ccatgatgcagccacgccatctgt

SEQ ID NO: 1266 - DNA, 24 bp, Artificial Sequence
  Description of Artificial Sequence:  Hypothetical Probe Sequence
ccattcccttagcgttcagcccat

SEQ ID NO: 1267 - DNA, 24 bp, Artificial Sequence
  Description of Artificial Sequence:  Hypothetical Probe Sequence
ccattcccctcaacgggatgtctg

SEQ ID NO: 1268 - DNA, 24 bp, Artificial Sequence
  Description of Artificial Sequence:  Hypothetical Probe Sequence
ccattcccacctagtgcacgccat

SEQ ID NO: 1269 - DNA, 24 bp, Artificial Sequence
  Description of Artificial Sequence:  Hypothetical Probe Sequence
ccattgcgtgataatccttggcaa

SEQ ID NO: 1270 - DNA, 24 bp, Artificial Sequence
  Description of Artificial Sequence:  Hypothetical Probe Sequence
ccattgcgttagcgtttcccggta

SEQ ID NO: 1271 - DNA, 24 bp, Artificial Sequence
  Description of Artificial Sequence:  Hypothetical Probe Sequence
ccattgcgtgtcggtaaaagtgcg

SEQ ID NO: 1272 - DNA, 24 bp, Artificial Sequence
  Description of Artificial Sequence:  Hypothetical Probe Sequence
ccattgcgtcgtaaagtcccatcg

SEQ ID NO: 1273 - DNA, 24 bp, Artificial Sequence
  Description of Artificial Sequence:  Hypothetical Probe Sequence
ccattgcgaggacacggagtgtgc

SEQ ID NO: 1274 - DNA, 24 bp, Artificial Sequence
  Description of Artificial Sequence:  Hypothetical Probe Sequence
ccattgcgtgcgaatccagcagtg

SEQ ID NO: 1275 - DNA, 24 bp, Artificial Sequence
  Description of Artificial Sequence:  Hypothetical Probe Sequence
ccattgcgcacggcaagagtcgaa

SEQ ID NO: 1276 - DNA, 24 bp, Artificial Sequence
  Description of Artificial Sequence:  Hypothetical Probe Sequence
ccattgcggacccacgtctggatg

SEQ ID NO: 1277 - DNA, 24 bp, Artificial Sequence
  Description of Artificial Sequence:  Hypothetical Probe Sequence
ccattgcggtgcggaccgttagtg

SEQ ID NO: 1278 - DNA, 24 bp, Artificial Sequence
  Description of Artificial Sequence:  Hypothetical Probe Sequence
ccattgcgacggccatatcgacct

SEQ ID NO: 1279 - DNA, 24 bp, Artificial Sequence
  Description of Artificial Sequence:  Hypothetical Probe Sequence
ccatcacgttgaagcctgcggctt

SEQ ID NO: 1280 - DNA, 24 bp, Artificial Sequence
  Description of Artificial Sequence:  Hypothetical Probe Sequence
ccatcacgtctggcaatcccagcc

SEQ ID NO: 1281 - DNA, 24 bp, Artificial Sequence
  Description of Artificial Sequence:  Hypothetical Probe Sequence
ccatcacgagtgaccttcccccat

SEQ ID NO: 1282 - DNA, 24 bp, Artificial Sequence
  Description of Artificial Sequence:  Hypothetical Probe Sequence
ccatcacgatcggcttttgatgcg

SEQ ID NO: 1283 - DNA, 24 bp, Artificial Sequence
  Description of Artificial Sequence:  Hypothetical Probe Sequence
ccatcacgtgcgaaagatcgagcc

SEQ ID NO: 1284 - DNA, 24 bp, Artificial Sequence
  Description of Artificial Sequence:  Hypothetical Probe Sequence
ccatcacggaccgagtgctttgcg

SEQ ID NO: 1285 - DNA, 24 bp, Artificial Sequence
  Description of Artificial Sequence:  Hypothetical Probe Sequence
ccatcacgagccgatgagtgcacg

SEQ ID NO: 1286 - DNA, 24 bp, Artificial Sequence
  Description of Artificial Sequence:  Hypothetical Probe Sequence
ccatcagcttgatcccccatcagc

SEQ ID NO: 1287 - DNA, 24 bp, Artificial Sequence
  Description of Artificial Sequence:  Hypothetical Probe Sequence
ccatcagccttgggaccgttctca

SEQ ID NO: 1288 - DNA, 24 bp, Artificial Sequence
  Description of Artificial Sequence:  Hypothetical Probe Sequence
ccatcagccgttttagtcccccat

SEQ ID NO: 1289 - DNA, 24 bp, Artificial Sequence
  Description of Artificial Sequence:  Hypothetical Probe Sequence
ccatcagcagtggcaagtgcagcc

SEQ ID NO: 1290 - DNA, 24 bp, Artificial Sequence
  Description of Artificial Sequence:  Hypothetical Probe Sequence
ccatcagcacctttagtgcggacc

SEQ ID NO: 1291 - DNA, 24 bp, Artificial Sequence
  Description of Artificial Sequence:  Hypothetical Probe Sequence
ccatcagctcccaggagaccccta

SEQ ID NO: 1292 - DNA, 24 bp, Artificial Sequence
  Description of Artificial Sequence:  Hypothetical Probe Sequence
ccatgaccgagtaggaacggtgcg

SEQ ID NO: 1293 - DNA, 24 bp, Artificial Sequence
  Description of Artificial Sequence:  Hypothetical Probe Sequence
ccatgaccaggaaatctcccgacc

SEQ ID NO: 1294 - DNA, 24 bp, Artificial Sequence
  Description of Artificial Sequence:  Hypothetical Probe Sequence
ccatgaccgatgcttggcttcgaa

SEQ ID NO: 1295 - DNA, 24 bp, Artificial Sequence
  Description of Artificial Sequence:  Hypothetical Probe Sequence
ccatgacctcccggtagtcttgcg

SEQ ID NO: 1296 - DNA, 24 bp, Artificial Sequence
  Description of Artificial Sequence:  Hypothetical Probe Sequence
ccatgaccagccgagtgcaatccc

SEQ ID NO: 1297 - DNA, 24 bp, Artificial Sequence
  Description of Artificial Sequence:  Hypothetical Probe Sequence
ccatgtgctgatacctgtgcgcaa

SEQ ID NO: 1298 - DNA, 24 bp, Artificial Sequence
  Description of Artificial Sequence:  Hypothetical Probe Sequence
ccatgtgcaatctgcgacgggacc

SEQ ID NO: 1299 - DNA, 24 bp, Artificial Sequence
  Description of Artificial Sequence:  Hypothetical Probe Sequence
ccatgtgctctgcgttggacgctt

SEQ ID NO: 1300 - DNA, 24 bp, Artificial Sequence
  Description of Artificial Sequence:  Hypothetical Probe Sequence
ccatgtgcctgtcgtttgtcacgg

SEQ ID NO: 1301 - DNA, 24 bp, Artificial Sequence
  Description of Artificial Sequence:  Hypothetical Probe Sequence
ccatgtgcgcttcgttaatcccat

SEQ ID NO: 1302 - DNA, 24 bp, Artificial Sequence
  Description of Artificial Sequence:  Hypothetical Probe Sequence
ccatgtgcatcgggtaaccttccc

SEQ ID NO: 1303 - DNA, 24 bp, Artificial Sequence
  Description of Artificial Sequence:  Hypothetical Probe Sequence
ccatgtgcaggaatactccccgtt

SEQ ID NO: 1304 - DNA, 24 bp, Artificial Sequence
  Description of Artificial Sequence:  Hypothetical Probe Sequence
ccatgtgctgcgggactctggacc

SEQ ID NO: 1305 - DNA, 24 bp, Artificial Sequence
  Description of Artificial Sequence:  Hypothetical Probe Sequence
ccatgtgcgacccctacctatgcg

SEQ ID NO: 1306 - DNA, 24 bp, Artificial Sequence
  Description of Artificial Sequence:  Hypothetical Probe Sequence
ccatgtgcagcccacgaaagctca

SEQ ID NO: 1307 - DNA, 24 bp, Artificial Sequence
  Description of Artificial Sequence:  Hypothetical Probe Sequence
ccatggacggtactcatgcgatcg

SEQ ID NO: 1308 - DNA, 24 bp, Artificial Sequence
  Description of Artificial Sequence:  Hypothetical Probe Sequence
ccatggacaggacacgaggacgaa

SEQ ID NO: 1309 - DNA, 24 bp, Artificial Sequence
  Description of Artificial Sequence:  Hypothetical Probe Sequence
ccatggaccacggtctcacgggac

SEQ ID NO: 1310 - DNA, 24 bp, Artificial Sequence
  Description of Artificial Sequence:  Hypothetical Probe Sequence
ccatggacgtgccagcttgagcaa

SEQ ID NO: 1311 - DNA, 24 bp, Artificial Sequence
  Description of Artificial Sequence:  Hypothetical Probe Sequence
ccatacggaatcgcaatgcgagcc

SEQ ID NO: 1312 - DNA, 24 bp, Artificial Sequence
  Description of Artificial Sequence:  Hypothetical Probe Sequence
ccatacggtctggcaaagccgcaa

SEQ ID NO: 1313 - DNA, 24 bp, Artificial Sequence
  Description of Artificial Sequence:  Hypothetical Probe Sequence
ccatacggcttgcctatcccggta

SEQ ID NO: 1314 - DNA, 24 bp, Artificial Sequence
  Description of Artificial Sequence:  Hypothetical Probe Sequence
ccatacgggcaatctgagtgcacg

SEQ ID NO: 1315 - DNA, 24 bp, Artificial Sequence
  Description of Artificial Sequence:  Hypothetical Probe Sequence
ccatacgggaccctgtagccggta

SEQ ID NO: 1316 - DNA, 24 bp, Artificial Sequence
  Description of Artificial Sequence:  Hypothetical Probe Sequence
ccatacgggtgctcgtccatcgtt

SEQ ID NO: 1317 - DNA, 24 bp, Artificial Sequence
  Description of Artificial Sequence:  Hypothetical Probe Sequence
ccatagccgtgcgcaacgaacttg

SEQ ID NO: 1318 - DNA, 24 bp, Artificial Sequence
  Description of Artificial Sequence:  Hypothetical Probe Sequence
cgaatgattgcgccattgatgcaa

SEQ ID NO: 1319 - DNA, 24 bp, Artificial Sequence
  Description of Artificial Sequence:  Hypothetical Probe Sequence
cgaatgatcacgctgtacgggcaa

SEQ ID NO: 1320 - DNA, 24 bp, Artificial Sequence
  Description of Artificial Sequence:  Hypothetical Probe Sequence
cgaaaatccacgacggttgacacg

SEQ ID NO: 1321 - DNA, 24 bp, Artificial Sequence
  Description of Artificial Sequence:  Hypothetical Probe Sequence
cgaaaatcgtgcctgttgcggtct

SEQ ID NO: 1322 - DNA, 24 bp, Artificial Sequence
  Description of Artificial Sequence:  Hypothetical Probe Sequence
cgaaaatcggacttgatgcgcttg

SEQ ID NO: 1323 - DNA, 24 bp, Artificial Sequence
  Description of Artificial Sequence:  Hypothetical Probe Sequence
cgaaatacgctttcccgcaatgcg

SEQ ID NO: 1324 - DNA, 24 bp, Artificial Sequence
  Description of Artificial Sequence:  Hypothetical Probe Sequence
cgaaaaagcgaaatcgttgatgcg

SEQ ID NO: 1325 - DNA, 24 bp, Artificial Sequence
  Description of Artificial Sequence:  Hypothetical Probe Sequence
cgaaaaagtccctgcggagtttga

SEQ ID NO: 1326 - DNA, 24 bp, Artificial Sequence
  Description of Artificial Sequence:  Hypothetical Probe Sequence
cgaaaaagcacgaaagccatagcc

SEQ ID NO: 1327 - DNA, 24 bp, Artificial Sequence
  Description of Artificial Sequence:  Hypothetical Probe Sequence
cgaaaaagcagcggacctcaagga

SEQ ID NO: 1328 - DNA, 24 bp, Artificial Sequence
  Description of Artificial Sequence:  Hypothetical Probe Sequence
cgaaaaaggtgccacgcagctgtc

SEQ ID NO: 1329 - DNA, 24 bp, Artificial Sequence
  Description of Artificial Sequence:  Hypothetical Probe Sequence
cgaaaaagagccgtgcctcagtgc

SEQ ID NO: 1330 - DNA, 24 bp, Artificial Sequence
  Description of Artificial Sequence:  Hypothetical Probe Sequence
cgaatctgtcgttgcgcgaaagcc

SEQ ID NO: 1331 - DNA, 24 bp, Artificial Sequence
  Description of Artificial Sequence:  Hypothetical Probe Sequence
cgaatctgccataggagaccacgg

SEQ ID NO: 1332 - DNA, 24 bp, Artificial Sequence
  Description of Artificial Sequence:  Hypothetical Probe Sequence
cgaatctgcacgtacacagccacg

SEQ ID NO: 1333 - DNA, 24 bp, Artificial Sequence
  Description of Artificial Sequence:  Hypothetical Probe Sequence
cgaatgtcctcaagccgtgcccat

SEQ ID NO: 1334 - DNA, 24 bp, Artificial Sequence
  Description of Artificial Sequence:  Hypothetical Probe Sequence
cgaatgtcgtctctgttgcgagcc

SEQ ID NO: 1335 - DNA, 24 bp, Artificial Sequence
  Description of Artificial Sequence:  Hypothetical Probe Sequence
cgaatcgtctgtcagcgcaacagc

SEQ ID NO: 1336 - DNA, 24 bp, Artificial Sequence
  Description of Artificial Sequence:  Hypothetical Probe Sequence
cgaatcgtgcttccatagccatcg

SEQ ID NO: 1337 - DNA, 24 bp, Artificial Sequence
  Description of Artificial Sequence:  Hypothetical Probe Sequence
cgaacttgtcgtgacccagccacg

SEQ ID NO: 1338 - DNA, 24 bp, Artificial Sequence
  Description of Artificial Sequence:  Hypothetical Probe Sequence
cgaacttggcttgacccacgatcg

SEQ ID NO: 1339 - DNA, 24 bp, Artificial Sequence
  Description of Artificial Sequence:  Hypothetical Probe Sequence
cgaacttgcagcagtggatgcgaa

SEQ ID NO: 1340 - DNA, 24 bp, Artificial Sequence
  Description of Artificial Sequence:  Hypothetical Probe Sequence
cgaacttggacccttgtgcgctgt

SEQ ID NO: 1341 - DNA, 24 bp, Artificial Sequence
  Description of Artificial Sequence:  Hypothetical Probe Sequence
cgaacttggtgccagccgttgatg

SEQ ID NO: 1342 - DNA, 24 bp, Artificial Sequence
  Description of Artificial Sequence:  Hypothetical Probe Sequence
cgaacttgagccgatggagtcacg

SEQ ID NO: 1343 - DNA, 24 bp, Artificial Sequence
  Description of Artificial Sequence:  Hypothetical Probe Sequence
cgaacgttgagtcgaacacgatcg

SEQ ID NO: 1344 - DNA, 24 bp, Artificial Sequence
  Description of Artificial Sequence:  Hypothetical Probe Sequence
cgaacgttgtgctctgcagcttga

SEQ ID NO: 1345 - DNA, 24 bp, Artificial Sequence
  Description of Artificial Sequence:  Hypothetical Probe Sequence
cgaactcaccatgcaaacggcgtt

SEQ ID NO: 1346 - DNA, 24 bp, Artificial Sequence
  Description of Artificial Sequence:  Hypothetical Probe Sequence
cgaactcagctttgcgaggatgcg

SEQ ID NO: 1347 - DNA, 24 bp, Artificial Sequence
  Description of Artificial Sequence:  Hypothetical Probe Sequence
cgaactcatcccatacgcaagcaa

SEQ ID NO: 1348 - DNA, 24 bp, Artificial Sequence
  Description of Artificial Sequence:  Hypothetical Probe Sequence
cgaactcacagccagcgcttgtgc

SEQ ID NO: 1349 - DNA, 24 bp, Artificial Sequence
  Description of Artificial Sequence:  Hypothetical Probe Sequence
cgaaccatcgaaccatgaccggac

SEQ ID NO: 1350 - DNA, 24 bp, Artificial Sequence
  Description of Artificial Sequence:  Hypothetical Probe Sequence
cgaaccatatcgagtgcagcggac

SEQ ID NO: 1351 - DNA, 24 bp, Artificial Sequence
  Description of Artificial Sequence:  Hypothetical Probe Sequence
cgaaccatcctaaatccgtttgcg

SEQ ID NO: 1352 - DNA, 24 bp, Artificial Sequence
  Description of Artificial Sequence:  Hypothetical Probe Sequence
cgaaccatcacgttaggcaagcaa

SEQ ID NO: 1353 - DNA, 24 bp, Artificial Sequence
  Description of Artificial Sequence:  Hypothetical Probe Sequence
cgaaccatggacctcatccctccc

SEQ ID NO: 1354 - DNA, 24 bp, Artificial Sequence
  Description of Artificial Sequence:  Hypothetical Probe Sequence
cgaacgaaaaagaccttgcggcaa

SEQ ID NO: 1355 - DNA, 24 bp, Artificial Sequence
  Description of Artificial Sequence:  Hypothetical Probe Sequence
cgaacgaatcgtttagcgttgcaa

SEQ ID NO: 1356 - DNA, 24 bp, Artificial Sequence
  Description of Artificial Sequence:  Hypothetical Probe Sequence
cgaagctttgatcacgcgttgacc

SEQ ID NO: 1357 - DNA, 24 bp, Artificial Sequence
  Description of Artificial Sequence:  Hypothetical Probe Sequence
cgaagctttacatgcgttgatgcg

SEQ ID NO: 1358 - DNA, 24 bp, Artificial Sequence
  Description of Artificial Sequence:  Hypothetical Probe Sequence
cgaagcttcgttcgaaggacagga

SEQ ID NO: 1359 - DNA, 24 bp, Artificial Sequence
  Description of Artificial Sequence:  Hypothetical Probe Sequence
cgaagcttcgaatcgtgcaaccat

SEQ ID NO: 1360 - DNA, 24 bp, Artificial Sequence
  Description of Artificial Sequence:  Hypothetical Probe Sequence
cgaagcttgtgcggacaaagttga

SEQ ID NO: 1361 - DNA, 24 bp, Artificial Sequence
  Description of Artificial Sequence:  Hypothetical Probe Sequence
cgaagagtccatacggtcccagcc

SEQ ID NO: 1362 - DNA, 24 bp, Artificial Sequence
  Description of Artificial Sequence:  Hypothetical Probe Sequence
cgaagcaattgaaccttgcgggac

SEQ ID NO: 1363 - DNA, 24 bp, Artificial Sequence
  Description of Artificial Sequence:  Hypothetical Probe Sequence
cgaagcaaaatcagccacctacgg

SEQ ID NO: 1364 - DNA, 24 bp, Artificial Sequence
  Description of Artificial Sequence:  Hypothetical Probe Sequence
cgaagcaaaaagccatcgtttgcg

SEQ ID NO: 1365 - DNA, 24 bp, Artificial Sequence
  Description of Artificial Sequence:  Hypothetical Probe Sequence
cgaagcaaccatacggcgttagtg

SEQ ID NO: 1366 - DNA, 24 bp, Artificial Sequence
  Description of Artificial Sequence:  Hypothetical Probe Sequence
cgaagcaagatgagcctgtccacg

SEQ ID NO: 1367 - DNA, 24 bp, Artificial Sequence
  Description of Artificial Sequence:  Hypothetical Probe Sequence
cgaaagtgcttggcaacgttcacg

SEQ ID NO: 1368 - DNA, 24 bp, Artificial Sequence
  Description of Artificial Sequence:  Hypothetical Probe Sequence
cgaaagtgcgtttgcgtctggtgc

SEQ ID NO: 1369 - DNA, 24 bp, Artificial Sequence
  Description of Artificial Sequence:  Hypothetical Probe Sequence
cgaaagtgcgaatgtcagtgcgaa

SEQ ID NO: 1370 - DNA, 24 bp, Artificial Sequence
  Description of Artificial Sequence:  Hypothetical Probe Sequence
cgaaagtggcttggactcgttccc

SEQ ID NO: 1371 - DNA, 24 bp, Artificial Sequence
  Description of Artificial Sequence:  Hypothetical Probe Sequence
cgaaagtggatggacccagctgcg

SEQ ID NO: 1372 - DNA, 24 bp, Artificial Sequence
  Description of Artificial Sequence:  Hypothetical Probe Sequence
cgaaacctgagtacggtgcgcgtt

SEQ ID NO: 1373 - DNA, 24 bp, Artificial Sequence
  Description of Artificial Sequence:  Hypothetical Probe Sequence
cgaaacctgcaactgtggtatgcg

SEQ ID NO: 1374 - DNA, 24 bp, Artificial Sequence
  Description of Artificial Sequence:  Hypothetical Probe Sequence
cgaaaccttgcgggtaacctcgaa

SEQ ID NO: 1375 - DNA, 24 bp, Artificial Sequence
  Description of Artificial Sequence:  Hypothetical Probe Sequence
cgaaacctgaccttgatgcgcagc

SEQ ID NO: 1376 - DNA, 24 bp, Artificial Sequence
  Description of Artificial Sequence:  Hypothetical Probe Sequence
cgaaacctgtgcgtctgaccggac

SEQ ID NO: 1377 - DNA, 24 bp, Artificial Sequence
  Description of Artificial Sequence:  Hypothetical Probe Sequence
cgaaatcggagttctgccattgcg

SEQ ID NO: 1378 - DNA, 24 bp, Artificial Sequence
  Description of Artificial Sequence:  Hypothetical Probe Sequence
cgaaaggaagtgcacggatgagcc

SEQ ID NO: 1379 - DNA, 24 bp, Artificial Sequence
  Description of Artificial Sequence:  Hypothetical Probe Sequence
cgaaaggatcccggtaggacgacc

SEQ ID NO: 1380 - DNA, 24 bp, Artificial Sequence
  Description of Artificial Sequence:  Hypothetical Probe Sequence
cgaaaggaagccagcctgtcgatg

SEQ ID NO: 1381 - DNA, 24 bp, Artificial Sequence
  Description of Artificial Sequence:  Hypothetical Probe Sequence
cgaacctagcaatgtcgcaagcaa

SEQ ID NO: 1382 - DNA, 24 bp, Artificial Sequence
  Description of Artificial Sequence:  Hypothetical Probe Sequence
cgaacctagtgcaatcagccgctt

SEQ ID NO: 1383 - DNA, 24 bp, Artificial Sequence
  Description of Artificial Sequence:  Hypothetical Probe Sequence
cgaagatgtcgttgcgacggtccc

SEQ ID NO: 1384 - DNA, 24 bp, Artificial Sequence
  Description of Artificial Sequence:  Hypothetical Probe Sequence
cgaagatggtctatcgagcccgaa

SEQ ID NO: 1385 - DNA, 24 bp, Artificial Sequence
  Description of Artificial Sequence:  Hypothetical Probe Sequence
cgaagatgtcccctcaagccatcg

SEQ ID NO: 1386 - DNA, 24 bp, Artificial Sequence
  Description of Artificial Sequence:  Hypothetical Probe Sequence
cgaagatgcacgctgtgcaacgtt

SEQ ID NO: 1387 - DNA, 24 bp, Artificial Sequence
  Description of Artificial Sequence:  Hypothetical Probe Sequence
cgaagatgggactcccacggggta

SEQ ID NO: 1388 - DNA, 24 bp, Artificial Sequence
  Description of Artificial Sequence:  Hypothetical Probe Sequence
cgaagatgagcctgatgtgcgcaa

SEQ ID NO: 1389 - DNA, 24 bp, Artificial Sequence
  Description of Artificial Sequence:  Hypothetical Probe Sequence
cgaatccctgtccagcaatcgctt

SEQ ID NO: 1390 - DNA, 24 bp, Artificial Sequence
  Description of Artificial Sequence:  Hypothetical Probe Sequence
cgaatcccgatgatacgaccggac

SEQ ID NO: 1391 - DNA, 24 bp, Artificial Sequence
  Description of Artificial Sequence:  Hypothetical Probe Sequence
cgaatccccacgaatcagtgtgcg

SEQ ID NO: 1392 - DNA, 24 bp, Artificial Sequence
  Description of Artificial Sequence:  Hypothetical Probe Sequence
cgaatccccagcgtgctgatcgaa

SEQ ID NO: 1393 - DNA, 24 bp, Artificial Sequence
  Description of Artificial Sequence:  Hypothetical Probe Sequence
cgaatcccacggatcgtcgtggta

SEQ ID NO: 1394 - DNA, 24 bp, Artificial Sequence
  Description of Artificial Sequence:  Hypothetical Probe Sequence
cgaatgcgtgatcagcaaaggctt

SEQ ID NO: 1395 - DNA, 24 bp, Artificial Sequence
  Description of Artificial Sequence:  Hypothetical Probe Sequence
cgaatgcgtacacagcgtgccagc

SEQ ID NO: 1396 - DNA, 24 bp, Artificial Sequence
  Description of Artificial Sequence:  Hypothetical Probe Sequence
cgaatgcgcgaacagcaggatgat

SEQ ID NO: 1397 - DNA, 24 bp, Artificial Sequence
  Description of Artificial Sequence:  Hypothetical Probe Sequence
cgaatgcgcagctacagacccacg

SEQ ID NO: 1398 - DNA, 24 bp, Artificial Sequence
  Description of Artificial Sequence:  Hypothetical Probe Sequence
cgaacacgtctgtctggtgccgaa

SEQ ID NO: 1399 - DNA, 24 bp, Artificial Sequence
  Description of Artificial Sequence:  Hypothetical Probe Sequence
cgaacacgccattcccaatcccat

SEQ ID NO: 1400 - DNA, 24 bp, Artificial Sequence
  Description of Artificial Sequence:  Hypothetical Probe Sequence
cgaacacggagtttagtccctgcg

SEQ ID NO: 1401 - DNA, 24 bp, Artificial Sequence
  Description of Artificial Sequence:  Hypothetical Probe Sequence
cgaacacgtgcggatggtctgcaa

SEQ ID NO: 1402 - DNA, 24 bp, Artificial Sequence
  Description of Artificial Sequence:  Hypothetical Probe Sequence
cgaacacgcacgcacgttagagcc

SEQ ID NO: 1403 - DNA, 24 bp, Artificial Sequence
  Description of Artificial Sequence:  Hypothetical Probe Sequence
cgaacagcaatcacggacggatcg

SEQ ID NO: 1404 - DNA, 24 bp, Artificial Sequence
  Description of Artificial Sequence:  Hypothetical Probe Sequence
cgaacagctcgtagtgctgttgcg

SEQ ID NO: 1405 - DNA, 24 bp, Artificial Sequence
  Description of Artificial Sequence:  Hypothetical Probe Sequence
cgaacagccttgccatgcaagcaa

SEQ ID NO: 1406 - DNA, 24 bp, Artificial Sequence
  Description of Artificial Sequence:  Hypothetical Probe Sequence
cgaacagcgagtttgatcccacct

SEQ ID NO: 1407 - DNA, 24 bp, Artificial Sequence
  Description of Artificial Sequence:  Hypothetical Probe Sequence
cgaacagcagtgttagcagcagcc

SEQ ID NO: 1408 - DNA, 24 bp, Artificial Sequence
  Description of Artificial Sequence:  Hypothetical Probe Sequence
cgaacagcgatgaaaggtgcgatg

SEQ ID NO: 1409 - DNA, 24 bp, Artificial Sequence
  Description of Artificial Sequence:  Hypothetical Probe Sequence
cgaacagccagcgaccggtactca

SEQ ID NO: 1410 - DNA, 24 bp, Artificial Sequence
  Description of Artificial Sequence:  Hypothetical Probe Sequence
cgaagaccctgtctcagtgcgtgc

SEQ ID NO: 1411 - DNA, 24 bp, Artificial Sequence
  Description of Artificial Sequence:  Hypothetical Probe Sequence
cgaagaccgtctaggatcccctca

SEQ ID NO: 1412 - DNA, 24 bp, Artificial Sequence
  Description of Artificial Sequence:  Hypothetical Probe Sequence
cgaagacctccccctaatcgctgt

SEQ ID NO: 1413 - DNA, 24 bp, Artificial Sequence
  Description of Artificial Sequence:  Hypothetical Probe Sequence
cgaagacctgcgttagctcaagcc

SEQ ID NO: 1414 - DNA, 24 bp, Artificial Sequence
  Description of Artificial Sequence:  Hypothetical Probe Sequence
cgaagtgcggtaaatctcgttgcg

SEQ ID NO: 1415 - DNA, 24 bp, Artificial Sequence
  Description of Artificial Sequence:  Hypothetical Probe Sequence
cgaagtgcaggaagcctcgtctca

SEQ ID NO: 1416 - DNA, 24 bp, Artificial Sequence
  Description of Artificial Sequence:  Hypothetical Probe Sequence
cgaagtgctccccctagatgcgaa

SEQ ID NO: 1417 - DNA, 24 bp, Artificial Sequence
  Description of Artificial Sequence:  Hypothetical Probe Sequence
cgaagtgcagccgatgggactcgt

SEQ ID NO: 1418 - DNA, 24 bp, Artificial Sequence
  Description of Artificial Sequence:  Hypothetical Probe Sequence
cgaaggacgcttgacctgatgcaa

SEQ ID NO: 1419 - DNA, 24 bp, Artificial Sequence
  Description of Artificial Sequence:  Hypothetical Probe Sequence
cgaaggacaccttctgtcccacgg

SEQ ID NO: 1420 - DNA, 24 bp, Artificial Sequence
  Description of Artificial Sequence:  Hypothetical Probe Sequence
cgaaggacgatggagtacgggctt

SEQ ID NO: 1421 - DNA, 24 bp, Artificial Sequence
  Description of Artificial Sequence:  Hypothetical Probe Sequence
cgaaacggtgattccctgtcgacc

SEQ ID NO: 1422 - DNA, 24 bp, Artificial Sequence
  Description of Artificial Sequence:  Hypothetical Probe Sequence
cgaaacggtctgcagcaaagtccc

SEQ ID NO: 1423 - DNA, 24 bp, Artificial Sequence
  Description of Artificial Sequence:  Hypothetical Probe Sequence
cgaaacgggagtggacggtatcgt

SEQ ID NO: 1424 - DNA, 24 bp, Artificial Sequence
  Description of Artificial Sequence:  Hypothetical Probe Sequence
cgaaacggacctaggacgtttcgt

SEQ ID NO: 1425 - DNA, 24 bp, Artificial Sequence
  Description of Artificial Sequence:  Hypothetical Probe Sequence
cgaaacggaggacttgatcgagcc

SEQ ID NO: 1426 - DNA, 24 bp, Artificial Sequence
  Description of Artificial Sequence:  Hypothetical Probe Sequence
cgaaacggcctatcgtgcaagagt

SEQ ID NO: 1427 - DNA, 24 bp, Artificial Sequence
  Description of Artificial Sequence:  Hypothetical Probe Sequence
cgaaacggtgcgctgttcgtcgtt

SEQ ID NO: 1428 - DNA, 24 bp, Artificial Sequence
  Description of Artificial Sequence:  Hypothetical Probe Sequence
cgaaacggacggcacgatcgtgat

SEQ ID NO: 1429 - DNA, 24 bp, Artificial Sequence
  Description of Artificial Sequence:  Hypothetical Probe Sequence
cgaaagcctgatcctatcccggac

SEQ ID NO: 1430 - DNA, 24 bp, Artificial Sequence
  Description of Artificial Sequence:  Hypothetical Probe Sequence
cgaaagcctctggcaacgaaggac

SEQ ID NO: 1431 - DNA, 24 bp, Artificial Sequence
  Description of Artificial Sequence:  Hypothetical Probe Sequence
cgaaagccctcaaatcgatgggac

SEQ ID NO: 1432 - DNA, 24 bp, Artificial Sequence
  Description of Artificial Sequence:  Hypothetical Probe Sequence
cgaaagccacctttagcagctcgt

SEQ ID NO: 1433 - DNA, 24 bp, Artificial Sequence
  Description of Artificial Sequence:  Hypothetical Probe Sequence
cgaaagccatcggtctgatgcgaa

SEQ ID NO: 1434 - DNA, 24 bp, Artificial Sequence
  Description of Artificial Sequence:  Hypothetical Probe Sequence
cgaaagccaggaagtggatggctt

SEQ ID NO: 1435 - DNA, 24 bp, Artificial Sequence
  Description of Artificial Sequence:  Hypothetical Probe Sequence
cgaaagccgatgcgaatgatagcc

SEQ ID NO: 1436 - DNA, 24 bp, Artificial Sequence
  Description of Artificial Sequence:  Hypothetical Probe Sequence
cgaaagccgtgcgatgggacgtct

SEQ ID NO: 1437 - DNA, 24 bp, Artificial Sequence
  Description of Artificial Sequence:  Hypothetical Probe Sequence
gctttgatatcgcttgacgggacc

SEQ ID NO: 1438 - DNA, 24 bp, Artificial Sequence
  Description of Artificial Sequence:  Hypothetical Probe Sequence
gctttgatcagctcccgacctgcg

SEQ ID NO: 1439 - DNA, 24 bp, Artificial Sequence
  Description of Artificial Sequence:  Hypothetical Probe Sequence
gctttgatgaccccattcccgacc

SEQ ID NO: 1440 - DNA, 24 bp, Artificial Sequence
  Description of Artificial Sequence:  Hypothetical Probe Sequence
gcttaatccagcggtatccccacg

SEQ ID NO: 1441 - DNA, 24 bp, Artificial Sequence
  Description of Artificial Sequence:  Hypothetical Probe Sequence
gcttaaagcgtttgcgccatgtgc

SEQ ID NO: 1442 - DNA, 24 bp, Artificial Sequence
  Description of Artificial Sequence:  Hypothetical Probe Sequence
gcttaaagcagcgaccgcttcgtt

SEQ ID NO: 1443 - DNA, 24 bp, Artificial Sequence
  Description of Artificial Sequence:  Hypothetical Probe Sequence
gctttctgcttgacggcttggcaa

SEQ ID NO: 1444 - DNA, 24 bp, Artificial Sequence
  Description of Artificial Sequence:  Hypothetical Probe Sequence
gctttctgctcaggacgctttcgt

SEQ ID NO: 1445 - DNA, 24 bp, Artificial Sequence
  Description of Artificial Sequence:  Hypothetical Probe Sequence
gctttctgctgttccccagcctca

SEQ ID NO: 1446 - DNA, 24 bp, Artificial Sequence
  Description of Artificial Sequence:  Hypothetical Probe Sequence
gctttctgcctaaggatgcgatcg

SEQ ID NO: 1447 - DNA, 24 bp, Artificial Sequence
  Description of Artificial Sequence:  Hypothetical Probe Sequence
gctttctgggacgcaaatcgccta

SEQ ID NO: 1448 - DNA, 24 bp, Artificial Sequence
  Description of Artificial Sequence:  Hypothetical Probe Sequence
gctttgtcgagtgtcttccctgcg

SEQ ID NO: 1449 - DNA, 24 bp, Artificial Sequence
  Description of Artificial Sequence:  Hypothetical Probe Sequence
gctttgtcgaccgcttcgaagcaa

SEQ ID NO: 1450 - DNA, 24 bp, Artificial Sequence
  Description of Artificial Sequence:  Hypothetical Probe Sequence
gctttcgttgtcgtgctgcgctca

SEQ ID NO: 1451 - DNA, 24 bp, Artificial Sequence
  Description of Artificial Sequence:  Hypothetical Probe Sequence
gctttcgtcgttgtgcaggagcaa

SEQ ID NO: 1452 - DNA, 24 bp, Artificial Sequence
  Description of Artificial Sequence:  Hypothetical Probe Sequence
gctttcgtgatgcctatccctgcg

SEQ ID NO: 1453 - DNA, 24 bp, Artificial Sequence
  Description of Artificial Sequence:  Hypothetical Probe Sequence
gctttcgtagccttagtcccgcaa

SEQ ID NO: 1454 - DNA, 24 bp, Artificial Sequence
  Description of Artificial Sequence:  Hypothetical Probe Sequence
gcttcttgccatcttggatgtgcg

SEQ ID NO: 1455 - DNA, 24 bp, Artificial Sequence
  Description of Artificial Sequence:  Hypothetical Probe Sequence
gcttcttggcaaagtgcgttacgg

SEQ ID NO: 1456 - DNA, 24 bp, Artificial Sequence
  Description of Artificial Sequence:  Hypothetical Probe Sequence
gcttcttgatcgacggtcccacgg

SEQ ID NO: 1457 - DNA, 24 bp, Artificial Sequence
  Description of Artificial Sequence:  Hypothetical Probe Sequence
gcttcgttcagccgttgaccagga

SEQ ID NO: 1458 - DNA, 24 bp, Artificial Sequence
  Description of Artificial Sequence:  Hypothetical Probe Sequence
gcttcgttgtgcagcccgaatgtc

SEQ ID NO: 1459 - DNA, 24 bp, Artificial Sequence
  Description of Artificial Sequence:  Hypothetical Probe Sequence
gcttctcagtgcgctttgcgcgtt

SEQ ID NO: 1460 - DNA, 24 bp, Artificial Sequence
  Description of Artificial Sequence:  Hypothetical Probe Sequence
gcttctgtacgggaccgacctgcg

SEQ ID NO: 1461 - DNA, 24 bp, Artificial Sequence
  Description of Artificial Sequence:  Hypothetical Probe Sequence
gcttccattcccgatgtccctccc

SEQ ID NO: 1462 - DNA, 24 bp, Artificial Sequence
  Description of Artificial Sequence:  Hypothetical Probe Sequence
gcttcgaacttggcaatcccgtgc

SEQ ID NO: 1463 - DNA, 24 bp, Artificial Sequence
  Description of Artificial Sequence:  Hypothetical Probe Sequence
gcttcgaactgtgcaaagcccagc

SEQ ID NO: 1464 - DNA, 24 bp, Artificial Sequence
  Description of Artificial Sequence:  Hypothetical Probe Sequence
gcttcgaaagtggcaaacgggatg

SEQ ID NO: 1465 - DNA, 24 bp, Artificial Sequence
  Description of Artificial Sequence:  Hypothetical Probe Sequence
gcttcgaaaggatgcgctgtgatg

SEQ ID NO: 1466 - DNA, 24 bp, Artificial Sequence
  Description of Artificial Sequence:  Hypothetical Probe Sequence
gcttgcttcttgatacagccgcaa

SEQ ID NO: 1467 - DNA, 24 bp, Artificial Sequence
  Description of Artificial Sequence:  Hypothetical Probe Sequence
gcttgctttccctctgagccgagt

SEQ ID NO: 1468 - DNA, 24 bp, Artificial Sequence
  Description of Artificial Sequence:  Hypothetical Probe Sequence
gcttggtagcaagtgcggacgagt

SEQ ID NO: 1469 - DNA, 24 bp, Artificial Sequence
  Description of Artificial Sequence:  Hypothetical Probe Sequence
gcttgagtcgtttcccgaccagcc

SEQ ID NO: 1470 - DNA, 24 bp, Artificial Sequence
  Description of Artificial Sequence:  Hypothetical Probe Sequence
gcttgagtgtgctgcgcttgcacg

SEQ ID NO: 1471 - DNA, 24 bp, Artificial Sequence
  Description of Artificial Sequence:  Hypothetical Probe Sequence
gcttgcaaaaagcacgcgaaagtg

SEQ ID NO: 1472 - DNA, 24 bp, Artificial Sequence
  Description of Artificial Sequence:  Hypothetical Probe Sequence
gcttgcaatcgtctcagcaatgcg

SEQ ID NO: 1473 - DNA, 24 bp, Artificial Sequence
  Description of Artificial Sequence:  Hypothetical Probe Sequence
gcttgcaacgaagtctcagcgcaa

SEQ ID NO: 1474 - DNA, 24 bp, Artificial Sequence
  Description of Artificial Sequence:  Hypothetical Probe Sequence
gcttgcaaacctcacgccatccta

SEQ ID NO: 1475 - DNA, 24 bp, Artificial Sequence
  Description of Artificial Sequence:  Hypothetical Probe Sequence
gcttgcaagatgcagctcccccta

SEQ ID NO: 1476 - DNA, 24 bp, Artificial Sequence
  Description of Artificial Sequence:  Hypothetical Probe Sequence
gcttacctcagctcccagccagcc

SEQ ID NO: 1477 - DNA, 24 bp, Artificial Sequence
  Description of Artificial Sequence:  Hypothetical Probe Sequence
gcttatcgcttgtctggtgctccc

SEQ ID NO: 1478 - DNA, 24 bp, Artificial Sequence
  Description of Artificial Sequence:  Hypothetical Probe Sequence
gcttatcgcctattgaacggcgtt

SEQ ID NO: 1479 - DNA, 24 bp, Artificial Sequence
  Description of Artificial Sequence:  Hypothetical Probe Sequence
gcttatcggaccgacccttgcgtt

SEQ ID NO: 1480 - DNA, 24 bp, Artificial Sequence
  Description of Artificial Sequence:  Hypothetical Probe Sequence
gcttcctacgtttgcgcttgcgaa

SEQ ID NO: 1481 - DNA, 24 bp, Artificial Sequence
  Description of Artificial Sequence:  Hypothetical Probe Sequence
gcttgatggcaaaggacacgacgg

SEQ ID NO: 1482 - DNA, 24 bp, Artificial Sequence
  Description of Artificial Sequence:  Hypothetical Probe Sequence
gcttgatgcacgaaagcgttgctt

SEQ ID NO: 1483 - DNA, 24 bp, Artificial Sequence
  Description of Artificial Sequence:  Hypothetical Probe Sequence
gcttgatggtgcataccgtttccc

SEQ ID NO: 1484 - DNA, 24 bp, Artificial Sequence
  Description of Artificial Sequence:  Hypothetical Probe Sequence
gctttcccatcggtctgacctccc

SEQ ID NO: 1485 - DNA, 24 bp, Artificial Sequence
  Description of Artificial Sequence:  Hypothetical Probe Sequence
gctttcccgaccggtatgtcgcaa

SEQ ID NO: 1486 - DNA, 24 bp, Artificial Sequence
  Description of Artificial Sequence:  Hypothetical Probe Sequence
gctttgcgtacaacgggcaatccc

SEQ ID NO: 1487 - DNA, 24 bp, Artificial Sequence
  Description of Artificial Sequence:  Hypothetical Probe Sequence
gctttgcgcgaagagtatcggcaa

SEQ ID NO: 1488 - DNA, 24 bp, Artificial Sequence
  Description of Artificial Sequence:  Hypothetical Probe Sequence
gctttgcgggtaaatcgagtacgg

SEQ ID NO: 1489 - DNA, 24 bp, Artificial Sequence
  Description of Artificial Sequence:  Hypothetical Probe Sequence
gctttgcgagtgggaccttgagcc

SEQ ID NO: 1490 - DNA, 24 bp, Artificial Sequence
  Description of Artificial Sequence:  Hypothetical Probe Sequence
gctttgcgatcggcaatcccttag

SEQ ID NO: 1491 - DNA, 24 bp, Artificial Sequence
  Description of Artificial Sequence:  Hypothetical Probe Sequence
gctttgcgacggtgtcaaaggcaa

SEQ ID NO: 1492 - DNA, 24 bp, Artificial Sequence
  Description of Artificial Sequence:  Hypothetical Probe Sequence
gcttcacgtgtccacgtccccacg

SEQ ID NO: 1493 - DNA, 24 bp, Artificial Sequence
  Description of Artificial Sequence:  Hypothetical Probe Sequence
gcttcacgcttgaaagcagcgagt

SEQ ID NO: 1494 - DNA, 24 bp, Artificial Sequence
  Description of Artificial Sequence:  Hypothetical Probe Sequence
gcttcacgctgttacaatcggcaa

SEQ ID NO: 1495 - DNA, 24 bp, Artificial Sequence
  Description of Artificial Sequence:  Hypothetical Probe Sequence
gcttcacgtcccgatgcttggacc

SEQ ID NO: 1496 - DNA, 24 bp, Artificial Sequence
  Description of Artificial Sequence:  Hypothetical Probe Sequence
gcttcacggacccacggagtcgaa

SEQ ID NO: 1497 - DNA, 24 bp, Artificial Sequence
  Description of Artificial Sequence:  Hypothetical Probe Sequence
gcttcagcaatctccccgaaagcc

SEQ ID NO: 1498 - DNA, 24 bp, Artificial Sequence
  Description of Artificial Sequence:  Hypothetical Probe Sequence
gcttcagctctgagcctccccacg

SEQ ID NO: 1499 - DNA, 24 bp, Artificial Sequence
  Description of Artificial Sequence:  Hypothetical Probe Sequence
gcttcagctcgtaatctccccagc

SEQ ID NO: 1500 - DNA, 24 bp, Artificial Sequence
  Description of Artificial Sequence:  Hypothetical Probe Sequence
gcttcagcgcaaaaagaatcgacc

SEQ ID NO: 1501 - DNA, 24 bp, Artificial Sequence
  Description of Artificial Sequence:  Hypothetical Probe Sequence
gcttcagcacctggtaagccacgg

SEQ ID NO: 1502 - DNA, 24 bp, Artificial Sequence
  Description of Artificial Sequence:  Hypothetical Probe Sequence
gcttcagccacggcaactcagcaa

SEQ ID NO: 1503 - DNA, 24 bp, Artificial Sequence
  Description of Artificial Sequence:  Hypothetical Probe Sequence
gcttgaccaatccacgtgcgagcc

SEQ ID NO: 1504 - DNA, 24 bp, Artificial Sequence
  Description of Artificial Sequence:  Hypothetical Probe Sequence
gcttgaccccatgcttgcttagcc

SEQ ID NO: 1505 - DNA, 24 bp, Artificial Sequence
  Description of Artificial Sequence:  Hypothetical Probe Sequence
gcttgacccctaagcccacgctca

SEQ ID NO: 1506 - DNA, 24 bp, Artificial Sequence
  Description of Artificial Sequence:  Hypothetical Probe Sequence
gcttgacccagcgaccgtgctctg

SEQ ID NO: 1507 - DNA, 24 bp, Artificial Sequence
  Description of Artificial Sequence:  Hypothetical Probe Sequence
gcttgtgcatcggtgccttgacct

SEQ ID NO: 1508 - DNA, 24 bp, Artificial Sequence
  Description of Artificial Sequence:  Hypothetical Probe Sequence
gcttgtgctcccaatctgcgttga

SEQ ID NO: 1509 - DNA, 24 bp, Artificial Sequence
  Description of Artificial Sequence:  Hypothetical Probe Sequence
gcttggaccgtttctggtgcccat

SEQ ID NO: 1510 - DNA, 24 bp, Artificial Sequence
  Description of Artificial Sequence:  Hypothetical Probe Sequence
gcttggaccgaatctggcaatgtc

SEQ ID NO: 1511 - DNA, 24 bp, Artificial Sequence
  Description of Artificial Sequence:  Hypothetical Probe Sequence
gcttggactccccttgtgtcgcaa

SEQ ID NO: 1512 - DNA, 24 bp, Artificial Sequence
  Description of Artificial Sequence:  Hypothetical Probe Sequence
gcttggaccacgtacatcccagcc

SEQ ID NO: 1513 - DNA, 24 bp, Artificial Sequence
  Description of Artificial Sequence:  Hypothetical Probe Sequence
gcttacggtctgacggtgcgtcgt

SEQ ID NO: 1514 - DNA, 24 bp, Artificial Sequence
  Description of Artificial Sequence:  Hypothetical Probe Sequence
gcttagccctgtaatcacgggcaa

SEQ ID NO: 1515 - DNA, 24 bp, Artificial Sequence
  Description of Artificial Sequence:  Hypothetical Probe Sequence
gcttagccatcgctcaaaagcgaa

SEQ ID NO: 1516 - DNA, 24 bp, Artificial Sequence
  Description of Artificial Sequence:  Hypothetical Probe Sequence
ggtatctggtgcaggacgaatgcg

SEQ ID NO: 1517 - DNA, 24 bp, Artificial Sequence
  Description of Artificial Sequence:  Hypothetical Probe Sequence
ggtatgtcgctttgcgcagctccc

SEQ ID NO: 1518 - DNA, 24 bp, Artificial Sequence
  Description of Artificial Sequence:  Hypothetical Probe Sequence
ggtacgaacagcggtaagccgcaa

SEQ ID NO: 1519 - DNA, 24 bp, Artificial Sequence
  Description of Artificial Sequence:  Hypothetical Probe Sequence
ggtacgaaagcctacaagcccgaa

SEQ ID NO: 1520 - DNA, 24 bp, Artificial Sequence
  Description of Artificial Sequence:  Hypothetical Probe Sequence
ggtagcaacagcgacccagccagc

SEQ ID NO: 1521 - DNA, 24 bp, Artificial Sequence
  Description of Artificial Sequence:  Hypothetical Probe Sequence
ggtagcaaggactgcgtctgtgcg

SEQ ID NO: 1522 - DNA, 24 bp, Artificial Sequence
  Description of Artificial Sequence:  Hypothetical Probe Sequence
ggtaacctcacgtgcgctgttgcg

SEQ ID NO: 1523 - DNA, 24 bp, Artificial Sequence
  Description of Artificial Sequence:  Hypothetical Probe Sequence
ggtaatcggcaacgttcttgacgg

SEQ ID NO: 1524 - DNA, 24 bp, Artificial Sequence
  Description of Artificial Sequence:  Hypothetical Probe Sequence
ggtagatggcttcgtttccccagc

SEQ ID NO: 1525 - DNA, 24 bp, Artificial Sequence
  Description of Artificial Sequence:  Hypothetical Probe Sequence
ggtatgcggcaactgtatcggtgc

SEQ ID NO: 1526 - DNA, 24 bp, Artificial Sequence
  Description of Artificial Sequence:  Hypothetical Probe Sequence
ggtatgcgagtggtgcggtagtgc

SEQ ID NO: 1527 - DNA, 24 bp, Artificial Sequence
  Description of Artificial Sequence:  Hypothetical Probe Sequence
ggtacacggcaacgttccattcgt

SEQ ID NO: 1528 - DNA, 24 bp, Artificial Sequence
  Description of Artificial Sequence:  Hypothetical Probe Sequence
ggtacacgatcggaccaggatgcg

SEQ ID NO: 1529 - DNA, 24 bp, Artificial Sequence
  Description of Artificial Sequence:  Hypothetical Probe Sequence
ggtacacgagccgagtcagcgctt

SEQ ID NO: 1530 - DNA, 24 bp, Artificial Sequence
  Description of Artificial Sequence:  Hypothetical Probe Sequence
ggtacagcgcttaggaggacgtgc

SEQ ID NO: 1531 - DNA, 24 bp, Artificial Sequence
  Description of Artificial Sequence:  Hypothetical Probe Sequence
ggtacagcgaccctgttccctccc

SEQ ID NO: 1532 - DNA, 24 bp, Artificial Sequence
  Description of Artificial Sequence:  Hypothetical Probe Sequence
ggtagaccggtacagcatcgcgaa

SEQ ID NO: 1533 - DNA, 24 bp, Artificial Sequence
  Description of Artificial Sequence:  Hypothetical Probe Sequence
ggtagaccatcgcagcgtgcatcg

SEQ ID NO: 1534 - DNA, 24 bp, Artificial Sequence
  Description of Artificial Sequence:  Hypothetical Probe Sequence
ggtagaccgtgcccatccattgcg

SEQ ID NO: 1535 - DNA, 24 bp, Artificial Sequence
  Description of Artificial Sequence:  Hypothetical Probe Sequence
ggtagaccacggttagtgcgagcc

SEQ ID NO: 1536 - DNA, 24 bp, Artificial Sequence
  Description of Artificial Sequence:  Hypothetical Probe Sequence
ggtaacggtcgtttagacggtgcg

SEQ ID NO: 1537 - DNA, 24 bp, Artificial Sequence
  Description of Artificial Sequence:  Hypothetical Probe Sequence
ggtaacggctgtgtgcgatggatg

SEQ ID NO: 1538 - DNA, 24 bp, Artificial Sequence
  Description of Artificial Sequence:  Hypothetical Probe Sequence
ggtaagccgagtaccttgcgctgt

SEQ ID NO: 1539 - DNA, 24 bp, Artificial Sequence
  Description of Artificial Sequence:  Hypothetical Probe Sequence
gtctttgatgcgcgtttgcgaaag

SEQ ID NO: 1540 - DNA, 24 bp, Artificial Sequence
  Description of Artificial Sequence:  Hypothetical Probe Sequence
gtcttctgcagctgcgcttgccat

SEQ ID NO: 1541 - DNA, 24 bp, Artificial Sequence
  Description of Artificial Sequence:  Hypothetical Probe Sequence
gtctcttgcagcacggtccctgcg

SEQ ID NO: 1542 - DNA, 24 bp, Artificial Sequence
  Description of Artificial Sequence:  Hypothetical Probe Sequence
gtctcgttcgaacagcagccgctt

SEQ ID NO: 1543 - DNA, 24 bp, Artificial Sequence
  Description of Artificial Sequence:  Hypothetical Probe Sequence
gtctcgttgtgccacgtcgttgcg

SEQ ID NO: 1544 - DNA, 24 bp, Artificial Sequence
  Description of Artificial Sequence:  Hypothetical Probe Sequence
gtctccattcccacggctgtagcc

SEQ ID NO: 1545 - DNA, 24 bp, Artificial Sequence
  Description of Artificial Sequence:  Hypothetical Probe Sequence
gtctcgaacgaacagcgcaacacg

SEQ ID NO: 1546 - DNA, 24 bp, Artificial Sequence
  Description of Artificial Sequence:  Hypothetical Probe Sequence
gtctcgaaatcgcgaaacgggacc

SEQ ID NO: 1547 - DNA, 24 bp, Artificial Sequence
  Description of Artificial Sequence:  Hypothetical Probe Sequence
gtctgcaaatcgaatctccccgtt

SEQ ID NO: 1548 - DNA, 24 bp, Artificial Sequence
  Description of Artificial Sequence:  Hypothetical Probe Sequence
gtctgatgcagcatcgtgcggcaa

SEQ ID NO: 1549 - DNA, 24 bp, Artificial Sequence
  Description of Artificial Sequence:  Hypothetical Probe Sequence
gtcttccccttgacggcgttgcaa

SEQ ID NO: 1550 - DNA, 24 bp, Artificial Sequence
  Description of Artificial Sequence:  Hypothetical Probe Sequence
gtcttcccccattctgacggggta

SEQ ID NO: 1551 - DNA, 24 bp, Artificial Sequence
  Description of Artificial Sequence:  Hypothetical Probe Sequence
gtcttcccacggagtgccatgtgc

SEQ ID NO: 1552 - DNA, 24 bp, Artificial Sequence
  Description of Artificial Sequence:  Hypothetical Probe Sequence
gtcttgcgagtgatcgagccagcc

SEQ ID NO: 1553 - DNA, 24 bp, Artificial Sequence
  Description of Artificial Sequence:  Hypothetical Probe Sequence
gtcttgcggacctccctacaacgg

SEQ ID NO: 1554 - DNA, 24 bp, Artificial Sequence
  Description of Artificial Sequence:  Hypothetical Probe Sequence
gtctcacgctcaacggcttgccat

SEQ ID NO: 1555 - DNA, 24 bp, Artificial Sequence
  Description of Artificial Sequence:  Hypothetical Probe Sequence
gtctcacggctttgtcagccgtgc

SEQ ID NO: 1556 - DNA, 24 bp, Artificial Sequence
  Description of Artificial Sequence:  Hypothetical Probe Sequence
gtctcacgcctagacctgcggcaa

SEQ ID NO: 1557 - DNA, 24 bp, Artificial Sequence
  Description of Artificial Sequence:  Hypothetical Probe Sequence
gtctcacgtcccctgtgctttgcg

SEQ ID NO: 1558 - DNA, 24 bp, Artificial Sequence
  Description of Artificial Sequence:  Hypothetical Probe Sequence
gtctcacgacggcgttcgttgtgc

SEQ ID NO: 1559 - DNA, 24 bp, Artificial Sequence
  Description of Artificial Sequence:  Hypothetical Probe Sequence
gtctcagccagctcgttcgtcgaa

SEQ ID NO: 1560 - DNA, 24 bp, Artificial Sequence
  Description of Artificial Sequence:  Hypothetical Probe Sequence
gtctcagcggacggacggacccta

SEQ ID NO: 1561 - DNA, 24 bp, Artificial Sequence
  Description of Artificial Sequence:  Hypothetical Probe Sequence
gtctgtgcgcttcacgttgatgcg

SEQ ID NO: 1562 - DNA, 24 bp, Artificial Sequence
  Description of Artificial Sequence:  Hypothetical Probe Sequence
gtctgtgcgcaaggaccgttccat

SEQ ID NO: 1563 - DNA, 24 bp, Artificial Sequence
  Description of Artificial Sequence:  Hypothetical Probe Sequence
gtctgtgcagccgctttcccagga

SEQ ID NO: 1564 - DNA, 24 bp, Artificial Sequence
  Description of Artificial Sequence:  Hypothetical Probe Sequence
gtctggacgcttacggcgaaaaag

SEQ ID NO: 1565 - DNA, 24 bp, Artificial Sequence
  Description of Artificial Sequence:  Hypothetical Probe Sequence
gtctggactcccgcaacacgtgcg

SEQ ID NO: 1566 - DNA, 24 bp, Artificial Sequence
  Description of Artificial Sequence:  Hypothetical Probe Sequence
gtctggacagccatcgatcgtgcg

SEQ ID NO: 1567 - DNA, 24 bp, Artificial Sequence
  Description of Artificial Sequence:  Hypothetical Probe Sequence
gtctagccggtacagctcccatcg

SEQ ID NO: 1568 - DNA, 24 bp, Artificial Sequence
  Description of Artificial Sequence:  Hypothetical Probe Sequence
gagttctgtgcgcacgcacggcaa

SEQ ID NO: 1569 - DNA, 24 bp, Artificial Sequence
  Description of Artificial Sequence:  Hypothetical Probe Sequence
gagttctgcacgacggcacgtccc

SEQ ID NO: 1570 - DNA, 24 bp, Artificial Sequence
  Description of Artificial Sequence:  Hypothetical Probe Sequence
gagtcttgcacgccatagcccacg

SEQ ID NO: 1571 - DNA, 24 bp, Artificial Sequence
  Description of Artificial Sequence:  Hypothetical Probe Sequence
gagtcgttcgttagccatcgtgcg

SEQ ID NO: 1572 - DNA, 24 bp, Artificial Sequence
  Description of Artificial Sequence:  Hypothetical Probe Sequence
gagtctgtcacgcagcagccagga

SEQ ID NO: 1573 - DNA, 24 bp, Artificial Sequence
  Description of Artificial Sequence:  Hypothetical Probe Sequence
gagtcgaaagcctgcgtcgtccat

SEQ ID NO: 1574 - DNA, 24 bp, Artificial Sequence
  Description of Artificial Sequence:  Hypothetical Probe Sequence
gagtgcttgcaacacgcacgacct

SEQ ID NO: 1575 - DNA, 24 bp, Artificial Sequence
  Description of Artificial Sequence:  Hypothetical Probe Sequence
gagtgcttcacggtgcgtgcagcc

SEQ ID NO: 1576 - DNA, 24 bp, Artificial Sequence
  Description of Artificial Sequence:  Hypothetical Probe Sequence
gagtatcgtgcgatcggaccctca

SEQ ID NO: 1577 - DNA, 24 bp, Artificial Sequence
  Description of Artificial Sequence:  Hypothetical Probe Sequence
gagtcctacagctcccgctttgcg

SEQ ID NO: 1578 - DNA, 24 bp, Artificial Sequence
  Description of Artificial Sequence:  Hypothetical Probe Sequence
gagttcccgtgccctatcgtgtgc

SEQ ID NO: 1579 - DNA, 24 bp, Artificial Sequence
  Description of Artificial Sequence:  Hypothetical Probe Sequence
gagttgcgaaagcacgggacgtgc

SEQ ID NO: 1580 - DNA, 24 bp, Artificial Sequence
  Description of Artificial Sequence:  Hypothetical Probe Sequence
gagttgcgccattacatcccggta

SEQ ID NO: 1581 - DNA, 24 bp, Artificial Sequence
  Description of Artificial Sequence:  Hypothetical Probe Sequence
gagttgcgggtagcaatctgcacg

SEQ ID NO: 1582 - DNA, 24 bp, Artificial Sequence
  Description of Artificial Sequence:  Hypothetical Probe Sequence
gagttgcgacctagcctccctgcg

SEQ ID NO: 1583 - DNA, 24 bp, Artificial Sequence
  Description of Artificial Sequence:  Hypothetical Probe Sequence
gagtcagcgatggtgcggacacgg

SEQ ID NO: 1584 - DNA, 24 bp, Artificial Sequence
  Description of Artificial Sequence:  Hypothetical Probe Sequence
gagtcagctccctctggacccgtt

SEQ ID NO: 1585 - DNA, 24 bp, Artificial Sequence
  Description of Artificial Sequence:  Hypothetical Probe Sequence
gagtcagcggacagccgagtcacg

SEQ ID NO: 1586 - DNA, 24 bp, Artificial Sequence
  Description of Artificial Sequence:  Hypothetical Probe Sequence
gagtgacccgtttccccgaactgt

SEQ ID NO: 1587 - DNA, 24 bp, Artificial Sequence
  Description of Artificial Sequence:  Hypothetical Probe Sequence
gagtgaccgtgcgaccagcccttg

SEQ ID NO: 1588 - DNA, 24 bp, Artificial Sequence
  Description of Artificial Sequence:  Hypothetical Probe Sequence
gagtgtgcttgaggactcccgtgc

SEQ ID NO: 1589 - DNA, 24 bp, Artificial Sequence
  Description of Artificial Sequence:  Hypothetical Probe Sequence
gagtggacccattgtcggacggac

SEQ ID NO: 1590 - DNA, 24 bp, Artificial Sequence
  Description of Artificial Sequence:  Hypothetical Probe Sequence
gagtggacggactgtcatcgcacg

SEQ ID NO: 1591 - DNA, 24 bp, Artificial Sequence
  Description of Artificial Sequence:  Hypothetical Probe Sequence
gagtacggccatttagtgcggctt

SEQ ID NO: 1592 - DNA, 24 bp, Artificial Sequence
  Description of Artificial Sequence:  Hypothetical Probe Sequence
gagtagccatcggaccagcccacg

SEQ ID NO: 1593 - DNA, 24 bp, Artificial Sequence
  Description of Artificial Sequence:  Hypothetical Probe Sequence
gcaattgagtgcggaccgaacagc

SEQ ID NO: 1594 - DNA, 24 bp, Artificial Sequence
  Description of Artificial Sequence:  Hypothetical Probe Sequence
gcaatgattcgttccccttgcacg

SEQ ID NO: 1595 - DNA, 24 bp, Artificial Sequence
  Description of Artificial Sequence:  Hypothetical Probe Sequence
gcaatgatcagcgctttcccagcc

SEQ ID NO: 1596 - DNA, 24 bp, Artificial Sequence
  Description of Artificial Sequence:  Hypothetical Probe Sequence
gcaaaatcatcggtgccgaaacct

SEQ ID NO: 1597 - DNA, 24 bp, Artificial Sequence
  Description of Artificial Sequence:  Hypothetical Probe Sequence
gcaaaatctcccatcgctcatccc

SEQ ID NO: 1598 - DNA, 24 bp, Artificial Sequence
  Description of Artificial Sequence:  Hypothetical Probe Sequence
gcaaaatccacgcagcctgtgacc

SEQ ID NO: 1599 - DNA, 24 bp, Artificial Sequence
  Description of Artificial Sequence:  Hypothetical Probe Sequence
gcaaaaagacctaggaagccgcaa

SEQ ID NO: 1600 - DNA, 24 bp, Artificial Sequence
  Description of Artificial Sequence:  Hypothetical Probe Sequence
gcaatctgcgttttagggacacgg

SEQ ID NO: 1601 - DNA, 24 bp, Artificial Sequence
  Description of Artificial Sequence:  Hypothetical Probe Sequence
gcaatctggcaacgttatcgcgtt

SEQ ID NO: 1602 - DNA, 24 bp, Artificial Sequence
  Description of Artificial Sequence:  Hypothetical Probe Sequence
gcaatctgtcccgcaactcaagcc

SEQ ID NO: 1603 - DNA, 24 bp, Artificial Sequence
  Description of Artificial Sequence:  Hypothetical Probe Sequence
gcaatctgtgcgctgtggacgtgc

SEQ ID NO: 1604 - DNA, 24 bp, Artificial Sequence
  Description of Artificial Sequence:  Hypothetical Probe Sequence
gcaatctggaccaatcagccccat

SEQ ID NO: 1605 - DNA, 24 bp, Artificial Sequence
  Description of Artificial Sequence:  Hypothetical Probe Sequence
gcaatctgggacagccgtgccagc

SEQ ID NO: 1606 - DNA, 24 bp, Artificial Sequence
  Description of Artificial Sequence:  Hypothetical Probe Sequence
gcaatgtctcgtgacctgcgcgaa

SEQ ID NO: 1607 - DNA, 24 bp, Artificial Sequence
  Description of Artificial Sequence:  Hypothetical Probe Sequence
gcaatgtcgctttcgtgtgcctca

SEQ ID NO: 1608 - DNA, 24 bp, Artificial Sequence
  Description of Artificial Sequence:  Hypothetical Probe Sequence
gcaatgtcggtagacctcccgctt

SEQ ID NO: 1609 - DNA, 24 bp, Artificial Sequence
  Description of Artificial Sequence:  Hypothetical Probe Sequence
gcaatgtcatcgtccctccccacg

SEQ ID NO: 1610 - DNA, 24 bp, Artificial Sequence
  Description of Artificial Sequence:  Hypothetical Probe Sequence
gcaatgtctgcggatgcgaaggac

SEQ ID NO: 1611 - DNA, 24 bp, Artificial Sequence
  Description of Artificial Sequence:  Hypothetical Probe Sequence
gcaatgtccacgcgaaatcgtcgt

SEQ ID NO: 1612 - DNA, 24 bp, Artificial Sequence
  Description of Artificial Sequence:  Hypothetical Probe Sequence
gcaatcgtctgttgcgaatccgaa

SEQ ID NO: 1613 - DNA, 24 bp, Artificial Sequence
  Description of Artificial Sequence:  Hypothetical Probe Sequence
gcaatcgtacctgcttgtgccgaa

SEQ ID NO: 1614 - DNA, 24 bp, Artificial Sequence
  Description of Artificial Sequence:  Hypothetical Probe Sequence
gcaatcgtagcctgattccccagc

SEQ ID NO: 1615 - DNA, 24 bp, Artificial Sequence
  Description of Artificial Sequence:  Hypothetical Probe Sequence
gcaacttggatgagcccacgcgaa

SEQ ID NO: 1616 - DNA, 24 bp, Artificial Sequence
  Description of Artificial Sequence:  Hypothetical Probe Sequence
gcaacttgcagccgaagcaagtgc

SEQ ID NO: 1617 - DNA, 24 bp, Artificial Sequence
  Description of Artificial Sequence:  Hypothetical Probe Sequence
gcaacgttttgatcgtcacgagcc

SEQ ID NO: 1618 - DNA, 24 bp, Artificial Sequence
  Description of Artificial Sequence:  Hypothetical Probe Sequence
gcaacgtttacaacggcagcgcaa

SEQ ID NO: 1619 - DNA, 24 bp, Artificial Sequence
  Description of Artificial Sequence:  Hypothetical Probe Sequence
gcaacgttgatggtgctccctgcg

SEQ ID NO: 1620 - DNA, 24 bp, Artificial Sequence
  Description of Artificial Sequence:  Hypothetical Probe Sequence
gcaacgtttcccacctttgaagcc

SEQ ID NO: 1621 - DNA, 24 bp, Artificial Sequence
  Description of Artificial Sequence:  Hypothetical Probe Sequence
gcaactcaatcgcgaagtgcccat

SEQ ID NO: 1622 - DNA, 24 bp, Artificial Sequence
  Description of Artificial Sequence:  Hypothetical Probe Sequence
gcaactcacacgacgggtgcagga

SEQ ID NO: 1623 - DNA, 24 bp, Artificial Sequence
  Description of Artificial Sequence:  Hypothetical Probe Sequence
gcaactcaacgggcttggacagga

SEQ ID NO: 1624 - DNA, 24 bp, Artificial Sequence
  Description of Artificial Sequence:  Hypothetical Probe Sequence
gcaactgttgcggcaagcaaacct

SEQ ID NO: 1625 - DNA, 24 bp, Artificial Sequence
  Description of Artificial Sequence:  Hypothetical Probe Sequence
gcaaccatctcaggaccagcgcaa

SEQ ID NO: 1626 - DNA, 24 bp, Artificial Sequence
  Description of Artificial Sequence:  Hypothetical Probe Sequence
gcaaccatcgaatgtcacggatcg

SEQ ID NO: 1627 - DNA, 24 bp, Artificial Sequence
  Description of Artificial Sequence:  Hypothetical Probe Sequence
gcaaccatgatgacggtcccagga

SEQ ID NO: 1628 - DNA, 24 bp, Artificial Sequence
  Description of Artificial Sequence:  Hypothetical Probe Sequence
gcaaccattgcgtcccttagtcgt

SEQ ID NO: 1629 - DNA, 24 bp, Artificial Sequence
  Description of Artificial Sequence:  Hypothetical Probe Sequence
gcaaccatggacgatgcgaagtgc

SEQ ID NO: 1630 - DNA, 24 bp, Artificial Sequence
  Description of Artificial Sequence:  Hypothetical Probe Sequence
gcaacgaagcttgacctgtcgctt

SEQ ID NO: 1631 - DNA, 24 bp, Artificial Sequence
  Description of Artificial Sequence:  Hypothetical Probe Sequence
gcaagcttgctttgtccttggcaa

SEQ ID NO: 1632 - DNA, 24 bp, Artificial Sequence
  Description of Artificial Sequence:  Hypothetical Probe Sequence
gcaagcttcacggcttcagcctgt

SEQ ID NO: 1633 - DNA, 24 bp, Artificial Sequence
  Description of Artificial Sequence:  Hypothetical Probe Sequence
gcaagcttagccgatggtgcctca

SEQ ID NO: 1634 - DNA, 24 bp, Artificial Sequence
  Description of Artificial Sequence:  Hypothetical Probe Sequence
gcaagtctgcttaatcgaccgcaa

SEQ ID NO: 1635 - DNA, 24 bp, Artificial Sequence
  Description of Artificial Sequence:  Hypothetical Probe Sequence
gcaagcaaaatcgcaatcgttccc

SEQ ID NO: 1636 - DNA, 24 bp, Artificial Sequence
  Description of Artificial Sequence:  Hypothetical Probe Sequence
gcaagcaacttgctcatgcgagcc

SEQ ID NO: 1637 - DNA, 24 bp, Artificial Sequence
  Description of Artificial Sequence:  Hypothetical Probe Sequence
gcaagcaactcagacccacgtcgt

SEQ ID NO: 1638 - DNA, 24 bp, Artificial Sequence
  Description of Artificial Sequence:  Hypothetical Probe Sequence
gcaagcaagctttcccgatgaatc

SEQ ID NO: 1639 - DNA, 24 bp, Artificial Sequence
  Description of Artificial Sequence:  Hypothetical Probe Sequence
gcaagcaacagcatacgaccgcaa

SEQ ID NO: 1640 - DNA, 24 bp, Artificial Sequence
  Description of Artificial Sequence:  Hypothetical Probe Sequence
gcaaagtgggtaccattgcgctca

SEQ ID NO: 1641 - DNA, 24 bp, Artificial Sequence
  Description of Artificial Sequence:  Hypothetical Probe Sequence
gcaaaccttctgagcccttgcacg

SEQ ID NO: 1642 - DNA, 24 bp, Artificial Sequence
  Description of Artificial Sequence:  Hypothetical Probe Sequence
gcaaaccttgtccagctcccggac

SEQ ID NO: 1643 - DNA, 24 bp, Artificial Sequence
  Description of Artificial Sequence:  Hypothetical Probe Sequence
gcaaacctccattgcgggacaatc

SEQ ID NO: 1644 - DNA, 24 bp, Artificial Sequence
  Description of Artificial Sequence:  Hypothetical Probe Sequence
gcaaacctgcaagaccctcagcaa

SEQ ID NO: 1645 - DNA, 24 bp, Artificial Sequence
  Description of Artificial Sequence:  Hypothetical Probe Sequence
gcaaacctgaccgcaaagccggta

SEQ ID NO: 1646 - DNA, 24 bp, Artificial Sequence
  Description of Artificial Sequence:  Hypothetical Probe Sequence
gcaaacctggacgcaagaccgacc

SEQ ID NO: 1647 - DNA, 24 bp, Artificial Sequence
  Description of Artificial Sequence:  Hypothetical Probe Sequence
gcaaatcgctcacctaagccgtct

SEQ ID NO: 1648 - DNA, 24 bp, Artificial Sequence
  Description of Artificial Sequence:  Hypothetical Probe Sequence
gcaaatcggagttgtccagcagcc

SEQ ID NO: 1649 - DNA, 24 bp, Artificial Sequence
  Description of Artificial Sequence:  Hypothetical Probe Sequence
gcaaatcgtccccagctgtcccat

SEQ ID NO: 1650 - DNA, 24 bp, Artificial Sequence
  Description of Artificial Sequence:  Hypothetical Probe Sequence
gcaaatcggaccatacgtgcagga

SEQ ID NO: 1651 - DNA, 24 bp, Artificial Sequence
  Description of Artificial Sequence:  Hypothetical Probe Sequence
gcaaaggatctgtgcggcaaatcg

SEQ ID NO: 1652 - DNA, 24 bp, Artificial Sequence
  Description of Artificial Sequence:  Hypothetical Probe Sequence
gcaaaggacttgggacacggtgcg

SEQ ID NO: 1653 - DNA, 24 bp, Artificial Sequence
  Description of Artificial Sequence:  Hypothetical Probe Sequence
gcaaaggactcagtgcagccgcaa

SEQ ID NO: 1654 - DNA, 24 bp, Artificial Sequence
  Description of Artificial Sequence:  Hypothetical Probe Sequence
gcaaaggaacctatcggatgcgtt

SEQ ID NO: 1655 - DNA, 24 bp, Artificial Sequence
  Description of Artificial Sequence:  Hypothetical Probe Sequence
gcaaaggaatcgcacgggtacgaa

SEQ ID NO: 1656 - DNA, 24 bp, Artificial Sequence
  Description of Artificial Sequence:  Hypothetical Probe Sequence
gcaacctagaccgctttcccacgg

SEQ ID NO: 1657 - DNA, 24 bp, Artificial Sequence
  Description of Artificial Sequence:  Hypothetical Probe Sequence
gcaacctaagccaggatcgttccc

SEQ ID NO: 1658 - DNA, 24 bp, Artificial Sequence
  Description of Artificial Sequence:  Hypothetical Probe Sequence
gcaagatgcgttagtgggacagcc

SEQ ID NO: 1659 - DNA, 24 bp, Artificial Sequence
  Description of Artificial Sequence:  Hypothetical Probe Sequence
gcaagatgcctacacgcgaaagcc

SEQ ID NO: 1660 - DNA, 24 bp, Artificial Sequence
  Description of Artificial Sequence:  Hypothetical Probe Sequence
gcaagatgtgcgttgagacccagc

SEQ ID NO: 1661 - DNA, 24 bp, Artificial Sequence
  Description of Artificial Sequence:  Hypothetical Probe Sequence
gcaatcccaatcacggcgaataca

SEQ ID NO: 1662 - DNA, 24 bp, Artificial Sequence
  Description of Artificial Sequence:  Hypothetical Probe Sequence
gcaatccctctgcagcgagtgctt

SEQ ID NO: 1663 - DNA, 24 bp, Artificial Sequence
  Description of Artificial Sequence:  Hypothetical Probe Sequence
gcaatcccacggggacaatcgtgc

SEQ ID NO: 1664 - DNA, 24 bp, Artificial Sequence
  Description of Artificial Sequence:  Hypothetical Probe Sequence
gcaatgcgttaggatgccattgcg

SEQ ID NO: 1665 - DNA, 24 bp, Artificial Sequence
  Description of Artificial Sequence:  Hypothetical Probe Sequence
gcaatgcgaaaggatgcgttcgaa

SEQ ID NO: 1666 - DNA, 24 bp, Artificial Sequence
  Description of Artificial Sequence:  Hypothetical Probe Sequence
gcaatgcgtcgtcgaatcgtctca

SEQ ID NO: 1667 - DNA, 24 bp, Artificial Sequence
  Description of Artificial Sequence:  Hypothetical Probe Sequence
gcaatgcgcgttgtgcctgtggta

SEQ ID NO: 1668 - DNA, 24 bp, Artificial Sequence
  Description of Artificial Sequence:  Hypothetical Probe Sequence
gcaatgcgctcaacctcgttgtgc

SEQ ID NO: 1669 - DNA, 24 bp, Artificial Sequence
  Description of Artificial Sequence:  Hypothetical Probe Sequence
gcaatgcgcgaatctggatgatcg

SEQ ID NO: 1670 - DNA, 24 bp, Artificial Sequence
  Description of Artificial Sequence:  Hypothetical Probe Sequence
gcaatgcgcagcgctttctgatcg

SEQ ID NO: 1671 - DNA, 24 bp, Artificial Sequence
  Description of Artificial Sequence:  Hypothetical Probe Sequence
gcaatgcgggacttagaccttccc

SEQ ID NO: 1672 - DNA, 24 bp, Artificial Sequence
  Description of Artificial Sequence:  Hypothetical Probe Sequence
gcaacacgaatcgatgcagcggac

SEQ ID NO: 1673 - DNA, 24 bp, Artificial Sequence
  Description of Artificial Sequence:  Hypothetical Probe Sequence
gcaacacgtctgcctatgcgccat

SEQ ID NO: 1674 - DNA, 24 bp, Artificial Sequence
  Description of Artificial Sequence:  Hypothetical Probe Sequence
gcaacacgcgttctgtggtaacgg

SEQ ID NO: 1675 - DNA, 24 bp, Artificial Sequence
  Description of Artificial Sequence:  Hypothetical Probe Sequence
gcaacacgctcagcaaaaagcgtt

SEQ ID NO: 1676 - DNA, 24 bp, Artificial Sequence
  Description of Artificial Sequence:  Hypothetical Probe Sequence
gcaacacgtcccgtcttcccctgt

SEQ ID NO: 1677 - DNA, 24 bp, Artificial Sequence
  Description of Artificial Sequence:  Hypothetical Probe Sequence
gcaacacgggaccacgatcggagt

SEQ ID NO: 1678 - DNA, 24 bp, Artificial Sequence
  Description of Artificial Sequence:  Hypothetical Probe Sequence
gcaacagcttgatgcgccatcacg

SEQ ID NO: 1679 - DNA, 24 bp, Artificial Sequence
  Description of Artificial Sequence:  Hypothetical Probe Sequence
gcaacagctcgtaggaatcggctt

SEQ ID NO: 1680 - DNA, 24 bp, Artificial Sequence
  Description of Artificial Sequence:  Hypothetical Probe Sequence
gcaacagcccatagtgatcgcacg

SEQ ID NO: 1681 - DNA, 24 bp, Artificial Sequence
  Description of Artificial Sequence:  Hypothetical Probe Sequence
gcaacagcggtaaaaggcttcagc

SEQ ID NO: 1682 - DNA, 24 bp, Artificial Sequence
  Description of Artificial Sequence:  Hypothetical Probe Sequence
gcaacagcgagtaggagtgccacg

SEQ ID NO: 1683 - DNA, 24 bp, Artificial Sequence
  Description of Artificial Sequence:  Hypothetical Probe Sequence
gcaacagccctaatacagcccgtt

SEQ ID NO: 1684 - DNA, 24 bp, Artificial Sequence
  Description of Artificial Sequence:  Hypothetical Probe Sequence
gcaacagccacgcttgcagctctg

SEQ ID NO: 1685 - DNA, 24 bp, Artificial Sequence
  Description of Artificial Sequence:  Hypothetical Probe Sequence
gcaagaccccattcgtcgtttcgt

SEQ ID NO: 1686 - DNA, 24 bp, Artificial Sequence
  Description of Artificial Sequence:  Hypothetical Probe Sequence
gcaagaccacctaatcggacacgg

SEQ ID NO: 1687 - DNA, 24 bp, Artificial Sequence
  Description of Artificial Sequence:  Hypothetical Probe Sequence
gcaagaccggacggaccacgaaag

SEQ ID NO: 1688 - DNA, 24 bp, Artificial Sequence
  Description of Artificial Sequence:  Hypothetical Probe Sequence
gcaagtgccttgaatctgcgggac

SEQ ID NO: 1689 - DNA, 24 bp, Artificial Sequence
  Description of Artificial Sequence:  Hypothetical Probe Sequence
gcaagtgcctgtctgttcccacgg

SEQ ID NO: 1690 - DNA, 24 bp, Artificial Sequence
  Description of Artificial Sequence:  Hypothetical Probe Sequence
gcaagtgcggtatcccgagtgatg

SEQ ID NO: 1691 - DNA, 24 bp, Artificial Sequence
  Description of Artificial Sequence:  Hypothetical Probe Sequence
gcaagtgcgcaattagatcgtgcg

SEQ ID NO: 1692 - DNA, 24 bp, Artificial Sequence
  Description of Artificial Sequence:  Hypothetical Probe Sequence
gcaagtgcacctgacctccccacg

SEQ ID NO: 1693 - DNA, 24 bp, Artificial Sequence
  Description of Artificial Sequence:  Hypothetical Probe Sequence
gcaagtgcatcgcctagtgctccc

SEQ ID NO: 1694 - DNA, 24 bp, Artificial Sequence
  Description of Artificial Sequence:  Hypothetical Probe Sequence
gcaagtgccctagtgcgtgcagtg

SEQ ID NO: 1695 - DNA, 24 bp, Artificial Sequence
  Description of Artificial Sequence:  Hypothetical Probe Sequence
gcaagtgctcccgtctgtgcccat

SEQ ID NO: 1696 - DNA, 24 bp, Artificial Sequence
  Description of Artificial Sequence:  Hypothetical Probe Sequence
gcaagtgcgtgcaaaggcttttga

SEQ ID NO: 1697 - DNA, 24 bp, Artificial Sequence
  Description of Artificial Sequence:  Hypothetical Probe Sequence
gcaagtgcacggaccttcgtccat

SEQ ID NO: 1698 - DNA, 24 bp, Artificial Sequence
  Description of Artificial Sequence:  Hypothetical Probe Sequence
gcaaggacaatccgaatgcggcaa

SEQ ID NO: 1699 - DNA, 24 bp, Artificial Sequence
  Description of Artificial Sequence:  Hypothetical Probe Sequence
gcaaggactcgtggacgtgcgtgc

SEQ ID NO: 1700 - DNA, 24 bp, Artificial Sequence
  Description of Artificial Sequence:  Hypothetical Probe Sequence
gcaaggacctgttctggcaaacgg

SEQ ID NO: 1701 - DNA, 24 bp, Artificial Sequence
  Description of Artificial Sequence:  Hypothetical Probe Sequence
gcaaggacatcgccattccctgtc

SEQ ID NO: 1702 - DNA, 24 bp, Artificial Sequence
  Description of Artificial Sequence:  Hypothetical Probe Sequence
gcaaggaccagcttagggactgcg

SEQ ID NO: 1703 - DNA, 24 bp, Artificial Sequence
  Description of Artificial Sequence:  Hypothetical Probe Sequence
gcaaggacggacaggagcttgacc

SEQ ID NO: 1704 - DNA, 24 bp, Artificial Sequence
  Description of Artificial Sequence:  Hypothetical Probe Sequence
gcaaacggctgtcacgtgatcgaa

SEQ ID NO: 1705 - DNA, 24 bp, Artificial Sequence
  Description of Artificial Sequence:  Hypothetical Probe Sequence
gcaaacgggcttgtgccctaagtg

SEQ ID NO: 1706 - DNA, 24 bp, Artificial Sequence
  Description of Artificial Sequence:  Hypothetical Probe Sequence
gcaaacgggtctgagtcacgcacg

SEQ ID NO: 1707 - DNA, 24 bp, Artificial Sequence
  Description of Artificial Sequence:  Hypothetical Probe Sequence
gcaaacggagtgctcacagccgtt

SEQ ID NO: 1708 - DNA, 24 bp, Artificial Sequence
  Description of Artificial Sequence:  Hypothetical Probe Sequence
gcaaacggtgcgcgaagtctgtgc

SEQ ID NO: 1709 - DNA, 24 bp, Artificial Sequence
  Description of Artificial Sequence:  Hypothetical Probe Sequence
gcaaacggggacgatgtctgcgaa

SEQ ID NO: 1710 - DNA, 24 bp, Artificial Sequence
  Description of Artificial Sequence:  Hypothetical Probe Sequence
gcaaagccgtctgtctgcaagcaa

SEQ ID NO: 1711 - DNA, 24 bp, Artificial Sequence
  Description of Artificial Sequence:  Hypothetical Probe Sequence
gcaaagccacctccatcgaaccta

SEQ ID NO: 1712 - DNA, 24 bp, Artificial Sequence
  Description of Artificial Sequence:  Hypothetical Probe Sequence
gcaaagccaggaacctaaaggcaa

SEQ ID NO: 1713 - DNA, 24 bp, Artificial Sequence
  Description of Artificial Sequence:  Hypothetical Probe Sequence
gcaaagcccctagtgccgaagtct

SEQ ID NO: 1714 - DNA, 24 bp, Artificial Sequence
  Description of Artificial Sequence:  Hypothetical Probe Sequence
gcaaagcctcccctgtggtaagcc

SEQ ID NO: 1715 - DNA, 24 bp, Artificial Sequence
  Description of Artificial Sequence:  Hypothetical Probe Sequence
agtgaatccgaaaggagtgctgcg

SEQ ID NO: 1716 - DNA, 24 bp, Artificial Sequence
  Description of Artificial Sequence:  Hypothetical Probe Sequence
agtgaatcacggcagcagccacgg

SEQ ID NO: 1717 - DNA, 24 bp, Artificial Sequence
  Description of Artificial Sequence:  Hypothetical Probe Sequence
agtgtctgcacgcagccacggacc

SEQ ID NO: 1718 - DNA, 24 bp, Artificial Sequence
  Description of Artificial Sequence:  Hypothetical Probe Sequence
agtgtcgtacggaccttgcgtgcg

SEQ ID NO: 1719 - DNA, 24 bp, Artificial Sequence
  Description of Artificial Sequence:  Hypothetical Probe Sequence
agtgcttgccatagccagccctgt

SEQ ID NO: 1720 - DNA, 24 bp, Artificial Sequence
  Description of Artificial Sequence:  Hypothetical Probe Sequence
agtgcttgggtaggacgtgcgatg

SEQ ID NO: 1721 - DNA, 24 bp, Artificial Sequence
  Description of Artificial Sequence:  Hypothetical Probe Sequence
agtgcttgcctaccatagcccgaa

SEQ ID NO: 1722 - DNA, 24 bp, Artificial Sequence
  Description of Artificial Sequence:  Hypothetical Probe Sequence
agtgcttgggactgcgggtagacc

SEQ ID NO: 1723 - DNA, 24 bp, Artificial Sequence
  Description of Artificial Sequence:  Hypothetical Probe Sequence
agtgcgtttcgtagtgggactgcg

SEQ ID NO: 1724 - DNA, 24 bp, Artificial Sequence
  Description of Artificial Sequence:  Hypothetical Probe Sequence
agtgcgttgtctgatgcgtttgcg

SEQ ID NO: 1725 - DNA, 24 bp, Artificial Sequence
  Description of Artificial Sequence:  Hypothetical Probe Sequence
agtgctcatccccgaaggacgacc

SEQ ID NO: 1726 - DNA, 24 bp, Artificial Sequence
  Description of Artificial Sequence:  Hypothetical Probe Sequence
agtgctgttcccatcggtgccagc

SEQ ID NO: 1727 - DNA, 24 bp, Artificial Sequence
  Description of Artificial Sequence:  Hypothetical Probe Sequence
agtgccatcttgacggctcaacgg

SEQ ID NO: 1728 - DNA, 24 bp, Artificial Sequence
  Description of Artificial Sequence:  Hypothetical Probe Sequence
agtgcgaatgcgaaagttgaagcc

SEQ ID NO: 1729 - DNA, 24 bp, Artificial Sequence
  Description of Artificial Sequence:  Hypothetical Probe Sequence
agtggcttcgttcttgcacgtccc

SEQ ID NO: 1730 - DNA, 24 bp, Artificial Sequence
  Description of Artificial Sequence:  Hypothetical Probe Sequence
agtggctttcccggaccctacacg

SEQ ID NO: 1731 - DNA, 24 bp, Artificial Sequence
  Description of Artificial Sequence:  Hypothetical Probe Sequence
agtggctttgcgcctagatggctt

SEQ ID NO: 1732 - DNA, 24 bp, Artificial Sequence
  Description of Artificial Sequence:  Hypothetical Probe Sequence
agtggcttgaccctgtacggcagc

SEQ ID NO: 1733 - DNA, 24 bp, Artificial Sequence
  Description of Artificial Sequence:  Hypothetical Probe Sequence
agtggcttagcctcgtgacccacg

SEQ ID NO: 1734 - DNA, 24 bp, Artificial Sequence
  Description of Artificial Sequence:  Hypothetical Probe Sequence
agtgggtacgttacgggtgcccat

SEQ ID NO: 1735 - DNA, 24 bp, Artificial Sequence
  Description of Artificial Sequence:  Hypothetical Probe Sequence
agtgggtatgcggcttgaccctca

SEQ ID NO: 1736 - DNA, 24 bp, Artificial Sequence
  Description of Artificial Sequence:  Hypothetical Probe Sequence
agtggcaaaaagtctgctgttgcg

SEQ ID NO: 1737 - DNA, 24 bp, Artificial Sequence
  Description of Artificial Sequence:  Hypothetical Probe Sequence
agtggcaaagtgagcctgcgcagc

SEQ ID NO: 1738 - DNA, 24 bp, Artificial Sequence
  Description of Artificial Sequence:  Hypothetical Probe Sequence
agtggcaagacctcgtgtgcgtgc

SEQ ID NO: 1739 - DNA, 24 bp, Artificial Sequence
  Description of Artificial Sequence:  Hypothetical Probe Sequence
agtgatcgctcaacggagccggta

SEQ ID NO: 1740 - DNA, 24 bp, Artificial Sequence
  Description of Artificial Sequence:  Hypothetical Probe Sequence
agtgatcgtgcgaccttgtcacgg

SEQ ID NO: 1741 - DNA, 24 bp, Artificial Sequence
  Description of Artificial Sequence:  Hypothetical Probe Sequence
agtgatcgcagcaccttgcggagt

SEQ ID NO: 1742 - DNA, 24 bp, Artificial Sequence
  Description of Artificial Sequence:  Hypothetical Probe Sequence
agtgatcggtgcatcggcttgcaa

SEQ ID NO: 1743 - DNA, 24 bp, Artificial Sequence
  Description of Artificial Sequence:  Hypothetical Probe Sequence
agtgatcgacggggtatcccacgg

SEQ ID NO: 1744 - DNA, 24 bp, Artificial Sequence
  Description of Artificial Sequence:  Hypothetical Probe Sequence
agtgcctatccccttggcttcgtt

SEQ ID NO: 1745 - DNA, 24 bp, Artificial Sequence
  Description of Artificial Sequence:  Hypothetical Probe Sequence
agtgcctacagcgcaatgcgcacg

SEQ ID NO: 1746 - DNA, 24 bp, Artificial Sequence
  Description of Artificial Sequence:  Hypothetical Probe Sequence
agtgcctagtgcgcttacgggcaa

SEQ ID NO: 1747 - DNA, 24 bp, Artificial Sequence
  Description of Artificial Sequence:  Hypothetical Probe Sequence
agtggatgagccggacacggccta

SEQ ID NO: 1748 - DNA, 24 bp, Artificial Sequence
  Description of Artificial Sequence:  Hypothetical Probe Sequence
agtgtccctcgtagccagccagga

SEQ ID NO: 1749 - DNA, 24 bp, Artificial Sequence
  Description of Artificial Sequence:  Hypothetical Probe Sequence
agtgtcccctgttcccgatgcagc

SEQ ID NO: 1750 - DNA, 24 bp, Artificial Sequence
  Description of Artificial Sequence:  Hypothetical Probe Sequence
agtgtcccgtgcataccgaaatcg

SEQ ID NO: 1751 - DNA, 24 bp, Artificial Sequence
  Description of Artificial Sequence:  Hypothetical Probe Sequence
agtgtgcgaatctgcgcagcagga

SEQ ID NO: 1752 - DNA, 24 bp, Artificial Sequence
  Description of Artificial Sequence:  Hypothetical Probe Sequence
agtgtgcgcttggtctgaccacgg

SEQ ID NO: 1753 - DNA, 24 bp, Artificial Sequence
  Description of Artificial Sequence:  Hypothetical Probe Sequence
agtgtgcgcgaactgtgatgccat

SEQ ID NO: 1754 - DNA, 24 bp, Artificial Sequence
  Description of Artificial Sequence:  Hypothetical Probe Sequence
agtgtgcgcctagagtagccgctt

SEQ ID NO: 1755 - DNA, 24 bp, Artificial Sequence
  Description of Artificial Sequence:  Hypothetical Probe Sequence
agtgtgcgtgcgtacacacgccat

SEQ ID NO: 1756 - DNA, 24 bp, Artificial Sequence
  Description of Artificial Sequence:  Hypothetical Probe Sequence
agtgcacgcgttaaagagccacct

SEQ ID NO: 1757 - DNA, 24 bp, Artificial Sequence
  Description of Artificial Sequence:  Hypothetical Probe Sequence
agtgcacgcgaatacacagcacgg

SEQ ID NO: 1758 - DNA, 24 bp, Artificial Sequence
  Description of Artificial Sequence:  Hypothetical Probe Sequence
agtgcacgtgcgcgtttacaagcc

SEQ ID NO: 1759 - DNA, 24 bp, Artificial Sequence
  Description of Artificial Sequence:  Hypothetical Probe Sequence
agtgcacggaccttagagccccat

SEQ ID NO: 1760 - DNA, 24 bp, Artificial Sequence
  Description of Artificial Sequence:  Hypothetical Probe Sequence
agtgcagcgcttcctaaaaggtgc

SEQ ID NO: 1761 - DNA, 24 bp, Artificial Sequence
  Description of Artificial Sequence:  Hypothetical Probe Sequence
agtggaccgcaacctagtgcatcg

SEQ ID NO: 1762 - DNA, 24 bp, Artificial Sequence
  Description of Artificial Sequence:  Hypothetical Probe Sequence
agtggaccggactctgtcccgacc

SEQ ID NO: 1763 - DNA, 24 bp, Artificial Sequence
  Description of Artificial Sequence:  Hypothetical Probe Sequence
agtggtgcaatcctcagtgctccc

SEQ ID NO: 1764 - DNA, 24 bp, Artificial Sequence
  Description of Artificial Sequence:  Hypothetical Probe Sequence
agtggtgcccatcgaagcttggac

SEQ ID NO: 1765 - DNA, 24 bp, Artificial Sequence
  Description of Artificial Sequence:  Hypothetical Probe Sequence
agtggtgcgtctatactgcgcagc

SEQ ID NO: 1766 - DNA, 24 bp, Artificial Sequence
  Description of Artificial Sequence:  Hypothetical Probe Sequence
agtggtgcgagtcctatgcggacc

SEQ ID NO: 1767 - DNA, 24 bp, Artificial Sequence
  Description of Artificial Sequence:  Hypothetical Probe Sequence
agtgggactcgtcttgatcgtgcg

SEQ ID NO: 1768 - DNA, 24 bp, Artificial Sequence
  Description of Artificial Sequence:  Hypothetical Probe Sequence
agtgggacccataatccttgtgcg

SEQ ID NO: 1769 - DNA, 24 bp, Artificial Sequence
  Description of Artificial Sequence:  Hypothetical Probe Sequence
agtgacggctcagtgctgcgccat

SEQ ID NO: 1770 - DNA, 24 bp, Artificial Sequence
  Description of Artificial Sequence:  Hypothetical Probe Sequence
agtgacggggtacttgggacgtgc

SEQ ID NO: 1771 - DNA, 24 bp, Artificial Sequence
  Description of Artificial Sequence:  Hypothetical Probe Sequence
agtgacgggatgtgattccccgtt

SEQ ID NO: 1772 - DNA, 24 bp, Artificial Sequence
  Description of Artificial Sequence:  Hypothetical Probe Sequence
agtgacggggacgtcttcccagga

SEQ ID NO: 1773 - DNA, 24 bp, Artificial Sequence
  Description of Artificial Sequence:  Hypothetical Probe Sequence
agtgagcccttgataccagcgcaa

SEQ ID NO: 1774 - DNA, 24 bp, Artificial Sequence
  Description of Artificial Sequence:  Hypothetical Probe Sequence
agtgagccatcgaaagcgttcgaa

SEQ ID NO: 1775 - DNA, 24 bp, Artificial Sequence
  Description of Artificial Sequence:  Hypothetical Probe Sequence
agtgagccggacgtctagccacgg

SEQ ID NO: 1776 - DNA, 24 bp, Artificial Sequence
  Description of Artificial Sequence:  Hypothetical Probe Sequence
acctttgacgaatgcgacggtcgt

SEQ ID NO: 1777 - DNA, 24 bp, Artificial Sequence
  Description of Artificial Sequence:  Hypothetical Probe Sequence
accttgattgcgtgcggtctccta

SEQ ID NO: 1778 - DNA, 24 bp, Artificial Sequence
  Description of Artificial Sequence:  Hypothetical Probe Sequence
accttctgcttgtgcggcttatcg

SEQ ID NO: 1779 - DNA, 24 bp, Artificial Sequence
  Description of Artificial Sequence:  Hypothetical Probe Sequence
accttctgtgcgcagcgtcttccc

SEQ ID NO: 1780 - DNA, 24 bp, Artificial Sequence
  Description of Artificial Sequence:  Hypothetical Probe Sequence
accttgtcccatgtgcccatcacg

SEQ ID NO: 1781 - DNA, 24 bp, Artificial Sequence
  Description of Artificial Sequence:  Hypothetical Probe Sequence
accttcgttcgtatcgtgcgagcc

SEQ ID NO: 1782 - DNA, 24 bp, Artificial Sequence
  Description of Artificial Sequence:  Hypothetical Probe Sequence
accttcgtcgttacggccatacgg

SEQ ID NO: 1783 - DNA, 24 bp, Artificial Sequence
  Description of Artificial Sequence:  Hypothetical Probe Sequence
accttcgttcccttaggatgtgcg

SEQ ID NO: 1784 - DNA, 24 bp, Artificial Sequence
  Description of Artificial Sequence:  Hypothetical Probe Sequence
accttcgtcagcacggtgcgctca

SEQ ID NO: 1785 - DNA, 24 bp, Artificial Sequence
  Description of Artificial Sequence:  Hypothetical Probe Sequence
acctcttggcttcctatgcgtgcg

SEQ ID NO: 1786 - DNA, 24 bp, Artificial Sequence
  Description of Artificial Sequence:  Hypothetical Probe Sequence
acctcgttcttgccatacggcgaa

SEQ ID NO: 1787 - DNA, 24 bp, Artificial Sequence
  Description of Artificial Sequence:  Hypothetical Probe Sequence
acctcgttccatagccctgtgtgc

SEQ ID NO: 1788 - DNA, 24 bp, Artificial Sequence
  Description of Artificial Sequence:  Hypothetical Probe Sequence
acctccatcacggcttgagttgcg

SEQ ID NO: 1789 - DNA, 24 bp, Artificial Sequence
  Description of Artificial Sequence:  Hypothetical Probe Sequence
acctccatacgggatgcacgccta

SEQ ID NO: 1790 - DNA, 24 bp, Artificial Sequence
  Description of Artificial Sequence:  Hypothetical Probe Sequence
acctcgaacgttagcccagcgagt

SEQ ID NO: 1791 - DNA, 24 bp, Artificial Sequence
  Description of Artificial Sequence:  Hypothetical Probe Sequence
acctcgaaggtatgcgctcatgcg

SEQ ID NO: 1792 - DNA, 24 bp, Artificial Sequence
  Description of Artificial Sequence:  Hypothetical Probe Sequence
acctgcttcttgtccccacgagga

SEQ ID NO: 1793 - DNA, 24 bp, Artificial Sequence
  Description of Artificial Sequence:  Hypothetical Probe Sequence
acctgctttgcggagtcgaacgtt

SEQ ID NO: 1794 - DNA, 24 bp, Artificial Sequence
  Description of Artificial Sequence:  Hypothetical Probe Sequence
acctgcttcagccttgcacgtgcg

SEQ ID NO: 1795 - DNA, 24 bp, Artificial Sequence
  Description of Artificial Sequence:  Hypothetical Probe Sequence
acctgcaatgatgcaatgcgtgcg

SEQ ID NO: 1796 - DNA, 24 bp, Artificial Sequence
  Description of Artificial Sequence:  Hypothetical Probe Sequence
acctgcaagagtcttggtgcagcc

SEQ ID NO: 1797 - DNA, 24 bp, Artificial Sequence
  Description of Artificial Sequence:  Hypothetical Probe Sequence
acctagtgccattctgcagcgctt

SEQ ID NO: 1798 - DNA, 24 bp, Artificial Sequence
  Description of Artificial Sequence:  Hypothetical Probe Sequence
accttcccaatcgatggtgcatcg

SEQ ID NO: 1799 - DNA, 24 bp, Artificial Sequence
  Description of Artificial Sequence:  Hypothetical Probe Sequence
accttcccaaagtgattgcggtgc

SEQ ID NO: 1800 - DNA, 24 bp, Artificial Sequence
  Description of Artificial Sequence:  Hypothetical Probe Sequence
accttcccctgtcagcgagttcgt

SEQ ID NO: 1801 - DNA, 24 bp, Artificial Sequence
  Description of Artificial Sequence:  Hypothetical Probe Sequence
accttcccacctcgaacacgccta

SEQ ID NO: 1802 - DNA, 24 bp, Artificial Sequence
  Description of Artificial Sequence:  Hypothetical Probe Sequence
accttcccatcgtcgtcacgtcgt

SEQ ID NO: 1803 - DNA, 24 bp, Artificial Sequence
  Description of Artificial Sequence:  Hypothetical Probe Sequence
accttccccctaagcctccctctg

SEQ ID NO: 1804 - DNA, 24 bp, Artificial Sequence
  Description of Artificial Sequence:  Hypothetical Probe Sequence
accttcccacggctcagatgacgg

SEQ ID NO: 1805 - DNA, 24 bp, Artificial Sequence
  Description of Artificial Sequence:  Hypothetical Probe Sequence
accttgcgttgatgattgcgtcgt

SEQ ID NO: 1806 - DNA, 24 bp, Artificial Sequence
  Description of Artificial Sequence:  Hypothetical Probe Sequence
accttgcgcgaaaaagtcgtcgtt

SEQ ID NO: 1807 - DNA, 24 bp, Artificial Sequence
  Description of Artificial Sequence:  Hypothetical Probe Sequence
accttgcggcttgctttcgtctca

SEQ ID NO: 1808 - DNA, 24 bp, Artificial Sequence
  Description of Artificial Sequence:  Hypothetical Probe Sequence
accttgcgacggcagcacctctca

SEQ ID NO: 1809 - DNA, 24 bp, Artificial Sequence
  Description of Artificial Sequence:  Hypothetical Probe Sequence
acctcacgaaagtcccagccacgg

SEQ ID NO: 1810 - DNA, 24 bp, Artificial Sequence
  Description of Artificial Sequence:  Hypothetical Probe Sequence
acctcacggtcttccccgaagacc

SEQ ID NO: 1811 - DNA, 24 bp, Artificial Sequence
  Description of Artificial Sequence:  Hypothetical Probe Sequence
acctcacggagtctgtacggtgcg

SEQ ID NO: 1812 - DNA, 24 bp, Artificial Sequence
  Description of Artificial Sequence:  Hypothetical Probe Sequence
acctcacgtcccccatacggctca

SEQ ID NO: 1813 - DNA, 24 bp, Artificial Sequence
  Description of Artificial Sequence:  Hypothetical Probe Sequence
acctgacccgaactgtggaccagc

SEQ ID NO: 1814 - DNA, 24 bp, Artificial Sequence
  Description of Artificial Sequence:  Hypothetical Probe Sequence
acctgacccacgaaaggcaacgtt

SEQ ID NO: 1815 - DNA, 24 bp, Artificial Sequence
  Description of Artificial Sequence:  Hypothetical Probe Sequence
acctgaccacggttgatgcgtgtc

SEQ ID NO: 1816 - DNA, 24 bp, Artificial Sequence
  Description of Artificial Sequence:  Hypothetical Probe Sequence
acctgtgcctcagcaagatgacgg

SEQ ID NO: 1817 - DNA, 24 bp, Artificial Sequence
  Description of Artificial Sequence:  Hypothetical Probe Sequence
acctgtgcgagtcgaaacgggtgc

SEQ ID NO: 1818 - DNA, 24 bp, Artificial Sequence
  Description of Artificial Sequence:  Hypothetical Probe Sequence
acctgtgcacctcagcgatgcagc

SEQ ID NO: 1819 - DNA, 24 bp, Artificial Sequence
  Description of Artificial Sequence:  Hypothetical Probe Sequence
acctgtgcaggatcccacggtgtc

SEQ ID NO: 1820 - DNA, 24 bp, Artificial Sequence
  Description of Artificial Sequence:  Hypothetical Probe Sequence
acctgtgccctacacgggacatcg

SEQ ID NO: 1821 - DNA, 24 bp, Artificial Sequence
  Description of Artificial Sequence:  Hypothetical Probe Sequence
acctggaccttgtgcgaatcgctt

SEQ ID NO: 1822 - DNA, 24 bp, Artificial Sequence
  Description of Artificial Sequence:  Hypothetical Probe Sequence
acctggacgatgtgcgctgtagga

SEQ ID NO: 1823 - DNA, 24 bp, Artificial Sequence
  Description of Artificial Sequence:  Hypothetical Probe Sequence
acctggactccctcgtcagcgatg

SEQ ID NO: 1824 - DNA, 24 bp, Artificial Sequence
  Description of Artificial Sequence:  Hypothetical Probe Sequence
acctggacagccaatccacgagcc

SEQ ID NO: 1825 - DNA, 24 bp, Artificial Sequence
  Description of Artificial Sequence:  Hypothetical Probe Sequence
acctacggttgacgaagcaatgcg

SEQ ID NO: 1826 - DNA, 24 bp, Artificial Sequence
  Description of Artificial Sequence:  Hypothetical Probe Sequence
acctacggcgttcgaagcttggta

SEQ ID NO: 1827 - DNA, 24 bp, Artificial Sequence
  Description of Artificial Sequence:  Hypothetical Probe Sequence
atcgttgacgaaagccagccgcaa

SEQ ID NO: 1828 - DNA, 24 bp, Artificial Sequence
  Description of Artificial Sequence:  Hypothetical Probe Sequence
atcgttgaaggatgcggaccatcg

SEQ ID NO: 1829 - DNA, 24 bp, Artificial Sequence
  Description of Artificial Sequence:  Hypothetical Probe Sequence
atcgttgaacggtgcgtctggatg

SEQ ID NO: 1830 - DNA, 24 bp, Artificial Sequence
  Description of Artificial Sequence:  Hypothetical Probe Sequence
atcgtgatcacggtgcacggcgaa

SEQ ID NO: 1831 - DNA, 24 bp, Artificial Sequence
  Description of Artificial Sequence:  Hypothetical Probe Sequence
atcgttaggtgcaccttgcgccta

SEQ ID NO: 1832 - DNA, 24 bp, Artificial Sequence
  Description of Artificial Sequence:  Hypothetical Probe Sequence
atcgaatccgttacggtgcgtgtc

SEQ ID NO: 1833 - DNA, 24 bp, Artificial Sequence
  Description of Artificial Sequence:  Hypothetical Probe Sequence
atcgaatcctcaatcggcaacacg

SEQ ID NO: 1834 - DNA, 24 bp, Artificial Sequence
  Description of Artificial Sequence:  Hypothetical Probe Sequence
atcgaatcatcgggacagccacgg

SEQ ID NO: 1835 - DNA, 24 bp, Artificial Sequence
  Description of Artificial Sequence:  Hypothetical Probe Sequence
atcgaatcgacctgcgtcccatcg

SEQ ID NO: 1836 - DNA, 24 bp, Artificial Sequence
  Description of Artificial Sequence:  Hypothetical Probe Sequence
atcgaatcggaccttgatcggtgc

SEQ ID NO: 1837 - DNA, 24 bp, Artificial Sequence
  Description of Artificial Sequence:  Hypothetical Probe Sequence
atcgatacgctttgcgctgtatcg

SEQ ID NO: 1838 - DNA, 24 bp, Artificial Sequence
  Description of Artificial Sequence:  Hypothetical Probe Sequence
atcgataccagcccattgcggcaa

SEQ ID NO: 1839 - DNA, 24 bp, Artificial Sequence
  Description of Artificial Sequence:  Hypothetical Probe Sequence
atcgatacacggttgaacggcgaa

SEQ ID NO: 1840 - DNA, 24 bp, Artificial Sequence
  Description of Artificial Sequence:  Hypothetical Probe Sequence
atcgtctgccatgcttcacgacgg

SEQ ID NO: 1841 - DNA, 24 bp, Artificial Sequence
  Description of Artificial Sequence:  Hypothetical Probe Sequence
atcgtctgcctaagccgatgacgg

SEQ ID NO: 1842 - DNA, 24 bp, Artificial Sequence
  Description of Artificial Sequence:  Hypothetical Probe Sequence
atcgtctgcagcggacagtggcaa

SEQ ID NO: 1843 - DNA, 24 bp, Artificial Sequence
  Description of Artificial Sequence:  Hypothetical Probe Sequence
atcgtgtcccattcgtgcaacacg

SEQ ID NO: 1844 - DNA, 24 bp, Artificial Sequence
  Description of Artificial Sequence:  Hypothetical Probe Sequence
atcgtgtcgtgcgatgacggtgcg

SEQ ID NO: 1845 - DNA, 24 bp, Artificial Sequence
  Description of Artificial Sequence:  Hypothetical Probe Sequence
atcgtcgtttgacacgggacgcaa

SEQ ID NO: 1846 - DNA, 24 bp, Artificial Sequence
  Description of Artificial Sequence:  Hypothetical Probe Sequence
atcgtcgtgatgggacgctttccc

SEQ ID NO: 1847 - DNA, 24 bp, Artificial Sequence
  Description of Artificial Sequence:  Hypothetical Probe Sequence
atcgtcgtgtgcttgactgttgcg

SEQ ID NO: 1848 - DNA, 24 bp, Artificial Sequence
  Description of Artificial Sequence:  Hypothetical Probe Sequence
atcgtcgtagcccagctctgcgaa

SEQ ID NO: 1849 - DNA, 24 bp, Artificial Sequence
  Description of Artificial Sequence:  Hypothetical Probe Sequence
atcgcttgcttgcgaagcaagctt

SEQ ID NO: 1850 - DNA, 24 bp, Artificial Sequence
  Description of Artificial Sequence:  Hypothetical Probe Sequence
atcgcttgggtatcgttgcgttga

SEQ ID NO: 1851 - DNA, 24 bp, Artificial Sequence
  Description of Artificial Sequence:  Hypothetical Probe Sequence
atcgcttgaccttgtcgctttccc

SEQ ID NO: 1852 - DNA, 24 bp, Artificial Sequence
  Description of Artificial Sequence:  Hypothetical Probe Sequence
atcgcttgcctatgatcagcagcc

SEQ ID NO: 1853 - DNA, 24 bp, Artificial Sequence
  Description of Artificial Sequence:  Hypothetical Probe Sequence
atcgcttgcacggagttcccacct

SEQ ID NO: 1854 - DNA, 24 bp, Artificial Sequence
  Description of Artificial Sequence:  Hypothetical Probe Sequence
atcgcgtttgatacggtctggtgc

SEQ ID NO: 1855 - DNA, 24 bp, Artificial Sequence
  Description of Artificial Sequence:  Hypothetical Probe Sequence
atcgcgttttaggcttagccgctt

SEQ ID NO: 1856 - DNA, 24 bp, Artificial Sequence
  Description of Artificial Sequence:  Hypothetical Probe Sequence
atcgcgttaaagcacggtctgtgc

SEQ ID NO: 1857 - DNA, 24 bp, Artificial Sequence
  Description of Artificial Sequence:  Hypothetical Probe Sequence
atcgcgttcttgggtaagccacct

SEQ ID NO: 1858 - DNA, 24 bp, Artificial Sequence
  Description of Artificial Sequence:  Hypothetical Probe Sequence
atcgcgttcgttcagcatcggagt

SEQ ID NO: 1859 - DNA, 24 bp, Artificial Sequence
  Description of Artificial Sequence:  Hypothetical Probe Sequence
atcgcgttctgttccccgaaccta

SEQ ID NO: 1860 - DNA, 24 bp, Artificial Sequence
  Description of Artificial Sequence:  Hypothetical Probe Sequence
atcgcgttggtatgtccagcgagt

SEQ ID NO: 1861 - DNA, 24 bp, Artificial Sequence
  Description of Artificial Sequence:  Hypothetical Probe Sequence
atcgcgttagtgtctgacggcacg

SEQ ID NO: 1862 - DNA, 24 bp, Artificial Sequence
  Description of Artificial Sequence:  Hypothetical Probe Sequence
atcgcgttatcggcttagtgcacg

SEQ ID NO: 1863 - DNA, 24 bp, Artificial Sequence
  Description of Artificial Sequence:  Hypothetical Probe Sequence
atcgcgttgatgtacaccattgcg

SEQ ID NO: 1864 - DNA, 24 bp, Artificial Sequence
  Description of Artificial Sequence:  Hypothetical Probe Sequence
atcgcgttggactacaagcccttg

SEQ ID NO: 1865 - DNA, 24 bp, Artificial Sequence
  Description of Artificial Sequence:  Hypothetical Probe Sequence
atcgctcatgatacggtccccacg

SEQ ID NO: 1866 - DNA, 24 bp, Artificial Sequence
  Description of Artificial Sequence:  Hypothetical Probe Sequence
atcgctcacgtttgcgacctgtgc

SEQ ID NO: 1867 - DNA, 24 bp, Artificial Sequence
  Description of Artificial Sequence:  Hypothetical Probe Sequence
atcgctcagatggcaagacctgcg

SEQ ID NO: 1868 - DNA, 24 bp, Artificial Sequence
  Description of Artificial Sequence:  Hypothetical Probe Sequence
atcgctgttgattcccagcctgcg

SEQ ID NO: 1869 - DNA, 24 bp, Artificial Sequence
  Description of Artificial Sequence:  Hypothetical Probe Sequence
atcgctgttgtccacgcacgggac

SEQ ID NO: 1870 - DNA, 24 bp, Artificial Sequence
  Description of Artificial Sequence:  Hypothetical Probe Sequence
atcgctgtcttgccattgcgcagc

SEQ ID NO: 1871 - DNA, 24 bp, Artificial Sequence
  Description of Artificial Sequence:  Hypothetical Probe Sequence
atcgctgtgcaatgcgtgtcctgt

SEQ ID NO: 1872 - DNA, 24 bp, Artificial Sequence
  Description of Artificial Sequence:  Hypothetical Probe Sequence
atcgctgttgcgcgtttgatcagc

SEQ ID NO: 1873 - DNA, 24 bp, Artificial Sequence
  Description of Artificial Sequence:  Hypothetical Probe Sequence
atcgctgtcacgaatctgcgctgt

SEQ ID NO: 1874 - DNA, 24 bp, Artificial Sequence
  Description of Artificial Sequence:  Hypothetical Probe Sequence
atcgctgtgaccgaccctcatgcg

SEQ ID NO: 1875 - DNA, 24 bp, Artificial Sequence
  Description of Artificial Sequence:  Hypothetical Probe Sequence
atcgccatttgatgcgtgatcgaa

SEQ ID NO: 1876 - DNA, 24 bp, Artificial Sequence
  Description of Artificial Sequence:  Hypothetical Probe Sequence
atcgccattgatcgaacttgcgaa

SEQ ID NO: 1877 - DNA, 24 bp, Artificial Sequence
  Description of Artificial Sequence:  Hypothetical Probe Sequence
atcgccattcgtaatccgttcgtt

SEQ ID NO: 1878 - DNA, 24 bp, Artificial Sequence
  Description of Artificial Sequence:  Hypothetical Probe Sequence
atcgccatcttgaaagcttggctt

SEQ ID NO: 1879 - DNA, 24 bp, Artificial Sequence
  Description of Artificial Sequence:  Hypothetical Probe Sequence
atcgccatctcacttgcgaaacgg

SEQ ID NO: 1880 - DNA, 24 bp, Artificial Sequence
  Description of Artificial Sequence:  Hypothetical Probe Sequence
atcgccatgcttctgtgtgctcgt

SEQ ID NO: 1881 - DNA, 24 bp, Artificial Sequence
  Description of Artificial Sequence:  Hypothetical Probe Sequence
atcgccataggaagcccgttctca

SEQ ID NO: 1882 - DNA, 24 bp, Artificial Sequence
  Description of Artificial Sequence:  Hypothetical Probe Sequence
atcgccatcctaaggaacggtcgt

SEQ ID NO: 1883 - DNA, 24 bp, Artificial Sequence
  Description of Artificial Sequence:  Hypothetical Probe Sequence
atcgccatgtgcttaggcaaatcg

SEQ ID NO: 1884 - DNA, 24 bp, Artificial Sequence
  Description of Artificial Sequence:  Hypothetical Probe Sequence
atcgcgaaatacctcatcccacgg

SEQ ID NO: 1885 - DNA, 24 bp, Artificial Sequence
  Description of Artificial Sequence:  Hypothetical Probe Sequence
atcgcgaatctgctcatgcgaaag

SEQ ID NO: 1886 - DNA, 24 bp, Artificial Sequence
  Description of Artificial Sequence:  Hypothetical Probe Sequence
atcgcgaatcgtggtaaatcgtgc

SEQ ID NO: 1887 - DNA, 24 bp, Artificial Sequence
  Description of Artificial Sequence:  Hypothetical Probe Sequence
atcgcgaactgtcttgcacgagcc

SEQ ID NO: 1888 - DNA, 24 bp, Artificial Sequence
  Description of Artificial Sequence:  Hypothetical Probe Sequence
atcgcgaaggtattgagaccagcc

SEQ ID NO: 1889 - DNA, 24 bp, Artificial Sequence
  Description of Artificial Sequence:  Hypothetical Probe Sequence
atcgcgaagtctcgaagcaaagga

SEQ ID NO: 1890 - DNA, 24 bp, Artificial Sequence
  Description of Artificial Sequence:  Hypothetical Probe Sequence
atcgcgaaacctccatggtatccc

SEQ ID NO: 1891 - DNA, 24 bp, Artificial Sequence
  Description of Artificial Sequence:  Hypothetical Probe Sequence
atcgcgaacctacagctcgtagcc

SEQ ID NO: 1892 - DNA, 24 bp, Artificial Sequence
  Description of Artificial Sequence:  Hypothetical Probe Sequence
atcgcgaatgcgtgtcgcaactgt

SEQ ID NO: 1893 - DNA, 24 bp, Artificial Sequence
  Description of Artificial Sequence:  Hypothetical Probe Sequence
atcgcgaagaccataccacgacgg

SEQ ID NO: 1894 - DNA, 24 bp, Artificial Sequence
  Description of Artificial Sequence:  Hypothetical Probe Sequence
atcggcttttagccatcagctgcg

SEQ ID NO: 1895 - DNA, 24 bp, Artificial Sequence
  Description of Artificial Sequence:  Hypothetical Probe Sequence
atcggctttacaccatgtgcggac

SEQ ID NO: 1896 - DNA, 24 bp, Artificial Sequence
  Description of Artificial Sequence:  Hypothetical Probe Sequence
atcggctttctgttgacagcgacc

SEQ ID NO: 1897 - DNA, 24 bp, Artificial Sequence
  Description of Artificial Sequence:  Hypothetical Probe Sequence
atcggcttcgttgaccacctggac

SEQ ID NO: 1898 - DNA, 24 bp, Artificial Sequence
  Description of Artificial Sequence:  Hypothetical Probe Sequence
atcggcttctgtatcggacccagc

SEQ ID NO: 1899 - DNA, 24 bp, Artificial Sequence
  Description of Artificial Sequence:  Hypothetical Probe Sequence
atcggcttgtgcttagcagcctca

SEQ ID NO: 1900 - DNA, 24 bp, Artificial Sequence
  Description of Artificial Sequence:  Hypothetical Probe Sequence
atcgggtacgttaggacacgcgtt

SEQ ID NO: 1901 - DNA, 24 bp, Artificial Sequence
  Description of Artificial Sequence:  Hypothetical Probe Sequence
atcgggtagcaagtctcagcgtgc

SEQ ID NO: 1902 - DNA, 24 bp, Artificial Sequence
  Description of Artificial Sequence:  Hypothetical Probe Sequence
atcgggtaaggaacctgcaagcaa

SEQ ID NO: 1903 - DNA, 24 bp, Artificial Sequence
  Description of Artificial Sequence:  Hypothetical Probe Sequence
atcgggtatcccaggaccatcgaa

SEQ ID NO: 1904 - DNA, 24 bp, Artificial Sequence
  Description of Artificial Sequence:  Hypothetical Probe Sequence
atcgggtaacggtacagcaaagcc

SEQ ID NO: 1905 - DNA, 24 bp, Artificial Sequence
  Description of Artificial Sequence:  Hypothetical Probe Sequence
atcgggtaagcctgatacggagcc

SEQ ID NO: 1906 - DNA, 24 bp, Artificial Sequence
  Description of Artificial Sequence:  Hypothetical Probe Sequence
atcggtctcgaaaatcgcaacgaa

SEQ ID NO: 1907 - DNA, 24 bp, Artificial Sequence
  Description of Artificial Sequence:  Hypothetical Probe Sequence
atcggtctgcttagccggtaagcc

SEQ ID NO: 1908 - DNA, 24 bp, Artificial Sequence
  Description of Artificial Sequence:  Hypothetical Probe Sequence
atcggtctatcgcacgggaccagc

SEQ ID NO: 1909 - DNA, 24 bp, Artificial Sequence
  Description of Artificial Sequence:  Hypothetical Probe Sequence
atcggtctacggccatggaccttg

SEQ ID NO: 1910 - DNA, 24 bp, Artificial Sequence
  Description of Artificial Sequence:  Hypothetical Probe Sequence
atcggagtgcaagcttgaccggac

SEQ ID NO: 1911 - DNA, 24 bp, Artificial Sequence
  Description of Artificial Sequence:  Hypothetical Probe Sequence
atcggagtatcgcttgcagcgcaa

SEQ ID NO: 1912 - DNA, 24 bp, Artificial Sequence
  Description of Artificial Sequence:  Hypothetical Probe Sequence
atcggagtcagcttagacggcacg

SEQ ID NO: 1913 - DNA, 24 bp, Artificial Sequence
  Description of Artificial Sequence:  Hypothetical Probe Sequence
atcggcaatgattgcgacctgacc

SEQ ID NO: 1914 - DNA, 24 bp, Artificial Sequence
  Description of Artificial Sequence:  Hypothetical Probe Sequence
atcggcaatacaaatcgcaaagcc

SEQ ID NO: 1915 - DNA, 24 bp, Artificial Sequence
  Description of Artificial Sequence:  Hypothetical Probe Sequence
atcggcaatgtctccctctgcacg

SEQ ID NO: 1916 - DNA, 24 bp, Artificial Sequence
  Description of Artificial Sequence:  Hypothetical Probe Sequence
atcggcaactcaaaagggaccacg

SEQ ID NO: 1917 - DNA, 24 bp, Artificial Sequence
  Description of Artificial Sequence:  Hypothetical Probe Sequence
atcggcaaccataccttctggcaa

SEQ ID NO: 1918 - DNA, 24 bp, Artificial Sequence
  Description of Artificial Sequence:  Hypothetical Probe Sequence
atcggcaagcttttagatcgcgaa

SEQ ID NO: 1919 - DNA, 24 bp, Artificial Sequence
  Description of Artificial Sequence:  Hypothetical Probe Sequence
atcggcaagagtagccgtctgtgc

SEQ ID NO: 1920 - DNA, 24 bp, Artificial Sequence
  Description of Artificial Sequence:  Hypothetical Probe Sequence
atcggcaagcaatcgtagtggcaa

SEQ ID NO: 1921 - DNA, 24 bp, Artificial Sequence
  Description of Artificial Sequence:  Hypothetical Probe Sequence
atcggcaaagtgcttgatcgtccc

SEQ ID NO: 1922 - DNA, 24 bp, Artificial Sequence
  Description of Artificial Sequence:  Hypothetical Probe Sequence
atcggcaaaggaagtggtgctcgt

SEQ ID NO: 1923 - DNA, 24 bp, Artificial Sequence
  Description of Artificial Sequence:  Hypothetical Probe Sequence
atcggcaacagcagtgctgtgtgc

SEQ ID NO: 1924 - DNA, 24 bp, Artificial Sequence
  Description of Artificial Sequence:  Hypothetical Probe Sequence
atcggcaaggactgtcggtaatcg

SEQ ID NO: 1925 - DNA, 24 bp, Artificial Sequence
  Description of Artificial Sequence:  Hypothetical Probe Sequence
atcgagtgcgaatgatggaccacg

SEQ ID NO: 1926 - DNA, 24 bp, Artificial Sequence
  Description of Artificial Sequence:  Hypothetical Probe Sequence
atcgagtgcctatgcgctcacagc

SEQ ID NO: 1927 - DNA, 24 bp, Artificial Sequence
  Description of Artificial Sequence:  Hypothetical Probe Sequence
atcgagtggtgcttgaacggagcc

SEQ ID NO: 1928 - DNA, 24 bp, Artificial Sequence
  Description of Artificial Sequence:  Hypothetical Probe Sequence
atcgacctggtaacggcacggacc

SEQ ID NO: 1929 - DNA, 24 bp, Artificial Sequence
  Description of Artificial Sequence:  Hypothetical Probe Sequence
atcgacctgcaatctgaggaacgg

SEQ ID NO: 1930 - DNA, 24 bp, Artificial Sequence
  Description of Artificial Sequence:  Hypothetical Probe Sequence
atcgacctggaccacgtgcgtcgt

SEQ ID NO: 1931 - DNA, 24 bp, Artificial Sequence
  Description of Artificial Sequence:  Hypothetical Probe Sequence
atcgatcgctgtatcgcagccgaa

SEQ ID NO: 1932 - DNA, 24 bp, Artificial Sequence
  Description of Artificial Sequence:  Hypothetical Probe Sequence
atcgatcggcttaggagacccgtt

SEQ ID NO: 1933 - DNA, 24 bp, Artificial Sequence
  Description of Artificial Sequence:  Hypothetical Probe Sequence
atcgatcgaggaagccggacaatc

SEQ ID NO: 1934 - DNA, 24 bp, Artificial Sequence
  Description of Artificial Sequence:  Hypothetical Probe Sequence
atcgatcggtgccgtttgtcagcc

SEQ ID NO: 1935 - DNA, 24 bp, Artificial Sequence
  Description of Artificial Sequence:  Hypothetical Probe Sequence
atcgaggaacctgcttagcccacg

SEQ ID NO: 1936 - DNA, 24 bp, Artificial Sequence
  Description of Artificial Sequence:  Hypothetical Probe Sequence
atcgaggaatcggtgcctgtgcaa

SEQ ID NO: 1937 - DNA, 24 bp, Artificial Sequence
  Description of Artificial Sequence:  Hypothetical Probe Sequence
atcgcctatgatacggcagcctca

SEQ ID NO: 1938 - DNA, 24 bp, Artificial Sequence
  Description of Artificial Sequence:  Hypothetical Probe Sequence
atcgcctaaaagctcaagccacgg

SEQ ID NO: 1939 - DNA, 24 bp, Artificial Sequence
  Description of Artificial Sequence:  Hypothetical Probe Sequence
atcgcctatgtcccattgcgagcc

SEQ ID NO: 1940 - DNA, 24 bp, Artificial Sequence
  Description of Artificial Sequence:  Hypothetical Probe Sequence
atcgcctacgtttcgtccattccc

SEQ ID NO: 1941 - DNA, 24 bp, Artificial Sequence
  Description of Artificial Sequence:  Hypothetical Probe Sequence
atcgcctagctttcccctcatcgt

SEQ ID NO: 1942 - DNA, 24 bp, Artificial Sequence
  Description of Artificial Sequence:  Hypothetical Probe Sequence
atcgcctaaggaatacacggcacg

SEQ ID NO: 1943 - DNA, 24 bp, Artificial Sequence
  Description of Artificial Sequence:  Hypothetical Probe Sequence
atcgcctatgcgggtatcgttcgt

SEQ ID NO: 1944 - DNA, 24 bp, Artificial Sequence
  Description of Artificial Sequence:  Hypothetical Probe Sequence
atcgcctacacggcttcgtttcgt

SEQ ID NO: 1945 - DNA, 24 bp, Artificial Sequence
  Description of Artificial Sequence:  Hypothetical Probe Sequence
atcggatgttgagcaaagcctgcg

SEQ ID NO: 1946 - DNA, 24 bp, Artificial Sequence
  Description of Artificial Sequence:  Hypothetical Probe Sequence
atcggatgtcgtggacgaccagcc

SEQ ID NO: 1947 - DNA, 24 bp, Artificial Sequence
  Description of Artificial Sequence:  Hypothetical Probe Sequence
atcggatgctcaacggaatccgtt

SEQ ID NO: 1948 - DNA, 24 bp, Artificial Sequence
  Description of Artificial Sequence:  Hypothetical Probe Sequence
atcggatgctgtcgttacggatcg

SEQ ID NO: 1949 - DNA, 24 bp, Artificial Sequence
  Description of Artificial Sequence:  Hypothetical Probe Sequence
atcggatggtctgtgccagcggac

SEQ ID NO: 1950 - DNA, 24 bp, Artificial Sequence
  Description of Artificial Sequence:  Hypothetical Probe Sequence
atcggatgatcgaggaacggggac

SEQ ID NO: 1951 - DNA, 24 bp, Artificial Sequence
  Description of Artificial Sequence:  Hypothetical Probe Sequence
atcggatgcctagtcttccccacg

SEQ ID NO: 1952 - DNA, 24 bp, Artificial Sequence
  Description of Artificial Sequence:  Hypothetical Probe Sequence
atcggatgtgcgcttgtgattgcg

SEQ ID NO: 1953 - DNA, 24 bp, Artificial Sequence
  Description of Artificial Sequence:  Hypothetical Probe Sequence
atcggatgcacgcttggcttggac

SEQ ID NO: 1954 - DNA, 24 bp, Artificial Sequence
  Description of Artificial Sequence:  Hypothetical Probe Sequence
atcggatgcagcttagtgcggatg

SEQ ID NO: 1955 - DNA, 24 bp, Artificial Sequence
  Description of Artificial Sequence:  Hypothetical Probe Sequence
atcggatgggacagcctgatgcaa

SEQ ID NO: 1956 - DNA, 24 bp, Artificial Sequence
  Description of Artificial Sequence:  Hypothetical Probe Sequence
atcggatgacggcttgtcccgatg

SEQ ID NO: 1957 - DNA, 24 bp, Artificial Sequence
  Description of Artificial Sequence:  Hypothetical Probe Sequence
atcgtccctgtccgaatgcgcacg

SEQ ID NO: 1958 - DNA, 24 bp, Artificial Sequence
  Description of Artificial Sequence:  Hypothetical Probe Sequence
atcgtcccaggatcgtgcttagcc

SEQ ID NO: 1959 - DNA, 24 bp, Artificial Sequence
  Description of Artificial Sequence:  Hypothetical Probe Sequence
atcgtcccgatgcctacgtttccc

SEQ ID NO: 1960 - DNA, 24 bp, Artificial Sequence
  Description of Artificial Sequence:  Hypothetical Probe Sequence
atcgtgcgttgatgtccgttagcc

SEQ ID NO: 1961 - DNA, 24 bp, Artificial Sequence
  Description of Artificial Sequence:  Hypothetical Probe Sequence
atcgtgcgttagtccctccccgtt

SEQ ID NO: 1962 - DNA, 24 bp, Artificial Sequence
  Description of Artificial Sequence:  Hypothetical Probe Sequence
atcgtgcgcttgcttgcacgtgat

SEQ ID NO: 1963 - DNA, 24 bp, Artificial Sequence
  Description of Artificial Sequence:  Hypothetical Probe Sequence
atcgtgcgctcatgtctcccaaag

SEQ ID NO: 1964 - DNA, 24 bp, Artificial Sequence
  Description of Artificial Sequence:  Hypothetical Probe Sequence
atcgtgcgccatcctagcaaatcg

SEQ ID NO: 1965 - DNA, 24 bp, Artificial Sequence
  Description of Artificial Sequence:  Hypothetical Probe Sequence
atcgtgcggcttccataatcgacc

SEQ ID NO: 1966 - DNA, 24 bp, Artificial Sequence
  Description of Artificial Sequence:  Hypothetical Probe Sequence
atcgtgcggagtgctttcgtgacc

SEQ ID NO: 1967 - DNA, 24 bp, Artificial Sequence
  Description of Artificial Sequence:  Hypothetical Probe Sequence
atcgtgcgtccccagcaaagagga

SEQ ID NO: 1968 - DNA, 24 bp, Artificial Sequence
  Description of Artificial Sequence:  Hypothetical Probe Sequence
atcgtgcgcacgtacaagccacct

SEQ ID NO: 1969 - DNA, 24 bp, Artificial Sequence
  Description of Artificial Sequence:  Hypothetical Probe Sequence
atcgtgcggtgcggtaccattcgt

SEQ ID NO: 1970 - DNA, 24 bp, Artificial Sequence
  Description of Artificial Sequence:  Hypothetical Probe Sequence
atcgcacgaaaggaccgcttgatg

SEQ ID NO: 1971 - DNA, 24 bp, Artificial Sequence
  Description of Artificial Sequence:  Hypothetical Probe Sequence
atcgcacgcttggtctacggacgg

SEQ ID NO: 1972 - DNA, 24 bp, Artificial Sequence
  Description of Artificial Sequence:  Hypothetical Probe Sequence
atcgcacgcgaagagtcgttcgaa

SEQ ID NO: 1973 - DNA, 24 bp, Artificial Sequence
  Description of Artificial Sequence:  Hypothetical Probe Sequence
atcgcacggcttacctcacgggta

SEQ ID NO: 1974 - DNA, 24 bp, Artificial Sequence
  Description of Artificial Sequence:  Hypothetical Probe Sequence
atcgcacgagtgttagtgcgcgtt

SEQ ID NO: 1975 - DNA, 24 bp, Artificial Sequence
  Description of Artificial Sequence:  Hypothetical Probe Sequence
atcgcacgacctgcaaaggagtgc

SEQ ID NO: 1976 - DNA, 24 bp, Artificial Sequence
  Description of Artificial Sequence:  Hypothetical Probe Sequence
atcgcacgtcccctcacgaagctt

SEQ ID NO: 1977 - DNA, 24 bp, Artificial Sequence
  Description of Artificial Sequence:  Hypothetical Probe Sequence
atcgcacgtgcgctcagtgcatcg

SEQ ID NO: 1978 - DNA, 24 bp, Artificial Sequence
  Description of Artificial Sequence:  Hypothetical Probe Sequence
atcgcacgacggctgtgcaaacct

SEQ ID NO: 1979 - DNA, 24 bp, Artificial Sequence
  Description of Artificial Sequence:  Hypothetical Probe Sequence
atcgcacgagccatacgaccgatg

SEQ ID NO: 1980 - DNA, 24 bp, Artificial Sequence
  Description of Artificial Sequence:  Hypothetical Probe Sequence
atcgcagcttagcgaagcaagcaa

SEQ ID NO: 1981 - DNA, 24 bp, Artificial Sequence
  Description of Artificial Sequence:  Hypothetical Probe Sequence
atcgcagctctgttgaggactgcg

SEQ ID NO: 1982 - DNA, 24 bp, Artificial Sequence
  Description of Artificial Sequence:  Hypothetical Probe Sequence
atcgcagctgtcgagtgtgcgcaa

SEQ ID NO: 1983 - DNA, 24 bp, Artificial Sequence
  Description of Artificial Sequence:  Hypothetical Probe Sequence
atcgcagctcgtcctacagcggac

SEQ ID NO: 1984 - DNA, 24 bp, Artificial Sequence
  Description of Artificial Sequence:  Hypothetical Probe Sequence
atcgcagcgtctcttgggacccta

SEQ ID NO: 1985 - DNA, 24 bp, Artificial Sequence
  Description of Artificial Sequence:  Hypothetical Probe Sequence
atcgcagcagtgtgtccgttcgtt

SEQ ID NO: 1986 - DNA, 24 bp, Artificial Sequence
  Description of Artificial Sequence:  Hypothetical Probe Sequence
atcgcagcatcgatacgtgcacct

SEQ ID NO: 1987 - DNA, 24 bp, Artificial Sequence
  Description of Artificial Sequence:  Hypothetical Probe Sequence
atcgcagcggacatactgcgagga

SEQ ID NO: 1988 - DNA, 24 bp, Artificial Sequence
  Description of Artificial Sequence:  Hypothetical Probe Sequence
atcgcagcacggctcacgaagtgc

SEQ ID NO: 1989 - DNA, 24 bp, Artificial Sequence
  Description of Artificial Sequence:  Hypothetical Probe Sequence
atcggacctacaagccgaccctgt

SEQ ID NO: 1990 - DNA, 24 bp, Artificial Sequence
  Description of Artificial Sequence:  Hypothetical Probe Sequence
atcggacccgttccattctggtgc

SEQ ID NO: 1991 - DNA, 24 bp, Artificial Sequence
  Description of Artificial Sequence:  Hypothetical Probe Sequence
atcggaccgcaagatgtgtcgtgc

SEQ ID NO: 1992 - DNA, 24 bp, Artificial Sequence
  Description of Artificial Sequence:  Hypothetical Probe Sequence
atcggaccatcgagtggcttcgaa

SEQ ID NO: 1993 - DNA, 24 bp, Artificial Sequence
  Description of Artificial Sequence:  Hypothetical Probe Sequence
atcggacctgcgtgtcaatcccat

SEQ ID NO: 1994 - DNA, 24 bp, Artificial Sequence
  Description of Artificial Sequence:  Hypothetical Probe Sequence
atcggaccggacttgacgtttgtc

SEQ ID NO: 1995 - DNA, 24 bp, Artificial Sequence
  Description of Artificial Sequence:  Hypothetical Probe Sequence
atcggaccacggccataggagcaa

SEQ ID NO: 1996 - DNA, 24 bp, Artificial Sequence
  Description of Artificial Sequence:  Hypothetical Probe Sequence
atcggtgcttgatgatcagccgaa

SEQ ID NO: 1997 - DNA, 24 bp, Artificial Sequence
  Description of Artificial Sequence:  Hypothetical Probe Sequence
atcggtgctgtcacctacgggcaa

SEQ ID NO: 1998 - DNA, 24 bp, Artificial Sequence
  Description of Artificial Sequence:  Hypothetical Probe Sequence
atcggtgcctcacgaacctacacg

SEQ ID NO: 1999 - DNA, 24 bp, Artificial Sequence
  Description of Artificial Sequence:  Hypothetical Probe Sequence
atcggtgcggtagtctgaccggta

SEQ ID NO: 2000 - DNA, 24 bp, Artificial Sequence
  Description of Artificial Sequence:  Hypothetical Probe Sequence
atcggtgcgatgttaggcaagtgc

SEQ ID NO: 2001 - DNA, 24 bp, Artificial Sequence
  Description of Artificial Sequence:  Hypothetical Probe Sequence
atcggtgccacgctgtggacgctt

SEQ ID NO: 2002 - DNA, 24 bp, Artificial Sequence
  Description of Artificial Sequence:  Hypothetical Probe Sequence
atcggtgcggacagtgcacgaaag

SEQ ID NO: 2003 - DNA, 24 bp, Artificial Sequence
  Description of Artificial Sequence:  Hypothetical Probe Sequence
atcggtgcagccgagtcgttagcc

SEQ ID NO: 2004 - DNA, 24 bp, Artificial Sequence
  Description of Artificial Sequence:  Hypothetical Probe Sequence
atcgggacaaagacggctgttccc

SEQ ID NO: 2005 - DNA, 24 bp, Artificial Sequence
  Description of Artificial Sequence:  Hypothetical Probe Sequence
atcgggaccgttcctatccctctg

SEQ ID NO: 2006 - DNA, 24 bp, Artificial Sequence
  Description of Artificial Sequence:  Hypothetical Probe Sequence
atcgggaccgaagagtacggggac

SEQ ID NO: 2007 - DNA, 24 bp, Artificial Sequence
  Description of Artificial Sequence:  Hypothetical Probe Sequence
atcgggacgcttgatgtcgtcacg

SEQ ID NO: 2008 - DNA, 24 bp, Artificial Sequence
  Description of Artificial Sequence:  Hypothetical Probe Sequence
atcgggacggtaggtaaaagcacg

SEQ ID NO: 2009 - DNA, 24 bp, Artificial Sequence
  Description of Artificial Sequence:  Hypothetical Probe Sequence
atcgggacgagtaaagtccccacg

SEQ ID NO: 2010 - DNA, 24 bp, Artificial Sequence
  Description of Artificial Sequence:  Hypothetical Probe Sequence
atcgggacacctggtatccccgtt

SEQ ID NO: 2011 - DNA, 24 bp, Artificial Sequence
  Description of Artificial Sequence:  Hypothetical Probe Sequence
atcgggactcccttgacttggcaa

SEQ ID NO: 2012 - DNA, 24 bp, Artificial Sequence
  Description of Artificial Sequence:  Hypothetical Probe Sequence
atcgggacacggaggacgttcttg

SEQ ID NO: 2013 - DNA, 24 bp, Artificial Sequence
  Description of Artificial Sequence:  Hypothetical Probe Sequence
atcgacggttgatctggtgctgcg

SEQ ID NO: 2014 - DNA, 24 bp, Artificial Sequence
  Description of Artificial Sequence:  Hypothetical Probe Sequence
atcgacggatacacggagccgcaa

SEQ ID NO: 2015 - DNA, 24 bp, Artificial Sequence
  Description of Artificial Sequence:  Hypothetical Probe Sequence
atcgacggtacaacgggaccggac

SEQ ID NO: 2016 - DNA, 24 bp, Artificial Sequence
  Description of Artificial Sequence:  Hypothetical Probe Sequence
atcgacggcttgttagcttgcacg

SEQ ID NO: 2017 - DNA, 24 bp, Artificial Sequence
  Description of Artificial Sequence:  Hypothetical Probe Sequence
atcgacggctgttgatcgttgcaa

SEQ ID NO: 2018 - DNA, 24 bp, Artificial Sequence
  Description of Artificial Sequence:  Hypothetical Probe Sequence
atcgacggccattacaggtatgcg

SEQ ID NO: 2019 - DNA, 24 bp, Artificial Sequence
  Description of Artificial Sequence:  Hypothetical Probe Sequence
atcgacggatcgggtacgaaacct

SEQ ID NO: 2020 - DNA, 24 bp, Artificial Sequence
  Description of Artificial Sequence:  Hypothetical Probe Sequence
atcgacggaggacgaacgaaagtg

SEQ ID NO: 2021 - DNA, 24 bp, Artificial Sequence
  Description of Artificial Sequence:  Hypothetical Probe Sequence
atcgacgggatgagtgtcccggac

SEQ ID NO: 2022 - DNA, 24 bp, Artificial Sequence
  Description of Artificial Sequence:  Hypothetical Probe Sequence
atcgacggacggaatccagccgaa

SEQ ID NO: 2023 - DNA, 24 bp, Artificial Sequence
  Description of Artificial Sequence:  Hypothetical Probe Sequence
atcgacggagccccatacctcacg

SEQ ID NO: 2024 - DNA, 24 bp, Artificial Sequence
  Description of Artificial Sequence:  Hypothetical Probe Sequence
atcgagcctgatggtaagcccgtt

SEQ ID NO: 2025 - DNA, 24 bp, Artificial Sequence
  Description of Artificial Sequence:  Hypothetical Probe Sequence
atcgagccttaggaccgcttcacg

SEQ ID NO: 2026 - DNA, 24 bp, Artificial Sequence
  Description of Artificial Sequence:  Hypothetical Probe Sequence
atcgagcctgtctcccatcgtccc

SEQ ID NO: 2027 - DNA, 24 bp, Artificial Sequence
  Description of Artificial Sequence:  Hypothetical Probe Sequence
atcgagcccttgatcgacctcgtt

SEQ ID NO: 2028 - DNA, 24 bp, Artificial Sequence
  Description of Artificial Sequence:  Hypothetical Probe Sequence
atcgagccctgtgtctacggcgtt

SEQ ID NO: 2029 - DNA, 24 bp, Artificial Sequence
  Description of Artificial Sequence:  Hypothetical Probe Sequence
atcgagccggtaacctgcaaggac

SEQ ID NO: 2030 - DNA, 24 bp, Artificial Sequence
  Description of Artificial Sequence:  Hypothetical Probe Sequence
atcgagccgcaatgtcctgtcacg

SEQ ID NO: 2031 - DNA, 24 bp, Artificial Sequence
  Description of Artificial Sequence:  Hypothetical Probe Sequence
atcgagccaggaggtatctgcgaa

SEQ ID NO: 2032 - DNA, 24 bp, Artificial Sequence
  Description of Artificial Sequence:  Hypothetical Probe Sequence
atcgagcctccccgttttagtgcg

SEQ ID NO: 2033 - DNA, 24 bp, Artificial Sequence
  Description of Artificial Sequence:  Hypothetical Probe Sequence
atcgagccgaccttaggaccgagt

SEQ ID NO: 2034 - DNA, 24 bp, Artificial Sequence
  Description of Artificial Sequence:  Hypothetical Probe Sequence
aggatgatcgaaccattcccgctt

SEQ ID NO: 2035 - DNA, 24 bp, Artificial Sequence
  Description of Artificial Sequence:  Hypothetical Probe Sequence
aggattaggcaatcccgcaagatg

SEQ ID NO: 2036 - DNA, 24 bp, Artificial Sequence
  Description of Artificial Sequence:  Hypothetical Probe Sequence
aggaaatcgcaatctgacgggctt

SEQ ID NO: 2037 - DNA, 24 bp, Artificial Sequence
  Description of Artificial Sequence:  Hypothetical Probe Sequence
aggaaatcggactcgtcagcgctt

SEQ ID NO: 2038 - DNA, 24 bp, Artificial Sequence
  Description of Artificial Sequence:  Hypothetical Probe Sequence
aggaaaagccatccatgatgcacg

SEQ ID NO: 2039 - DNA, 24 bp, Artificial Sequence
  Description of Artificial Sequence:  Hypothetical Probe Sequence
aggaaaaggctttgcgcttgttga

SEQ ID NO: 2040 - DNA, 24 bp, Artificial Sequence
  Description of Artificial Sequence:  Hypothetical Probe Sequence
aggaaaagtccctgatgtgcgtgc

SEQ ID NO: 2041 - DNA, 24 bp, Artificial Sequence
  Description of Artificial Sequence:  Hypothetical Probe Sequence
aggaaaagcacgatcgaaaggcaa

SEQ ID NO: 2042 - DNA, 24 bp, Artificial Sequence
  Description of Artificial Sequence:  Hypothetical Probe Sequence
aggatctgcgttctgtcgtttgcg

SEQ ID NO: 2043 - DNA, 24 bp, Artificial Sequence
  Description of Artificial Sequence:  Hypothetical Probe Sequence
aggatctgcgaaacctcacgacgg

SEQ ID NO: 2044 - DNA, 24 bp, Artificial Sequence
  Description of Artificial Sequence:  Hypothetical Probe Sequence
aggatctgagccacggccatcgtt

SEQ ID NO: 2045 - DNA, 24 bp, Artificial Sequence
  Description of Artificial Sequence:  Hypothetical Probe Sequence
aggatgtccagctcgttgcgtgcg

SEQ ID NO: 2046 - DNA, 24 bp, Artificial Sequence
  Description of Artificial Sequence:  Hypothetical Probe Sequence
aggatcgtcgaaagcccttgcttg

SEQ ID NO: 2047 - DNA, 24 bp, Artificial Sequence
  Description of Artificial Sequence:  Hypothetical Probe Sequence
aggatcgtacggcagcgaccgatg

SEQ ID NO: 2048 - DNA, 24 bp, Artificial Sequence
  Description of Artificial Sequence:  Hypothetical Probe Sequence
aggacttggcttagccggacagtg

SEQ ID NO: 2049 - DNA, 24 bp, Artificial Sequence
  Description of Artificial Sequence:  Hypothetical Probe Sequence
aggacttgggtatgtcgtgccgtt

SEQ ID NO: 2050 - DNA, 24 bp, Artificial Sequence
  Description of Artificial Sequence:  Hypothetical Probe Sequence
aggacttggcaatgattcccggac

SEQ ID NO: 2051 - DNA, 24 bp, Artificial Sequence
  Description of Artificial Sequence:  Hypothetical Probe Sequence
aggacgttatcgatcgtcccgtgc

SEQ ID NO: 2052 - DNA, 24 bp, Artificial Sequence
  Description of Artificial Sequence:  Hypothetical Probe Sequence
aggacgttcagcgagttgcgccta

SEQ ID NO: 2053 - DNA, 24 bp, Artificial Sequence
  Description of Artificial Sequence:  Hypothetical Probe Sequence
aggacgttgtgcatcgcgttgacc

SEQ ID NO: 2054 - DNA, 24 bp, Artificial Sequence
  Description of Artificial Sequence:  Hypothetical Probe Sequence
aggacgttggacgtgctccctccc

SEQ ID NO: 2055 - DNA, 24 bp, Artificial Sequence
  Description of Artificial Sequence:  Hypothetical Probe Sequence
aggaccatgcaatgtcagccggac

SEQ ID NO: 2056 - DNA, 24 bp, Artificial Sequence
  Description of Artificial Sequence:  Hypothetical Probe Sequence
aggaccatagtggcaaggacacgg

SEQ ID NO: 2057 - DNA, 24 bp, Artificial Sequence
  Description of Artificial Sequence:  Hypothetical Probe Sequence
aggaccatcagcaaagccatgcaa

SEQ ID NO: 2058 - DNA, 24 bp, Artificial Sequence
  Description of Artificial Sequence:  Hypothetical Probe Sequence
aggaccatgtgctcccacggcgtt

SEQ ID NO: 2059 - DNA, 24 bp, Artificial Sequence
  Description of Artificial Sequence:  Hypothetical Probe Sequence
aggacgaacgttttagcagcgacc

SEQ ID NO: 2060 - DNA, 24 bp, Artificial Sequence
  Description of Artificial Sequence:  Hypothetical Probe Sequence
aggacgaaaccttctgccatgcaa

SEQ ID NO: 2061 - DNA, 24 bp, Artificial Sequence
  Description of Artificial Sequence:  Hypothetical Probe Sequence
aggacgaaacggggtaaaagccat

SEQ ID NO: 2062 - DNA, 24 bp, Artificial Sequence
  Description of Artificial Sequence:  Hypothetical Probe Sequence
aggagctttctgagcccacgatcg

SEQ ID NO: 2063 - DNA, 24 bp, Artificial Sequence
  Description of Artificial Sequence:  Hypothetical Probe Sequence
aggagcaaggaccgaaccattgcg

SEQ ID NO: 2064 - DNA, 24 bp, Artificial Sequence
  Description of Artificial Sequence:  Hypothetical Probe Sequence
aggagcaaacggacctcagcggta

SEQ ID NO: 2065 - DNA, 24 bp, Artificial Sequence
  Description of Artificial Sequence:  Hypothetical Probe Sequence
aggaagtgccatcgtttcccatcg

SEQ ID NO: 2066 - DNA, 24 bp, Artificial Sequence
  Description of Artificial Sequence:  Hypothetical Probe Sequence
aggaagtgcctacacgcacgagcc

SEQ ID NO: 2067 - DNA, 24 bp, Artificial Sequence
  Description of Artificial Sequence:  Hypothetical Probe Sequence
aggaagtgcagcatcgctcagcaa

SEQ ID NO: 2068 - DNA, 24 bp, Artificial Sequence
  Description of Artificial Sequence:  Hypothetical Probe Sequence
aggaagtgagcccctaagccacgg

SEQ ID NO: 2069 - DNA, 24 bp, Artificial Sequence
  Description of Artificial Sequence:  Hypothetical Probe Sequence
aggaacctcagcccatagccgctt

SEQ ID NO: 2070 - DNA, 24 bp, Artificial Sequence
  Description of Artificial Sequence:  Hypothetical Probe Sequence
aggaacctgaccgcttggacgtgc

SEQ ID NO: 2071 - DNA, 24 bp, Artificial Sequence
  Description of Artificial Sequence:  Hypothetical Probe Sequence
aggaatcgccatctgtgcttcgaa

SEQ ID NO: 2072 - DNA, 24 bp, Artificial Sequence
  Description of Artificial Sequence:  Hypothetical Probe Sequence
aggaatcgaccttcccgtgcgctt

SEQ ID NO: 2073 - DNA, 24 bp, Artificial Sequence
  Description of Artificial Sequence:  Hypothetical Probe Sequence
aggaatcgcagcggtagtgcccat

SEQ ID NO: 2074 - DNA, 24 bp, Artificial Sequence
  Description of Artificial Sequence:  Hypothetical Probe Sequence
aggaaggacacgatcgacggcagc

SEQ ID NO: 2075 - DNA, 24 bp, Artificial Sequence
  Description of Artificial Sequence:  Hypothetical Probe Sequence
aggagatggcaaatcgcacgccat

SEQ ID NO: 2076 - DNA, 24 bp, Artificial Sequence
  Description of Artificial Sequence:  Hypothetical Probe Sequence
aggatccccttggtctagccgcaa

SEQ ID NO: 2077 - DNA, 24 bp, Artificial Sequence
  Description of Artificial Sequence:  Hypothetical Probe Sequence
aggatcccgagttcgtgatggctt

SEQ ID NO: 2078 - DNA, 24 bp, Artificial Sequence
  Description of Artificial Sequence:  Hypothetical Probe Sequence
aggatgcgcgttcttgctgtggac

SEQ ID NO: 2079 - DNA, 24 bp, Artificial Sequence
  Description of Artificial Sequence:  Hypothetical Probe Sequence
aggatgcgagtgcgttgcaacacg

SEQ ID NO: 2080 - DNA, 24 bp, Artificial Sequence
  Description of Artificial Sequence:  Hypothetical Probe Sequence
aggatgcgtgcgacggtacacgtt

SEQ ID NO: 2081 - DNA, 24 bp, Artificial Sequence
  Description of Artificial Sequence:  Hypothetical Probe Sequence
aggatgcggtgctacacagcgctt

SEQ ID NO: 2082 - DNA, 24 bp, Artificial Sequence
  Description of Artificial Sequence:  Hypothetical Probe Sequence
aggacacgatacgatgcagctgcg

SEQ ID NO: 2083 - DNA, 24 bp, Artificial Sequence
  Description of Artificial Sequence:  Hypothetical Probe Sequence
aggacacgggtattgaacggacgg

SEQ ID NO: 2084 - DNA, 24 bp, Artificial Sequence
  Description of Artificial Sequence:  Hypothetical Probe Sequence
aggacacgacctagcctctgtgcg

SEQ ID NO: 2085 - DNA, 24 bp, Artificial Sequence
  Description of Artificial Sequence:  Hypothetical Probe Sequence
aggacacgcctaaaagggacgctt

SEQ ID NO: 2086 - DNA, 24 bp, Artificial Sequence
  Description of Artificial Sequence:  Hypothetical Probe Sequence
aggacacgggacgtcttgcgtcgt

SEQ ID NO: 2087 - DNA, 24 bp, Artificial Sequence
  Description of Artificial Sequence:  Hypothetical Probe Sequence
aggacagcatcggtgcagtgcacg

SEQ ID NO: 2088 - DNA, 24 bp, Artificial Sequence
  Description of Artificial Sequence:  Hypothetical Probe Sequence
aggacagcaggatgcggatgtccc

SEQ ID NO: 2089 - DNA, 24 bp, Artificial Sequence
  Description of Artificial Sequence:  Hypothetical Probe Sequence
aggacagccctatgtccagccgaa

SEQ ID NO: 2090 - DNA, 24 bp, Artificial Sequence
  Description of Artificial Sequence:  Hypothetical Probe Sequence
aggacagccacgttagtccccgaa

SEQ ID NO: 2091 - DNA, 24 bp, Artificial Sequence
  Description of Artificial Sequence:  Hypothetical Probe Sequence
aggagtgcatacgaccatcggcaa

SEQ ID NO: 2092 - DNA, 24 bp, Artificial Sequence
  Description of Artificial Sequence:  Hypothetical Probe Sequence
aggagtgcaaagtgcggtgcgacc

SEQ ID NO: 2093 - DNA, 24 bp, Artificial Sequence
  Description of Artificial Sequence:  Hypothetical Probe Sequence
aggagtgcgtctaaagcagcgtgc

SEQ ID NO: 2094 - DNA, 24 bp, Artificial Sequence
  Description of Artificial Sequence:  Hypothetical Probe Sequence
aggagtgccctacagcagtggtgc

SEQ ID NO: 2095 - DNA, 24 bp, Artificial Sequence
  Description of Artificial Sequence:  Hypothetical Probe Sequence
aggagtgcgacctcgttgtcggac

SEQ ID NO: 2096 - DNA, 24 bp, Artificial Sequence
  Description of Artificial Sequence:  Hypothetical Probe Sequence
aggaggaccttgtcccgcaaacgg

SEQ ID NO: 2097 - DNA, 24 bp, Artificial Sequence
  Description of Artificial Sequence:  Hypothetical Probe Sequence
aggaggacccatggactcccctca

SEQ ID NO: 2098 - DNA, 24 bp, Artificial Sequence
  Description of Artificial Sequence:  Hypothetical Probe Sequence
aggaggacgatgacctcacgcgtt

SEQ ID NO: 2099 - DNA, 24 bp, Artificial Sequence
  Description of Artificial Sequence:  Hypothetical Probe Sequence
aggaacggatcgcctaccatgcaa

SEQ ID NO: 2100 - DNA, 24 bp, Artificial Sequence
  Description of Artificial Sequence:  Hypothetical Probe Sequence
aggaacggaggacacgctgtgacc

SEQ ID NO: 2101 - DNA, 24 bp, Artificial Sequence
  Description of Artificial Sequence:  Hypothetical Probe Sequence
aggaacgggatggtctcagctccc

SEQ ID NO: 2102 - DNA, 24 bp, Artificial Sequence
  Description of Artificial Sequence:  Hypothetical Probe Sequence
aggaagccaaaggagttcccccat

SEQ ID NO: 2103 - DNA, 24 bp, Artificial Sequence
  Description of Artificial Sequence:  Hypothetical Probe Sequence
aggaagccctcaataccacgccat

SEQ ID NO: 2104 - DNA, 24 bp, Artificial Sequence
  Description of Artificial Sequence:  Hypothetical Probe Sequence
aggaagccagtgcagcccatccat

SEQ ID NO: 2105 - DNA, 24 bp, Artificial Sequence
  Description of Artificial Sequence:  Hypothetical Probe Sequence
aggaagcccacggcttttgacagc

SEQ ID NO: 2106 - DNA, 24 bp, Artificial Sequence
  Description of Artificial Sequence:  Hypothetical Probe Sequence
aggaagcccagccacgctgtgagt

SEQ ID NO: 2107 - DNA, 24 bp, Artificial Sequence
  Description of Artificial Sequence:  Hypothetical Probe Sequence
aggaagccgtgctgtcctcacacg

SEQ ID NO: 2108 - DNA, 24 bp, Artificial Sequence
  Description of Artificial Sequence:  Hypothetical Probe Sequence
cctattgatgcggcaatcgtcgtt

SEQ ID NO: 2109 - DNA, 24 bp, Artificial Sequence
  Description of Artificial Sequence:  Hypothetical Probe Sequence
cctatgtcgcaatgtcgtgcgctt

SEQ ID NO: 2110 - DNA, 24 bp, Artificial Sequence
  Description of Artificial Sequence:  Hypothetical Probe Sequence
cctatgtcacgggaccgcaatgcg

SEQ ID NO: 2111 - DNA, 24 bp, Artificial Sequence
  Description of Artificial Sequence:  Hypothetical Probe Sequence
cctatcgttcgttgtctgcgcacg

SEQ ID NO: 2112 - DNA, 24 bp, Artificial Sequence
  Description of Artificial Sequence:  Hypothetical Probe Sequence
cctatcgtcacggtgccagctgcg

SEQ ID NO: 2113 - DNA, 24 bp, Artificial Sequence
  Description of Artificial Sequence:  Hypothetical Probe Sequence
cctacgttgaccgaccggactgcg

SEQ ID NO: 2114 - DNA, 24 bp, Artificial Sequence
  Description of Artificial Sequence:  Hypothetical Probe Sequence
cctactgttgcgcacgacgggacc

SEQ ID NO: 2115 - DNA, 24 bp, Artificial Sequence
  Description of Artificial Sequence:  Hypothetical Probe Sequence
cctagcttgacctcccgtgccacg

SEQ ID NO: 2116 - DNA, 24 bp, Artificial Sequence
  Description of Artificial Sequence:  Hypothetical Probe Sequence
cctagcaagcaacacgcctacacg

SEQ ID NO: 2117 - DNA, 24 bp, Artificial Sequence
  Description of Artificial Sequence:  Hypothetical Probe Sequence
cctaatcgccatagtgtccccacg

SEQ ID NO: 2118 - DNA, 24 bp, Artificial Sequence
  Description of Artificial Sequence:  Hypothetical Probe Sequence
cctatcccttgaagccacggctgt

SEQ ID NO: 2119 - DNA, 24 bp, Artificial Sequence
  Description of Artificial Sequence:  Hypothetical Probe Sequence
cctatcccctcagaccacggcgaa

SEQ ID NO: 2120 - DNA, 24 bp, Artificial Sequence
  Description of Artificial Sequence:  Hypothetical Probe Sequence
cctatccccacgtgatagccggta

SEQ ID NO: 2121 - DNA, 24 bp, Artificial Sequence
  Description of Artificial Sequence:  Hypothetical Probe Sequence
cctacacgtcgtagcccacgcgtt

SEQ ID NO: 2122 - DNA, 24 bp, Artificial Sequence
  Description of Artificial Sequence:  Hypothetical Probe Sequence
cctacacgctgtcgttgtgcgtgc

SEQ ID NO: 2123 - DNA, 24 bp, Artificial Sequence
  Description of Artificial Sequence:  Hypothetical Probe Sequence
cctacacgcagcagtgtgcgacct

SEQ ID NO: 2124 - DNA, 24 bp, Artificial Sequence
  Description of Artificial Sequence:  Hypothetical Probe Sequence
cctacagcgtcttcgtcagctgcg

SEQ ID NO: 2125 - DNA, 24 bp, Artificial Sequence
  Description of Artificial Sequence:  Hypothetical Probe Sequence
cctacagcgagtcacggcaaagcc

SEQ ID NO: 2126 - DNA, 24 bp, Artificial Sequence
  Description of Artificial Sequence:  Hypothetical Probe Sequence
cctagacccgaaccatccatacgg

SEQ ID NO: 2127 - DNA, 24 bp, Artificial Sequence
  Description of Artificial Sequence:  Hypothetical Probe Sequence
cctagtgcgtctcgttacgggacc

SEQ ID NO: 2128 - DNA, 24 bp, Artificial Sequence
  Description of Artificial Sequence:  Hypothetical Probe Sequence
cctagtgcacggttgagcaaatcg

SEQ ID NO: 2129 - DNA, 24 bp, Artificial Sequence
  Description of Artificial Sequence:  Hypothetical Probe Sequence
cctaggaccacgcagctcgtgcaa

SEQ ID NO: 2130 - DNA, 24 bp, Artificial Sequence
  Description of Artificial Sequence:  Hypothetical Probe Sequence
cctaagccgagtagtggtgcgacc

SEQ ID NO: 2131 - DNA, 24 bp, Artificial Sequence
  Description of Artificial Sequence:  Hypothetical Probe Sequence
cctaagccacctcttgtccctgcg

SEQ ID NO: 2132 - DNA, 24 bp, Artificial Sequence
  Description of Artificial Sequence:  Hypothetical Probe Sequence
gatgttgaagccgtgcgtgcggta

SEQ ID NO: 2133 - DNA, 24 bp, Artificial Sequence
  Description of Artificial Sequence:  Hypothetical Probe Sequence
gatgaatcgtgcacggcgtttccc

SEQ ID NO: 2134 - DNA, 24 bp, Artificial Sequence
  Description of Artificial Sequence:  Hypothetical Probe Sequence
gatgaatcacggtcgttccccacg

SEQ ID NO: 2135 - DNA, 24 bp, Artificial Sequence
  Description of Artificial Sequence:  Hypothetical Probe Sequence
gatgaaagccatcagcggacgtgc

SEQ ID NO: 2136 - DNA, 24 bp, Artificial Sequence
  Description of Artificial Sequence:  Hypothetical Probe Sequence
gatgaaagcgaaagccccatcgtt

SEQ ID NO: 2137 - DNA, 24 bp, Artificial Sequence
  Description of Artificial Sequence:  Hypothetical Probe Sequence
gatgaaagcacgcagctgcgtgcg

SEQ ID NO: 2138 - DNA, 24 bp, Artificial Sequence
  Description of Artificial Sequence:  Hypothetical Probe Sequence
gatgcttgcgttccatgtgcacct

SEQ ID NO: 2139 - DNA, 24 bp, Artificial Sequence
  Description of Artificial Sequence:  Hypothetical Probe Sequence
gatgcgtttgtccgaaagccacgg

SEQ ID NO: 2140 - DNA, 24 bp, Artificial Sequence
  Description of Artificial Sequence:  Hypothetical Probe Sequence
gatgcgttggacagcccctacagc

SEQ ID NO: 2141 - DNA, 24 bp, Artificial Sequence
  Description of Artificial Sequence:  Hypothetical Probe Sequence
gatgctcacacgcgaacacggtgc

SEQ ID NO: 2142 - DNA, 24 bp, Artificial Sequence
  Description of Artificial Sequence:  Hypothetical Probe Sequence
gatgctgtcgaacctatgcggtgc

SEQ ID NO: 2143 - DNA, 24 bp, Artificial Sequence
  Description of Artificial Sequence:  Hypothetical Probe Sequence
gatgctgtcagccacggcttgtgc

SEQ ID NO: 2144 - DNA, 24 bp, Artificial Sequence
  Description of Artificial Sequence:  Hypothetical Probe Sequence
gatgctgtagccacgggcaacacg

SEQ ID NO: 2145 - DNA, 24 bp, Artificial Sequence
  Description of Artificial Sequence:  Hypothetical Probe Sequence
gatgccatcgtttcgtgcttggac

SEQ ID NO: 2146 - DNA, 24 bp, Artificial Sequence
  Description of Artificial Sequence:  Hypothetical Probe Sequence
gatgccatccatcagccgaaacct

SEQ ID NO: 2147 - DNA, 24 bp, Artificial Sequence
  Description of Artificial Sequence:  Hypothetical Probe Sequence
gatgccataggaggaccagccgaa

SEQ ID NO: 2148 - DNA, 24 bp, Artificial Sequence
  Description of Artificial Sequence:  Hypothetical Probe Sequence
gatgccatcctacgaaagccgacc

SEQ ID NO: 2149 - DNA, 24 bp, Artificial Sequence
  Description of Artificial Sequence:  Hypothetical Probe Sequence
gatgccattcccggtacagcccat

SEQ ID NO: 2150 - DNA, 24 bp, Artificial Sequence
  Description of Artificial Sequence:  Hypothetical Probe Sequence
gatgcgaactcatgcgggactccc

SEQ ID NO: 2151 - DNA, 24 bp, Artificial Sequence
  Description of Artificial Sequence:  Hypothetical Probe Sequence
gatgcgaaatcgcctacagcgctt

SEQ ID NO: 2152 - DNA, 24 bp, Artificial Sequence
  Description of Artificial Sequence:  Hypothetical Probe Sequence
gatgcgaaacgggcaatgtccttg

SEQ ID NO: 2153 - DNA, 24 bp, Artificial Sequence
  Description of Artificial Sequence:  Hypothetical Probe Sequence
gatgcgaaagccgcttgcaacttg

SEQ ID NO: 2154 - DNA, 24 bp, Artificial Sequence
  Description of Artificial Sequence:  Hypothetical Probe Sequence
gatggcttcttgcacggaccgtgc

SEQ ID NO: 2155 - DNA, 24 bp, Artificial Sequence
  Description of Artificial Sequence:  Hypothetical Probe Sequence
gatggcttgcaaaggatcgtgcaa

SEQ ID NO: 2156 - DNA, 24 bp, Artificial Sequence
  Description of Artificial Sequence:  Hypothetical Probe Sequence
gatggcttgaccgtctcagctgcg

SEQ ID NO: 2157 - DNA, 24 bp, Artificial Sequence
  Description of Artificial Sequence:  Hypothetical Probe Sequence
gatgggtatgcgatcgcacgaatc

SEQ ID NO: 2158 - DNA, 24 bp, Artificial Sequence
  Description of Artificial Sequence:  Hypothetical Probe Sequence
gatgggtagtgccacgtgcgcacg

SEQ ID NO: 2159 - DNA, 24 bp, Artificial Sequence
  Description of Artificial Sequence:  Hypothetical Probe Sequence
gatggagttcccggtagtgcgcaa

SEQ ID NO: 2160 - DNA, 24 bp, Artificial Sequence
  Description of Artificial Sequence:  Hypothetical Probe Sequence
gatggcaatctgcgaatcccagcc

SEQ ID NO: 2161 - DNA, 24 bp, Artificial Sequence
  Description of Artificial Sequence:  Hypothetical Probe Sequence
gatggcaacgttatacgcaatgcg

SEQ ID NO: 2162 - DNA, 24 bp, Artificial Sequence
  Description of Artificial Sequence:  Hypothetical Probe Sequence
gatggcaagcttcagccctagtgc

SEQ ID NO: 2163 - DNA, 24 bp, Artificial Sequence
  Description of Artificial Sequence:  Hypothetical Probe Sequence
gatggcaaacctaaagcagccgaa

SEQ ID NO: 2164 - DNA, 24 bp, Artificial Sequence
  Description of Artificial Sequence:  Hypothetical Probe Sequence
gatggcaagatggaccagcccgaa

SEQ ID NO: 2165 - DNA, 24 bp, Artificial Sequence
  Description of Artificial Sequence:  Hypothetical Probe Sequence
gatgagtggcaacgttcgtttccc

SEQ ID NO: 2166 - DNA, 24 bp, Artificial Sequence
  Description of Artificial Sequence:  Hypothetical Probe Sequence
gatgaccttgcgcgttgcttcgtt

SEQ ID NO: 2167 - DNA, 24 bp, Artificial Sequence
  Description of Artificial Sequence:  Hypothetical Probe Sequence
gatgatcgcgttccatgcttacgg

SEQ ID NO: 2168 - DNA, 24 bp, Artificial Sequence
  Description of Artificial Sequence:  Hypothetical Probe Sequence
gatgatcgccattgtccacgctca

SEQ ID NO: 2169 - DNA, 24 bp, Artificial Sequence
  Description of Artificial Sequence:  Hypothetical Probe Sequence
gatgatcggcttccatggactgcg

SEQ ID NO: 2170 - DNA, 24 bp, Artificial Sequence
  Description of Artificial Sequence:  Hypothetical Probe Sequence
gatgatcgcacggatgcgttcacg

SEQ ID NO: 2171 - DNA, 24 bp, Artificial Sequence
  Description of Artificial Sequence:  Hypothetical Probe Sequence
gatgcctaagccggtagtgcggac

SEQ ID NO: 2172 - DNA, 24 bp, Artificial Sequence
  Description of Artificial Sequence:  Hypothetical Probe Sequence
gatggatgctcagacccgttcgaa

SEQ ID NO: 2173 - DNA, 24 bp, Artificial Sequence
  Description of Artificial Sequence:  Hypothetical Probe Sequence
gatggatgcctatgcgagcctgcg

SEQ ID NO: 2174 - DNA, 24 bp, Artificial Sequence
  Description of Artificial Sequence:  Hypothetical Probe Sequence
gatggatggtgctgatcacgcgaa

SEQ ID NO: 2175 - DNA, 24 bp, Artificial Sequence
  Description of Artificial Sequence:  Hypothetical Probe Sequence
gatggatgagccaatccagctccc

SEQ ID NO: 2176 - DNA, 24 bp, Artificial Sequence
  Description of Artificial Sequence:  Hypothetical Probe Sequence
gatgtcccgcttaatccttgcgtt

SEQ ID NO: 2177 - DNA, 24 bp, Artificial Sequence
  Description of Artificial Sequence:  Hypothetical Probe Sequence
gatgtcccgtctcgttgaccccat

SEQ ID NO: 2178 - DNA, 24 bp, Artificial Sequence
  Description of Artificial Sequence:  Hypothetical Probe Sequence
gatgtccccagcgcttcacggtct

SEQ ID NO: 2179 - DNA, 24 bp, Artificial Sequence
  Description of Artificial Sequence:  Hypothetical Probe Sequence
gatgtcccgaccatactcccgcaa

SEQ ID NO: 2180 - DNA, 24 bp, Artificial Sequence
  Description of Artificial Sequence:  Hypothetical Probe Sequence
gatgtgcgttagcagcgatgatcg

SEQ ID NO: 2181 - DNA, 24 bp, Artificial Sequence
  Description of Artificial Sequence:  Hypothetical Probe Sequence
gatgtgcgggtaatcggcttgatg

SEQ ID NO: 2182 - DNA, 24 bp, Artificial Sequence
  Description of Artificial Sequence:  Hypothetical Probe Sequence
gatgtgcgcacgcgaatcgtagga

SEQ ID NO: 2183 - DNA, 24 bp, Artificial Sequence
  Description of Artificial Sequence:  Hypothetical Probe Sequence
gatgtgcgcagcgcaaatcgacct

SEQ ID NO: 2184 - DNA, 24 bp, Artificial Sequence
  Description of Artificial Sequence:  Hypothetical Probe Sequence
gatgcacgtgtcgtgcagccggac

SEQ ID NO: 2185 - DNA, 24 bp, Artificial Sequence
  Description of Artificial Sequence:  Hypothetical Probe Sequence
gatgcacgccatcgttcgttctca

SEQ ID NO: 2186 - DNA, 24 bp, Artificial Sequence
  Description of Artificial Sequence:  Hypothetical Probe Sequence
gatgcacgagtgacggatcggtgc

SEQ ID NO: 2187 - DNA, 24 bp, Artificial Sequence
  Description of Artificial Sequence:  Hypothetical Probe Sequence
gatgcacgtgcggtctgacccagc

SEQ ID NO: 2188 - DNA, 24 bp, Artificial Sequence
  Description of Artificial Sequence:  Hypothetical Probe Sequence
gatgcacgcacgcttgatcgggta

SEQ ID NO: 2189 - DNA, 24 bp, Artificial Sequence
  Description of Artificial Sequence:  Hypothetical Probe Sequence
gatgcacgagccgaccaatcacgg

SEQ ID NO: 2190 - DNA, 24 bp, Artificial Sequence
  Description of Artificial Sequence:  Hypothetical Probe Sequence
gatgcagctgattgcgatcgggac

SEQ ID NO: 2191 - DNA, 24 bp, Artificial Sequence
  Description of Artificial Sequence:  Hypothetical Probe Sequence
gatgcagctcgtcacgtcccatcg

SEQ ID NO: 2192 - DNA, 24 bp, Artificial Sequence
  Description of Artificial Sequence:  Hypothetical Probe Sequence
gatgcagccttgatcgcgaactca

SEQ ID NO: 2193 - DNA, 24 bp, Artificial Sequence
  Description of Artificial Sequence:  Hypothetical Probe Sequence
gatgcagcctcatgatgaccgctt

SEQ ID NO: 2194 - DNA, 24 bp, Artificial Sequence
  Description of Artificial Sequence:  Hypothetical Probe Sequence
gatgcagcggtaggtaacgggatg

SEQ ID NO: 2195 - DNA, 24 bp, Artificial Sequence
  Description of Artificial Sequence:  Hypothetical Probe Sequence
gatgcagcgtgcgcttgtctcacg

SEQ ID NO: 2196 - DNA, 24 bp, Artificial Sequence
  Description of Artificial Sequence:  Hypothetical Probe Sequence
gatgcagcagccctcatcccgagt

SEQ ID NO: 2197 - DNA, 24 bp, Artificial Sequence
  Description of Artificial Sequence:  Hypothetical Probe Sequence
gatggacccgttggacaaagcgaa

SEQ ID NO: 2198 - DNA, 24 bp, Artificial Sequence
  Description of Artificial Sequence:  Hypothetical Probe Sequence
gatggacccacgacggggtaggta

SEQ ID NO: 2199 - DNA, 24 bp, Artificial Sequence
  Description of Artificial Sequence:  Hypothetical Probe Sequence
gatgacggttgagctttgcggcaa

SEQ ID NO: 2200 - DNA, 24 bp, Artificial Sequence
  Description of Artificial Sequence:  Hypothetical Probe Sequence
gatgacggggtagacccgaagcaa

SEQ ID NO: 2201 - DNA, 24 bp, Artificial Sequence
  Description of Artificial Sequence:  Hypothetical Probe Sequence
gatgagccctcactcaagcctgcg

SEQ ID NO: 2202 - DNA, 24 bp, Artificial Sequence
  Description of Artificial Sequence:  Hypothetical Probe Sequence
gatgagccgtctacggcagcaatc

SEQ ID NO: 2203 - DNA, 24 bp, Artificial Sequence
  Description of Artificial Sequence:  Hypothetical Probe Sequence
gatgagccatcgtcgtccatgcaa

SEQ ID NO: 2204 - DNA, 24 bp, Artificial Sequence
  Description of Artificial Sequence:  Hypothetical Probe Sequence
gatgagcccagcatacgcaacgtt

SEQ ID NO: 2205 - DNA, 24 bp, Artificial Sequence
  Description of Artificial Sequence:  Hypothetical Probe Sequence
tcccttgaaatctgcgagcccgtt

SEQ ID NO: 2206 - DNA, 24 bp, Artificial Sequence
  Description of Artificial Sequence:  Hypothetical Probe Sequence
tcccttgaaggaagcccttgtccc

SEQ ID NO: 2207 - DNA, 24 bp, Artificial Sequence
  Description of Artificial Sequence:  Hypothetical Probe Sequence
tcccttgatgcgttagggtatgcg

SEQ ID NO: 2208 - DNA, 24 bp, Artificial Sequence
  Description of Artificial Sequence:  Hypothetical Probe Sequence
tcccttgacagcaaagatcgcacg

SEQ ID NO: 2209 - DNA, 24 bp, Artificial Sequence
  Description of Artificial Sequence:  Hypothetical Probe Sequence
tcccttgaggaccacggatgcacg

SEQ ID NO: 2210 - DNA, 24 bp, Artificial Sequence
  Description of Artificial Sequence:  Hypothetical Probe Sequence
tccctgattctgggaccagcagcc

SEQ ID NO: 2211 - DNA, 24 bp, Artificial Sequence
  Description of Artificial Sequence:  Hypothetical Probe Sequence
tccctgattcgtaatcacggcacg

SEQ ID NO: 2212 - DNA, 24 bp, Artificial Sequence
  Description of Artificial Sequence:  Hypothetical Probe Sequence
tccctgatcgaattgaagccagcc

SEQ ID NO: 2213 - DNA, 24 bp, Artificial Sequence
  Description of Artificial Sequence:  Hypothetical Probe Sequence
tccctgattgcgaggacctatccc

SEQ ID NO: 2214 - DNA, 24 bp, Artificial Sequence
  Description of Artificial Sequence:  Hypothetical Probe Sequence
tccctgatgacctgtcacggacgg

SEQ ID NO: 2215 - DNA, 24 bp, Artificial Sequence
  Description of Artificial Sequence:  Hypothetical Probe Sequence
tcccttagctgtatcgtgcgcgaa

SEQ ID NO: 2216 - DNA, 24 bp, Artificial Sequence
  Description of Artificial Sequence:  Hypothetical Probe Sequence
tcccttaggcaagcttgcaaggac

SEQ ID NO: 2217 - DNA, 24 bp, Artificial Sequence
  Description of Artificial Sequence:  Hypothetical Probe Sequence
tcccttagaggaaatctgcgtgcg

SEQ ID NO: 2218 - DNA, 24 bp, Artificial Sequence
  Description of Artificial Sequence:  Hypothetical Probe Sequence
tcccttagcacgcttgaggatccc

SEQ ID NO: 2219 - DNA, 24 bp, Artificial Sequence
  Description of Artificial Sequence:  Hypothetical Probe Sequence
tcccaatcctgtggactcccgctt

SEQ ID NO: 2220 - DNA, 24 bp, Artificial Sequence
  Description of Artificial Sequence:  Hypothetical Probe Sequence
tcccaatcgcttcctagaccccat

SEQ ID NO: 2221 - DNA, 24 bp, Artificial Sequence
  Description of Artificial Sequence:  Hypothetical Probe Sequence
tcccaatcgagtacctgaccgacc

SEQ ID NO: 2222 - DNA, 24 bp, Artificial Sequence
  Description of Artificial Sequence:  Hypothetical Probe Sequence
tcccaatcagtggaccgaccagcc

SEQ ID NO: 2223 - DNA, 24 bp, Artificial Sequence
  Description of Artificial Sequence:  Hypothetical Probe Sequence
tcccaatcacctcttgagcccgtt

SEQ ID NO: 2224 - DNA, 24 bp, Artificial Sequence
  Description of Artificial Sequence:  Hypothetical Probe Sequence
tcccaatctcccagtgtgcgagga

SEQ ID NO: 2225 - DNA, 24 bp, Artificial Sequence
  Description of Artificial Sequence:  Hypothetical Probe Sequence
tcccaatcgacctctgcacgaaag

SEQ ID NO: 2226 - DNA, 24 bp, Artificial Sequence
  Description of Artificial Sequence:  Hypothetical Probe Sequence
tcccaatcagccgatgcgttagga

SEQ ID NO: 2227 - DNA, 24 bp, Artificial Sequence
  Description of Artificial Sequence:  Hypothetical Probe Sequence
tcccataccttggtgcacgggatg

SEQ ID NO: 2228 - DNA, 24 bp, Artificial Sequence
  Description of Artificial Sequence:  Hypothetical Probe Sequence
tcccatacccatcagccagcgagt

SEQ ID NO: 2229 - DNA, 24 bp, Artificial Sequence
  Description of Artificial Sequence:  Hypothetical Probe Sequence
tcccataccgaaatacgtgcggac

SEQ ID NO: 2230 - DNA, 24 bp, Artificial Sequence
  Description of Artificial Sequence:  Hypothetical Probe Sequence
tcccatacgtgccgaactcaagcc

SEQ ID NO: 2231 - DNA, 24 bp, Artificial Sequence
  Description of Artificial Sequence:  Hypothetical Probe Sequence
tcccaaagcgtttcgtcgttccat

SEQ ID NO: 2232 - DNA, 24 bp, Artificial Sequence
  Description of Artificial Sequence:  Hypothetical Probe Sequence
tcccaaagggtaccatcgttcacg

SEQ ID NO: 2233 - DNA, 24 bp, Artificial Sequence
  Description of Artificial Sequence:  Hypothetical Probe Sequence
tcccaaaggtctcgttcacggcaa

SEQ ID NO: 2234 - DNA, 24 bp, Artificial Sequence
  Description of Artificial Sequence:  Hypothetical Probe Sequence
tcccaaagacctcacgatcgcgtt

SEQ ID NO: 2235 - DNA, 24 bp, Artificial Sequence
  Description of Artificial Sequence:  Hypothetical Probe Sequence
tcccaaagatcgcgaattagcgaa

SEQ ID NO: 2236 - DNA, 24 bp, Artificial Sequence
  Description of Artificial Sequence:  Hypothetical Probe Sequence
tcccaaaggatgacctcttgcgaa

SEQ ID NO: 2237 - DNA, 24 bp, Artificial Sequence
  Description of Artificial Sequence:  Hypothetical Probe Sequence
tcccaaagtgcgtgatccattcgt

SEQ ID NO: 2238 - DNA, 24 bp, Artificial Sequence
  Description of Artificial Sequence:  Hypothetical Probe Sequence
tcccaaagcagcaatctgtcgtgc

SEQ ID NO: 2239 - DNA, 24 bp, Artificial Sequence
  Description of Artificial Sequence:  Hypothetical Probe Sequence
tcccaaaggacctcgttcgtagga

SEQ ID NO: 2240 - DNA, 24 bp, Artificial Sequence
  Description of Artificial Sequence:  Hypothetical Probe Sequence
tcccaaagagcccttgacggccta

SEQ ID NO: 2241 - DNA, 24 bp, Artificial Sequence
  Description of Artificial Sequence:  Hypothetical Probe Sequence
tccctctgcgtttccctcgttctg

SEQ ID NO: 2242 - DNA, 24 bp, Artificial Sequence
  Description of Artificial Sequence:  Hypothetical Probe Sequence
tccctctgctcacctaacggcgtt

SEQ ID NO: 2243 - DNA, 24 bp, Artificial Sequence
  Description of Artificial Sequence:  Hypothetical Probe Sequence
tccctctggtctgacccgaatccc

SEQ ID NO: 2244 - DNA, 24 bp, Artificial Sequence
  Description of Artificial Sequence:  Hypothetical Probe Sequence
tccctctgatcgcagcgcaagacc

SEQ ID NO: 2245 - DNA, 24 bp, Artificial Sequence
  Description of Artificial Sequence:  Hypothetical Probe Sequence
tccctctgaggacgttctgttgcg

SEQ ID NO: 2246 - DNA, 24 bp, Artificial Sequence
  Description of Artificial Sequence:  Hypothetical Probe Sequence
tccctctgtcccttgatgtcgcaa

SEQ ID NO: 2247 - DNA, 24 bp, Artificial Sequence
  Description of Artificial Sequence:  Hypothetical Probe Sequence
tccctctgggactgtcgaccatcg

SEQ ID NO: 2248 - DNA, 24 bp, Artificial Sequence
  Description of Artificial Sequence:  Hypothetical Probe Sequence
tccctgtccttgcgtttctgacgg

SEQ ID NO: 2249 - DNA, 24 bp, Artificial Sequence
  Description of Artificial Sequence:  Hypothetical Probe Sequence
tccctgtcatcgaatcgtgcggac

SEQ ID NO: 2250 - DNA, 24 bp, Artificial Sequence
  Description of Artificial Sequence:  Hypothetical Probe Sequence
tccctgtcaggatgtcgacctgcg

SEQ ID NO: 2251 - DNA, 24 bp, Artificial Sequence
  Description of Artificial Sequence:  Hypothetical Probe Sequence
tccctgtcggactacatccccgtt

SEQ ID NO: 2252 - DNA, 24 bp, Artificial Sequence
  Description of Artificial Sequence:  Hypothetical Probe Sequence
tccctcgttgtcacctcagcagcc

SEQ ID NO: 2253 - DNA, 24 bp, Artificial Sequence
  Description of Artificial Sequence:  Hypothetical Probe Sequence
tccctcgtctcagacccagcgctt

SEQ ID NO: 2254 - DNA, 24 bp, Artificial Sequence
  Description of Artificial Sequence:  Hypothetical Probe Sequence
tccctcgtggtatacatgcgcagc

SEQ ID NO: 2255 - DNA, 24 bp, Artificial Sequence
  Description of Artificial Sequence:  Hypothetical Probe Sequence
tccctcgtgtcttgtcagcctccc

SEQ ID NO: 2256 - DNA, 24 bp, Artificial Sequence
  Description of Artificial Sequence:  Hypothetical Probe Sequence
tccctcgtgcaaagtggtgcagga

SEQ ID NO: 2257 - DNA, 24 bp, Artificial Sequence
  Description of Artificial Sequence:  Hypothetical Probe Sequence
tccctcgtacctcctagtgctgcg

SEQ ID NO: 2258 - DNA, 24 bp, Artificial Sequence
  Description of Artificial Sequence:  Hypothetical Probe Sequence
tccctcgtgatgcacgatcgagga

SEQ ID NO: 2259 - DNA, 24 bp, Artificial Sequence
  Description of Artificial Sequence:  Hypothetical Probe Sequence
tccctcgttgcgccataggagctt

SEQ ID NO: 2260 - DNA, 24 bp, Artificial Sequence
  Description of Artificial Sequence:  Hypothetical Probe Sequence
tccctcgtgacctcgtgcaaaatc

SEQ ID NO: 2261 - DNA, 24 bp, Artificial Sequence
  Description of Artificial Sequence:  Hypothetical Probe Sequence
tccctcgtgtgcttagccatgctt

SEQ ID NO: 2262 - DNA, 24 bp, Artificial Sequence
  Description of Artificial Sequence:  Hypothetical Probe Sequence
tccctcgtggacgcttagtgcgaa

SEQ ID NO: 2263 - DNA, 24 bp, Artificial Sequence
  Description of Artificial Sequence:  Hypothetical Probe Sequence
tccccttgtgattcgttgcgacct

SEQ ID NO: 2264 - DNA, 24 bp, Artificial Sequence
  Description of Artificial Sequence:  Hypothetical Probe Sequence
tccccttgaaagggtaaccttgcg

SEQ ID NO: 2265 - DNA, 24 bp, Artificial Sequence
  Description of Artificial Sequence:  Hypothetical Probe Sequence
tccccttgtctgacctagcccgaa

SEQ ID NO: 2266 - DNA, 24 bp, Artificial Sequence
  Description of Artificial Sequence:  Hypothetical Probe Sequence
tccccttgctcaggactctggcaa

SEQ ID NO: 2267 - DNA, 24 bp, Artificial Sequence
  Description of Artificial Sequence:  Hypothetical Probe Sequence
tccccttgggtaagtgtgcggatg

SEQ ID NO: 2268 - DNA, 24 bp, Artificial Sequence
  Description of Artificial Sequence:  Hypothetical Probe Sequence
tccccttgatcgtctgtccccttg

SEQ ID NO: 2269 - DNA, 24 bp, Artificial Sequence
  Description of Artificial Sequence:  Hypothetical Probe Sequence
tccccttgagccaggattgatccc

SEQ ID NO: 2270 - DNA, 24 bp, Artificial Sequence
  Description of Artificial Sequence:  Hypothetical Probe Sequence
tccccgtttgatatcgtgattccc

SEQ ID NO: 2271 - DNA, 24 bp, Artificial Sequence
  Description of Artificial Sequence:  Hypothetical Probe Sequence
tccccgttatacgtgcgatggctt

SEQ ID NO: 2272 - DNA, 24 bp, Artificial Sequence
  Description of Artificial Sequence:  Hypothetical Probe Sequence
tccccgtttacattgacacgccat

SEQ ID NO: 2273 - DNA, 24 bp, Artificial Sequence
  Description of Artificial Sequence:  Hypothetical Probe Sequence
tccccgtttgtctgtcgaccgagt

SEQ ID NO: 2274 - DNA, 24 bp, Artificial Sequence
  Description of Artificial Sequence:  Hypothetical Probe Sequence
tccccgtttcgtcagcatcgaatc

SEQ ID NO: 2275 - DNA, 24 bp, Artificial Sequence
  Description of Artificial Sequence:  Hypothetical Probe Sequence
tccccgttcttggagtggtatgcg

SEQ ID NO: 2276 - DNA, 24 bp, Artificial Sequence
  Description of Artificial Sequence:  Hypothetical Probe Sequence
tccccgttctcaggtacacgctca

SEQ ID NO: 2277 - DNA, 24 bp, Artificial Sequence
  Description of Artificial Sequence:  Hypothetical Probe Sequence
tccccgttccatcacggatgagtg

SEQ ID NO: 2278 - DNA, 24 bp, Artificial Sequence
  Description of Artificial Sequence:  Hypothetical Probe Sequence
tccccgttgctttcccctgtagtg

SEQ ID NO: 2279 - DNA, 24 bp, Artificial Sequence
  Description of Artificial Sequence:  Hypothetical Probe Sequence
tccccgttgcaatctgacctcgaa

SEQ ID NO: 2280 - DNA, 24 bp, Artificial Sequence
  Description of Artificial Sequence:  Hypothetical Probe Sequence
tccccgttaccttgatacgggctt

SEQ ID NO: 2281 - DNA, 24 bp, Artificial Sequence
  Description of Artificial Sequence:  Hypothetical Probe Sequence
tccccgttatcgcctatcccagtg

SEQ ID NO: 2282 - DNA, 24 bp, Artificial Sequence
  Description of Artificial Sequence:  Hypothetical Probe Sequence
tccccgtttgcgtcgtaggacagc

SEQ ID NO: 2283 - DNA, 24 bp, Artificial Sequence
  Description of Artificial Sequence:  Hypothetical Probe Sequence
tccccgttgtgcagtgcgttctca

SEQ ID NO: 2284 - DNA, 24 bp, Artificial Sequence
  Description of Artificial Sequence:  Hypothetical Probe Sequence
tcccctcatgattgcgacgggctt

SEQ ID NO: 2285 - DNA, 24 bp, Artificial Sequence
  Description of Artificial Sequence:  Hypothetical Probe Sequence
tcccctcattagcttgtgcgcgtt

SEQ ID NO: 2286 - DNA, 24 bp, Artificial Sequence
  Description of Artificial Sequence:  Hypothetical Probe Sequence
tcccctcatctggcttttagcgaa

SEQ ID NO: 2287 - DNA, 24 bp, Artificial Sequence
  Description of Artificial Sequence:  Hypothetical Probe Sequence
tcccctcaccatcctaagccagtg

SEQ ID NO: 2288 - DNA, 24 bp, Artificial Sequence
  Description of Artificial Sequence:  Hypothetical Probe Sequence
tcccctcagcttaggacgaacagc

SEQ ID NO: 2289 - DNA, 24 bp, Artificial Sequence
  Description of Artificial Sequence:  Hypothetical Probe Sequence
tcccctcaacctcctacacgtccc

SEQ ID NO: 2290 - DNA, 24 bp, Artificial Sequence
  Description of Artificial Sequence:  Hypothetical Probe Sequence
tcccctcacacgatcgtcgtgacc

SEQ ID NO: 2291 - DNA, 24 bp, Artificial Sequence
  Description of Artificial Sequence:  Hypothetical Probe Sequence
tcccctcacagcctgttcccacct

SEQ ID NO: 2292 - DNA, 24 bp, Artificial Sequence
  Description of Artificial Sequence:  Hypothetical Probe Sequence
tcccctgttgatgcttgaccgtgc

SEQ ID NO: 2293 - DNA, 24 bp, Artificial Sequence
  Description of Artificial Sequence:  Hypothetical Probe Sequence
tcccctgttctgccatgatgtgcg

SEQ ID NO: 2294 - DNA, 24 bp, Artificial Sequence
  Description of Artificial Sequence:  Hypothetical Probe Sequence
tcccctgttgtcgcaagaccgctt

SEQ ID NO: 2295 - DNA, 24 bp, Artificial Sequence
  Description of Artificial Sequence:  Hypothetical Probe Sequence
tcccctgttcgtacctatcgcgtt

SEQ ID NO: 2296 - DNA, 24 bp, Artificial Sequence
  Description of Artificial Sequence:  Hypothetical Probe Sequence
tcccctgtcgaaaaagcgttagga

SEQ ID NO: 2297 - DNA, 24 bp, Artificial Sequence
  Description of Artificial Sequence:  Hypothetical Probe Sequence
tcccctgtgcaaagtggaccctca

SEQ ID NO: 2298 - DNA, 24 bp, Artificial Sequence
  Description of Artificial Sequence:  Hypothetical Probe Sequence
tcccctgtaggatcccgcaatgat

SEQ ID NO: 2299 - DNA, 24 bp, Artificial Sequence
  Description of Artificial Sequence:  Hypothetical Probe Sequence
tcccctgtcctaagcctgcgggta

SEQ ID NO: 2300 - DNA, 24 bp, Artificial Sequence
  Description of Artificial Sequence:  Hypothetical Probe Sequence
tcccctgtgatgggacacgggacc

SEQ ID NO: 2301 - DNA, 24 bp, Artificial Sequence
  Description of Artificial Sequence:  Hypothetical Probe Sequence
tcccctgttgcgcttgtgtcagcc

SEQ ID NO: 2302 - DNA, 24 bp, Artificial Sequence
  Description of Artificial Sequence:  Hypothetical Probe Sequence
tcccccatttgatcgtagtgcgtt

SEQ ID NO: 2303 - DNA, 24 bp, Artificial Sequence
  Description of Artificial Sequence:  Hypothetical Probe Sequence
tcccccatcttgtgcggatgttag

SEQ ID NO: 2304 - DNA, 24 bp, Artificial Sequence
  Description of Artificial Sequence:  Hypothetical Probe Sequence
tcccccatcgttgtctcgaacgtt

SEQ ID NO: 2305 - DNA, 24 bp, Artificial Sequence
  Description of Artificial Sequence:  Hypothetical Probe Sequence
tcccccatctcagaccatcgccta

SEQ ID NO: 2306 - DNA, 24 bp, Artificial Sequence
  Description of Artificial Sequence:  Hypothetical Probe Sequence
tcccccatgcttcttgcgaaggta

SEQ ID NO: 2307 - DNA, 24 bp, Artificial Sequence
  Description of Artificial Sequence:  Hypothetical Probe Sequence
tcccccatggtattgaaaaggcaa

SEQ ID NO: 2308 - DNA, 24 bp, Artificial Sequence
  Description of Artificial Sequence:  Hypothetical Probe Sequence
tcccccatagtgagtgcgttcagc

SEQ ID NO: 2309 - DNA, 24 bp, Artificial Sequence
  Description of Artificial Sequence:  Hypothetical Probe Sequence
tcccccattgcgaatcagccaatc

SEQ ID NO: 2310 - DNA, 24 bp, Artificial Sequence
  Description of Artificial Sequence:  Hypothetical Probe Sequence
tcccccatgtgccagcttagcagc

SEQ ID NO: 2311 - DNA, 24 bp, Artificial Sequence
  Description of Artificial Sequence:  Hypothetical Probe Sequence
tcccccatggacacctatacagcc

SEQ ID NO: 2312 - DNA, 24 bp, Artificial Sequence
  Description of Artificial Sequence:  Hypothetical Probe Sequence
tccccgaaatacaatctcccggac

SEQ ID NO: 2313 - DNA, 24 bp, Artificial Sequence
  Description of Artificial Sequence:  Hypothetical Probe Sequence
tccccgaaaaaggcaaggtacacg

SEQ ID NO: 2314 - DNA, 24 bp, Artificial Sequence
  Description of Artificial Sequence:  Hypothetical Probe Sequence
tccccgaatacaagtgcagcctca

SEQ ID NO: 2315 - DNA, 24 bp, Artificial Sequence
  Description of Artificial Sequence:  Hypothetical Probe Sequence
tccccgaacttggatgcagcaaag

SEQ ID NO: 2316 - DNA, 24 bp, Artificial Sequence
  Description of Artificial Sequence:  Hypothetical Probe Sequence
tccccgaagcttttgaccattccc

SEQ ID NO: 2317 - DNA, 24 bp, Artificial Sequence
  Description of Artificial Sequence:  Hypothetical Probe Sequence
tccccgaagtctggtagtgctgcg

SEQ ID NO: 2318 - DNA, 24 bp, Artificial Sequence
  Description of Artificial Sequence:  Hypothetical Probe Sequence
tccccgaaagtgggacggactctg

SEQ ID NO: 2319 - DNA, 24 bp, Artificial Sequence
  Description of Artificial Sequence:  Hypothetical Probe Sequence
tccccgaatgcgatcgttagtccc

SEQ ID NO: 2320 - DNA, 24 bp, Artificial Sequence
  Description of Artificial Sequence:  Hypothetical Probe Sequence
tcccgcttttaggaccggacgtct

SEQ ID NO: 2321 - DNA, 24 bp, Artificial Sequence
  Description of Artificial Sequence:  Hypothetical Probe Sequence
tcccgctttacactgtacggggac

SEQ ID NO: 2322 - DNA, 24 bp, Artificial Sequence
  Description of Artificial Sequence:  Hypothetical Probe Sequence
tcccgcttcgaaatcgtctgcttg

SEQ ID NO: 2323 - DNA, 24 bp, Artificial Sequence
  Description of Artificial Sequence:  Hypothetical Probe Sequence
tcccgcttgcttgtgcggtagagt

SEQ ID NO: 2324 - DNA, 24 bp, Artificial Sequence
  Description of Artificial Sequence:  Hypothetical Probe Sequence
tcccgcttgtctaggacttgcagc

SEQ ID NO: 2325 - DNA, 24 bp, Artificial Sequence
  Description of Artificial Sequence:  Hypothetical Probe Sequence
tcccgcttagtgcttggaccgacc

SEQ ID NO: 2326 - DNA, 24 bp, Artificial Sequence
  Description of Artificial Sequence:  Hypothetical Probe Sequence
tcccgcttatcgagccttgattga

SEQ ID NO: 2327 - DNA, 24 bp, Artificial Sequence
  Description of Artificial Sequence:  Hypothetical Probe Sequence
tcccgcttcacgatcgcctagagt

SEQ ID NO: 2328 - DNA, 24 bp, Artificial Sequence
  Description of Artificial Sequence:  Hypothetical Probe Sequence
tcccgcttcagcctcagatgccat

SEQ ID NO: 2329 - DNA, 24 bp, Artificial Sequence
  Description of Artificial Sequence:  Hypothetical Probe Sequence
tcccgcttagcctctggcttttga

SEQ ID NO: 2330 - DNA, 24 bp, Artificial Sequence
  Description of Artificial Sequence:  Hypothetical Probe Sequence
tcccggtatgatcgaagatgtgcg

SEQ ID NO: 2331 - DNA, 24 bp, Artificial Sequence
  Description of Artificial Sequence:  Hypothetical Probe Sequence
tcccggtaaatccacgggtaatcg

SEQ ID NO: 2332 - DNA, 24 bp, Artificial Sequence
  Description of Artificial Sequence:  Hypothetical Probe Sequence
tcccggtatgtccttggctttgcg

SEQ ID NO: 2333 - DNA, 24 bp, Artificial Sequence
  Description of Artificial Sequence:  Hypothetical Probe Sequence
tcccggtactcaaatctgcgatcg

SEQ ID NO: 2334 - DNA, 24 bp, Artificial Sequence
  Description of Artificial Sequence:  Hypothetical Probe Sequence
tcccggtactgtaggaacggcgaa

SEQ ID NO: 2335 - DNA, 24 bp, Artificial Sequence
  Description of Artificial Sequence:  Hypothetical Probe Sequence
tcccggtaggtacctagtgcgcaa

SEQ ID NO: 2336 - DNA, 24 bp, Artificial Sequence
  Description of Artificial Sequence:  Hypothetical Probe Sequence
tcccggtaaggagcttcgttgatg

SEQ ID NO: 2337 - DNA, 24 bp, Artificial Sequence
  Description of Artificial Sequence:  Hypothetical Probe Sequence
tcccggtacctattagcagcgtgc

SEQ ID NO: 2338 - DNA, 24 bp, Artificial Sequence
  Description of Artificial Sequence:  Hypothetical Probe Sequence
tcccggtagatgtcgttctgacgg

SEQ ID NO: 2339 - DNA, 24 bp, Artificial Sequence
  Description of Artificial Sequence:  Hypothetical Probe Sequence
tcccggtatgcgggtaaggatcgt

SEQ ID NO: 2340 - DNA, 24 bp, Artificial Sequence
  Description of Artificial Sequence:  Hypothetical Probe Sequence
tcccggtaagccccatctgtcgaa

SEQ ID NO: 2341 - DNA, 24 bp, Artificial Sequence
  Description of Artificial Sequence:  Hypothetical Probe Sequence
tcccgtctttgagcttgacccttg

SEQ ID NO: 2342 - DNA, 24 bp, Artificial Sequence
  Description of Artificial Sequence:  Hypothetical Probe Sequence
tcccgtcttgtcacggtgcggatg

SEQ ID NO: 2343 - DNA, 24 bp, Artificial Sequence
  Description of Artificial Sequence:  Hypothetical Probe Sequence
tcccgtcttcgtagtgcttgcacg

SEQ ID NO: 2344 - DNA, 24 bp, Artificial Sequence
  Description of Artificial Sequence:  Hypothetical Probe Sequence
tcccgtctctcaaccttgcgtccc

SEQ ID NO: 2345 - DNA, 24 bp, Artificial Sequence
  Description of Artificial Sequence:  Hypothetical Probe Sequence
tcccgtctagtgtcccagccgacc

SEQ ID NO: 2346 - DNA, 24 bp, Artificial Sequence
  Description of Artificial Sequence:  Hypothetical Probe Sequence
tcccgtctacctcctatgcgctgt

SEQ ID NO: 2347 - DNA, 24 bp, Artificial Sequence
  Description of Artificial Sequence:  Hypothetical Probe Sequence
tcccgtctatcgctcatgcgtcgt

SEQ ID NO: 2348 - DNA, 24 bp, Artificial Sequence
  Description of Artificial Sequence:  Hypothetical Probe Sequence
tcccgtctcctaaggagaccccat

SEQ ID NO: 2349 - DNA, 24 bp, Artificial Sequence
  Description of Artificial Sequence:  Hypothetical Probe Sequence
tcccgtcttgcgccatgagttcgt

SEQ ID NO: 2350 - DNA, 24 bp, Artificial Sequence
  Description of Artificial Sequence:  Hypothetical Probe Sequence
tcccgtctcacgaccttgtccacg

SEQ ID NO: 2351 - DNA, 24 bp, Artificial Sequence
  Description of Artificial Sequence:  Hypothetical Probe Sequence
tcccgtctggactctggcttgctt

SEQ ID NO: 2352 - DNA, 24 bp, Artificial Sequence
  Description of Artificial Sequence:  Hypothetical Probe Sequence
tcccgtctacggcttgaatcgtgc

SEQ ID NO: 2353 - DNA, 24 bp, Artificial Sequence
  Description of Artificial Sequence:  Hypothetical Probe Sequence
tcccgtctagccgagtgacccgaa

SEQ ID NO: 2354 - DNA, 24 bp, Artificial Sequence
  Description of Artificial Sequence:  Hypothetical Probe Sequence
tcccgagttgatccatcttgcacg

SEQ ID NO: 2355 - DNA, 24 bp, Artificial Sequence
  Description of Artificial Sequence:  Hypothetical Probe Sequence
tcccgagtcttgatcggcttgctt

SEQ ID NO: 2356 - DNA, 24 bp, Artificial Sequence
  Description of Artificial Sequence:  Hypothetical Probe Sequence
tcccgagtcgaagaccctcaagga

SEQ ID NO: 2357 - DNA, 24 bp, Artificial Sequence
  Description of Artificial Sequence:  Hypothetical Probe Sequence
tcccgagtatcgtctgatcggcaa

SEQ ID NO: 2358 - DNA, 24 bp, Artificial Sequence
  Description of Artificial Sequence:  Hypothetical Probe Sequence
tcccgagtcagcgaccacctgtgc

SEQ ID NO: 2359 - DNA, 24 bp, Artificial Sequence
  Description of Artificial Sequence:  Hypothetical Probe Sequence
tcccgagtgaccacgggcttaatc

SEQ ID NO: 2360 - DNA, 24 bp, Artificial Sequence
  Description of Artificial Sequence:  Hypothetical Probe Sequence
tcccgagtgtgctgtcgatgagcc

SEQ ID NO: 2361 - DNA, 24 bp, Artificial Sequence
  Description of Artificial Sequence:  Hypothetical Probe Sequence
tcccgagtacgggcaaaggaaaag

SEQ ID NO: 2362 - DNA, 24 bp, Artificial Sequence
  Description of Artificial Sequence:  Hypothetical Probe Sequence
tcccgcaattgacgttaaaggtgc

SEQ ID NO: 2363 - DNA, 24 bp, Artificial Sequence
  Description of Artificial Sequence:  Hypothetical Probe Sequence
tcccgcaattagccatcctatgcg

SEQ ID NO: 2364 - DNA, 24 bp, Artificial Sequence
  Description of Artificial Sequence:  Hypothetical Probe Sequence
tcccgcaaaatcggacaatcgctt

SEQ ID NO: 2365 - DNA, 24 bp, Artificial Sequence
  Description of Artificial Sequence:  Hypothetical Probe Sequence
tcccgcaatacaatcgagtggacc

SEQ ID NO: 2366 - DNA, 24 bp, Artificial Sequence
  Description of Artificial Sequence:  Hypothetical Probe Sequence
tcccgcaacttgaaagatcgctgt

SEQ ID NO: 2367 - DNA, 24 bp, Artificial Sequence
  Description of Artificial Sequence:  Hypothetical Probe Sequence
tcccgcaacgaagtgctgattcgt

SEQ ID NO: 2368 - DNA, 24 bp, Artificial Sequence
  Description of Artificial Sequence:  Hypothetical Probe Sequence
tcccgcaagctttctggtgcttga

SEQ ID NO: 2369 - DNA, 24 bp, Artificial Sequence
  Description of Artificial Sequence:  Hypothetical Probe Sequence
tcccgcaagagtccatgcaaccat

SEQ ID NO: 2370 - DNA, 24 bp, Artificial Sequence
  Description of Artificial Sequence:  Hypothetical Probe Sequence
tcccgcaaagtgagtggatgccat

SEQ ID NO: 2371 - DNA, 24 bp, Artificial Sequence
  Description of Artificial Sequence:  Hypothetical Probe Sequence
tcccgcaacagcggacaggaaaag

SEQ ID NO: 2372 - DNA, 24 bp, Artificial Sequence
  Description of Artificial Sequence:  Hypothetical Probe Sequence
tcccgcaaggaccctacttggtgc

SEQ ID NO: 2373 - DNA, 24 bp, Artificial Sequence
  Description of Artificial Sequence:  Hypothetical Probe Sequence
tcccgcaaagccggacataccgaa

SEQ ID NO: 2374 - DNA, 24 bp, Artificial Sequence
  Description of Artificial Sequence:  Hypothetical Probe Sequence
tcccagtgctcagtgccgaatctg

SEQ ID NO: 2375 - DNA, 24 bp, Artificial Sequence
  Description of Artificial Sequence:  Hypothetical Probe Sequence
tcccagtgctgtatcgcacgttga

SEQ ID NO: 2376 - DNA, 24 bp, Artificial Sequence
  Description of Artificial Sequence:  Hypothetical Probe Sequence
tcccagtgccattcccgagtttag

SEQ ID NO: 2377 - DNA, 24 bp, Artificial Sequence
  Description of Artificial Sequence:  Hypothetical Probe Sequence
tcccagtggcaatcgtcgaaggac

SEQ ID NO: 2378 - DNA, 24 bp, Artificial Sequence
  Description of Artificial Sequence:  Hypothetical Probe Sequence
tcccagtgcctaggacgtctgctt

SEQ ID NO: 2379 - DNA, 24 bp, Artificial Sequence
  Description of Artificial Sequence:  Hypothetical Probe Sequence
tcccagtgtccccctagtgccagc

SEQ ID NO: 2380 - DNA, 24 bp, Artificial Sequence
  Description of Artificial Sequence:  Hypothetical Probe Sequence
tcccagtgcagcgtctcgttagcc

SEQ ID NO: 2381 - DNA, 24 bp, Artificial Sequence
  Description of Artificial Sequence:  Hypothetical Probe Sequence
tcccagtgggacagtggcttgcaa

SEQ ID NO: 2382 - DNA, 24 bp, Artificial Sequence
  Description of Artificial Sequence:  Hypothetical Probe Sequence
tcccagtgagcccgtttcgttctg

SEQ ID NO: 2383 - DNA, 24 bp, Artificial Sequence
  Description of Artificial Sequence:  Hypothetical Probe Sequence
tcccaccttctgaatctccctgcg

SEQ ID NO: 2384 - DNA, 24 bp, Artificial Sequence
  Description of Artificial Sequence:  Hypothetical Probe Sequence
tcccaccttgtcatcggtgcaaag

SEQ ID NO: 2385 - DNA, 24 bp, Artificial Sequence
  Description of Artificial Sequence:  Hypothetical Probe Sequence
tcccacctgcaacacgtgtccttg

SEQ ID NO: 2386 - DNA, 24 bp, Artificial Sequence
  Description of Artificial Sequence:  Hypothetical Probe Sequence
tcccacctaggacagctctgcacg

SEQ ID NO: 2387 - DNA, 24 bp, Artificial Sequence
  Description of Artificial Sequence:  Hypothetical Probe Sequence
tcccacctgatgcttgtcgttgcg

SEQ ID NO: 2388 - DNA, 24 bp, Artificial Sequence
  Description of Artificial Sequence:  Hypothetical Probe Sequence
tcccaccttccccacgctcatgtc

SEQ ID NO: 2389 - DNA, 24 bp, Artificial Sequence
  Description of Artificial Sequence:  Hypothetical Probe Sequence
tcccacctcagccttggagtacgg

SEQ ID NO: 2390 - DNA, 24 bp, Artificial Sequence
  Description of Artificial Sequence:  Hypothetical Probe Sequence
tcccacctacggtcgtcgaactca

SEQ ID NO: 2391 - DNA, 24 bp, Artificial Sequence
  Description of Artificial Sequence:  Hypothetical Probe Sequence
tcccatcgcgttgcttaaaggcaa

SEQ ID NO: 2392 - DNA, 24 bp, Artificial Sequence
  Description of Artificial Sequence:  Hypothetical Probe Sequence
tcccatcgccatcagcctcattga

SEQ ID NO: 2393 - DNA, 24 bp, Artificial Sequence
  Description of Artificial Sequence:  Hypothetical Probe Sequence
tcccatcggatgttagaccttgcg

SEQ ID NO: 2394 - DNA, 24 bp, Artificial Sequence
  Description of Artificial Sequence:  Hypothetical Probe Sequence
tcccatcgtgcgaggaggtacacg

SEQ ID NO: 2395 - DNA, 24 bp, Artificial Sequence
  Description of Artificial Sequence:  Hypothetical Probe Sequence
tcccatcgcacgtcgttcccatac

SEQ ID NO: 2396 - DNA, 24 bp, Artificial Sequence
  Description of Artificial Sequence:  Hypothetical Probe Sequence
tcccatcgcagccagcaatcctgt

SEQ ID NO: 2397 - DNA, 24 bp, Artificial Sequence
  Description of Artificial Sequence:  Hypothetical Probe Sequence
tcccatcggaccttgacagcatcg

SEQ ID NO: 2398 - DNA, 24 bp, Artificial Sequence
  Description of Artificial Sequence:  Hypothetical Probe Sequence
tcccatcgggacctcaatcggatg

SEQ ID NO: 2399 - DNA, 24 bp, Artificial Sequence
  Description of Artificial Sequence:  Hypothetical Probe Sequence
tcccatcgagccatcgccatacct

SEQ ID NO: 2400 - DNA, 24 bp, Artificial Sequence
  Description of Artificial Sequence:  Hypothetical Probe Sequence
tcccaggacttggtgcgtgctcgt

SEQ ID NO: 2401 - DNA, 24 bp, Artificial Sequence
  Description of Artificial Sequence:  Hypothetical Probe Sequence
tcccaggagcttacggagccatac

SEQ ID NO: 2402 - DNA, 24 bp, Artificial Sequence
  Description of Artificial Sequence:  Hypothetical Probe Sequence
tcccaggaggtattagtgcgtgcg

SEQ ID NO: 2403 - DNA, 24 bp, Artificial Sequence
  Description of Artificial Sequence:  Hypothetical Probe Sequence
tcccaggagagtggactcccagcc

SEQ ID NO: 2404 - DNA, 24 bp, Artificial Sequence
  Description of Artificial Sequence:  Hypothetical Probe Sequence
tcccaggaacctcgaagcaaccta

SEQ ID NO: 2405 - DNA, 24 bp, Artificial Sequence
  Description of Artificial Sequence:  Hypothetical Probe Sequence
tcccaggagatgtgcgtgcgcttg

SEQ ID NO: 2406 - DNA, 24 bp, Artificial Sequence
  Description of Artificial Sequence:  Hypothetical Probe Sequence
tcccaggatccccctaaggagctt

SEQ ID NO: 2407 - DNA, 24 bp, Artificial Sequence
  Description of Artificial Sequence:  Hypothetical Probe Sequence
tcccaggatgcgaatcgcaattag

SEQ ID NO: 2408 - DNA, 24 bp, Artificial Sequence
  Description of Artificial Sequence:  Hypothetical Probe Sequence
tccccctatgatcgaaagccccta

SEQ ID NO: 2409 - DNA, 24 bp, Artificial Sequence
  Description of Artificial Sequence:  Hypothetical Probe Sequence
tccccctacgttcctaatcggtgc

SEQ ID NO: 2410 - DNA, 24 bp, Artificial Sequence
  Description of Artificial Sequence:  Hypothetical Probe Sequence
tccccctactcagtgcacggggta

SEQ ID NO: 2411 - DNA, 24 bp, Artificial Sequence
  Description of Artificial Sequence:  Hypothetical Probe Sequence
tccccctagcttcacgggtacacg

SEQ ID NO: 2412 - DNA, 24 bp, Artificial Sequence
  Description of Artificial Sequence:  Hypothetical Probe Sequence
tccccctaggtagagttgcggtgc

SEQ ID NO: 2413 - DNA, 24 bp, Artificial Sequence
  Description of Artificial Sequence:  Hypothetical Probe Sequence
tccccctatgcggatgtgcgagtg

SEQ ID NO: 2414 - DNA, 24 bp, Artificial Sequence
  Description of Artificial Sequence:  Hypothetical Probe Sequence
tccccctagaccatacacggcttg

SEQ ID NO: 2415 - DNA, 24 bp, Artificial Sequence
  Description of Artificial Sequence:  Hypothetical Probe Sequence
tccccctaggacaatcctcatgcg

SEQ ID NO: 2416 - DNA, 24 bp, Artificial Sequence
  Description of Artificial Sequence:  Hypothetical Probe Sequence
tccccctaacggctgtggacggta

SEQ ID NO: 2417 - DNA, 24 bp, Artificial Sequence
  Description of Artificial Sequence:  Hypothetical Probe Sequence
tcccgatgttgatccccctaacct

SEQ ID NO: 2418 - DNA, 24 bp, Artificial Sequence
  Description of Artificial Sequence:  Hypothetical Probe Sequence
tcccgatgttagctgtagcctgcg

SEQ ID NO: 2419 - DNA, 24 bp, Artificial Sequence
  Description of Artificial Sequence:  Hypothetical Probe Sequence
tcccgatgtgtcacggtgtcagcc

SEQ ID NO: 2420 - DNA, 24 bp, Artificial Sequence
  Description of Artificial Sequence:  Hypothetical Probe Sequence
tcccgatgctgtaaagggacctgt

SEQ ID NO: 2421 - DNA, 24 bp, Artificial Sequence
  Description of Artificial Sequence:  Hypothetical Probe Sequence
tcccgatgggtaagtgtcccctca

SEQ ID NO: 2422 - DNA, 24 bp, Artificial Sequence
  Description of Artificial Sequence:  Hypothetical Probe Sequence
tcccgatggagttgtccttgacgg

SEQ ID NO: 2423 - DNA, 24 bp, Artificial Sequence
  Description of Artificial Sequence:  Hypothetical Probe Sequence
tcccgatggcaagcaaaaagctca

SEQ ID NO: 2424 - DNA, 24 bp, Artificial Sequence
  Description of Artificial Sequence:  Hypothetical Probe Sequence
tcccgatgatcgggacagtggtgc

SEQ ID NO: 2425 - DNA, 24 bp, Artificial Sequence
  Description of Artificial Sequence:  Hypothetical Probe Sequence
tcccgatgtgcgatacccatagcc

SEQ ID NO: 2426 - DNA, 24 bp, Artificial Sequence
  Description of Artificial Sequence:  Hypothetical Probe Sequence
tcccgatgcacgggaccttgttga

SEQ ID NO: 2427 - DNA, 24 bp, Artificial Sequence
  Description of Artificial Sequence:  Hypothetical Probe Sequence
tcccgatggaccgcaacgttccta

SEQ ID NO: 2428 - DNA, 24 bp, Artificial Sequence
  Description of Artificial Sequence:  Hypothetical Probe Sequence
tcccgatgggaccctacagcctca

SEQ ID NO: 2429 - DNA, 24 bp, Artificial Sequence
  Description of Artificial Sequence:  Hypothetical Probe Sequence
tcccgatgacggctcacttggtgc

SEQ ID NO: 2430 - DNA, 24 bp, Artificial Sequence
  Description of Artificial Sequence:  Hypothetical Probe Sequence
tcccgatgagcctgcgttagacct

SEQ ID NO: 2431 - DNA, 24 bp, Artificial Sequence
  Description of Artificial Sequence:  Hypothetical Probe Sequence
tccctccctgatacctcagcgtgc

SEQ ID NO: 2432 - DNA, 24 bp, Artificial Sequence
  Description of Artificial Sequence:  Hypothetical Probe Sequence
tccctccctacagtgcgcaaacgg

SEQ ID NO: 2433 - DNA, 24 bp, Artificial Sequence
  Description of Artificial Sequence:  Hypothetical Probe Sequence
tccctccctgtccctacgaaatcg

SEQ ID NO: 2434 - DNA, 24 bp, Artificial Sequence
  Description of Artificial Sequence:  Hypothetical Probe Sequence
tccctccccttgttagggacccat

SEQ ID NO: 2435 - DNA, 24 bp, Artificial Sequence
  Description of Artificial Sequence:  Hypothetical Probe Sequence
tccctcccctcacgttccatgagt

SEQ ID NO: 2436 - DNA, 24 bp, Artificial Sequence
  Description of Artificial Sequence:  Hypothetical Probe Sequence
tccctcccctgtgtgcgagtctca

SEQ ID NO: 2437 - DNA, 24 bp, Artificial Sequence
  Description of Artificial Sequence:  Hypothetical Probe Sequence
tccctccccgaattagctgttgcg

SEQ ID NO: 2438 - DNA, 24 bp, Artificial Sequence
  Description of Artificial Sequence:  Hypothetical Probe Sequence
tccctcccatcgcctaatcggagt

SEQ ID NO: 2439 - DNA, 24 bp, Artificial Sequence
  Description of Artificial Sequence:  Hypothetical Probe Sequence
tccctcccaggattgaacgggtct

SEQ ID NO: 2440 - DNA, 24 bp, Artificial Sequence
  Description of Artificial Sequence:  Hypothetical Probe Sequence
tccctcccgatgaaagacctgctt

SEQ ID NO: 2441 - DNA, 24 bp, Artificial Sequence
  Description of Artificial Sequence:  Hypothetical Probe Sequence
tccctcccacggaatcaggacagc

SEQ ID NO: 2442 - DNA, 24 bp, Artificial Sequence
  Description of Artificial Sequence:  Hypothetical Probe Sequence
tccctgcgtgatagtggcaaacct

SEQ ID NO: 2443 - DNA, 24 bp, Artificial Sequence
  Description of Artificial Sequence:  Hypothetical Probe Sequence
tccctgcgatacgtgcaatcgcaa

SEQ ID NO: 2444 - DNA, 24 bp, Artificial Sequence
  Description of Artificial Sequence:  Hypothetical Probe Sequence
tccctgcgaaagagtgcgaaccat

SEQ ID NO: 2445 - DNA, 24 bp, Artificial Sequence
  Description of Artificial Sequence:  Hypothetical Probe Sequence
tccctgcgtacaccatatcgtgcg

SEQ ID NO: 2446 - DNA, 24 bp, Artificial Sequence
  Description of Artificial Sequence:  Hypothetical Probe Sequence
tccctgcgtgtcagtgcttggtgc

SEQ ID NO: 2447 - DNA, 24 bp, Artificial Sequence
  Description of Artificial Sequence:  Hypothetical Probe Sequence
tccctgcgcttgaggaataccgtt

SEQ ID NO: 2448 - DNA, 24 bp, Artificial Sequence
  Description of Artificial Sequence:  Hypothetical Probe Sequence
tccctgcgcgaacacgtgatcacg

SEQ ID NO: 2449 - DNA, 24 bp, Artificial Sequence
  Description of Artificial Sequence:  Hypothetical Probe Sequence
tccctgcggcttttgaagtgagcc

SEQ ID NO: 2450 - DNA, 24 bp, Artificial Sequence
  Description of Artificial Sequence:  Hypothetical Probe Sequence
tccctgcggcaacgttgtctcacg

SEQ ID NO: 2451 - DNA, 24 bp, Artificial Sequence
  Description of Artificial Sequence:  Hypothetical Probe Sequence
tccctgcgacctgcaaatcgtgtc

SEQ ID NO: 2452 - DNA, 24 bp, Artificial Sequence
  Description of Artificial Sequence:  Hypothetical Probe Sequence
tccctgcgaggagagtgtgcggac

SEQ ID NO: 2453 - DNA, 24 bp, Artificial Sequence
  Description of Artificial Sequence:  Hypothetical Probe Sequence
tccctgcgtcccgagtgcaagcaa

SEQ ID NO: 2454 - DNA, 24 bp, Artificial Sequence
  Description of Artificial Sequence:  Hypothetical Probe Sequence
tccctgcgcacgggtacgttgacc

SEQ ID NO: 2455 - DNA, 24 bp, Artificial Sequence
  Description of Artificial Sequence:  Hypothetical Probe Sequence
tccctgcgcagcctgtaggaagcc

SEQ ID NO: 2456 - DNA, 24 bp, Artificial Sequence
  Description of Artificial Sequence:  Hypothetical Probe Sequence
tccctgcggaccctgtcagcctca

SEQ ID NO: 2457 - DNA, 24 bp, Artificial Sequence
  Description of Artificial Sequence:  Hypothetical Probe Sequence
tccctgcggtgcgcttgcaagagt

SEQ ID NO: 2458 - DNA, 24 bp, Artificial Sequence
  Description of Artificial Sequence:  Hypothetical Probe Sequence
tccccacgttgacagctcccaatc

SEQ ID NO: 2459 - DNA, 24 bp, Artificial Sequence
  Description of Artificial Sequence:  Hypothetical Probe Sequence
tccccacgttagtcgtcttgcgaa

SEQ ID NO: 2460 - DNA, 24 bp, Artificial Sequence
  Description of Artificial Sequence:  Hypothetical Probe Sequence
tccccacgtctgggacacggtgtc

SEQ ID NO: 2461 - DNA, 24 bp, Artificial Sequence
  Description of Artificial Sequence:  Hypothetical Probe Sequence
tccccacgtcgtgtgcatactccc

SEQ ID NO: 2462 - DNA, 24 bp, Artificial Sequence
  Description of Artificial Sequence:  Hypothetical Probe Sequence
tccccacgctgttctgagccagtg

SEQ ID NO: 2463 - DNA, 24 bp, Artificial Sequence
  Description of Artificial Sequence:  Hypothetical Probe Sequence
tccccacgggtatcccctgtccat

SEQ ID NO: 2464 - DNA, 24 bp, Artificial Sequence
  Description of Artificial Sequence:  Hypothetical Probe Sequence
tccccacggtctcagcatcgagtg

SEQ ID NO: 2465 - DNA, 24 bp, Artificial Sequence
  Description of Artificial Sequence:  Hypothetical Probe Sequence
tccccacggcaaaatcgtgctctg

SEQ ID NO: 2466 - DNA, 24 bp, Artificial Sequence
  Description of Artificial Sequence:  Hypothetical Probe Sequence
tccccacgacctaatcgatgctca

SEQ ID NO: 2467 - DNA, 24 bp, Artificial Sequence
  Description of Artificial Sequence:  Hypothetical Probe Sequence
tccccacgatcgcgaatgatccat

SEQ ID NO: 2468 - DNA, 24 bp, Artificial Sequence
  Description of Artificial Sequence:  Hypothetical Probe Sequence
tccccacgcctagtgcagccatac

SEQ ID NO: 2469 - DNA, 24 bp, Artificial Sequence
  Description of Artificial Sequence:  Hypothetical Probe Sequence
tccccacgtgcgtgattcgtcgtt

SEQ ID NO: 2470 - DNA, 24 bp, Artificial Sequence
  Description of Artificial Sequence:  Hypothetical Probe Sequence
tccccacgcagccgttcttgacct

SEQ ID NO: 2471 - DNA, 24 bp, Artificial Sequence
  Description of Artificial Sequence:  Hypothetical Probe Sequence
tccccacggaccagcctacacagc

SEQ ID NO: 2472 - DNA, 24 bp, Artificial Sequence
  Description of Artificial Sequence:  Hypothetical Probe Sequence
tccccacggtgctgtctgcgtgat

SEQ ID NO: 2473 - DNA, 24 bp, Artificial Sequence
  Description of Artificial Sequence:  Hypothetical Probe Sequence
tccccacgggacccatcgttgagt

SEQ ID NO: 2474 - DNA, 24 bp, Artificial Sequence
  Description of Artificial Sequence:  Hypothetical Probe Sequence
tccccagcttgaaaaggaccctca

SEQ ID NO: 2475 - DNA, 24 bp, Artificial Sequence
  Description of Artificial Sequence:  Hypothetical Probe Sequence
tccccagcaatcggacggtagacc

SEQ ID NO: 2476 - DNA, 24 bp, Artificial Sequence
  Description of Artificial Sequence:  Hypothetical Probe Sequence
tccccagctacagcaaaaagcagc

SEQ ID NO: 2477 - DNA, 24 bp, Artificial Sequence
  Description of Artificial Sequence:  Hypothetical Probe Sequence
tccccagctctgatcggtctggac

SEQ ID NO: 2478 - DNA, 24 bp, Artificial Sequence
  Description of Artificial Sequence:  Hypothetical Probe Sequence
tccccagctcgtctgtgatggctt

SEQ ID NO: 2479 - DNA, 24 bp, Artificial Sequence
  Description of Artificial Sequence:  Hypothetical Probe Sequence
tccccagccttgctgtatcgggac

SEQ ID NO: 2480 - DNA, 24 bp, Artificial Sequence
  Description of Artificial Sequence:  Hypothetical Probe Sequence
tccccagccgaagtgcctcacttg

SEQ ID NO: 2481 - DNA, 24 bp, Artificial Sequence
  Description of Artificial Sequence:  Hypothetical Probe Sequence
tccccagcggtaaggacagcaaag

SEQ ID NO: 2482 - DNA, 24 bp, Artificial Sequence
  Description of Artificial Sequence:  Hypothetical Probe Sequence
tccccagcacctaatcacgggagt

SEQ ID NO: 2483 - DNA, 24 bp, Artificial Sequence
  Description of Artificial Sequence:  Hypothetical Probe Sequence
tccccagcatcggatgcttgatcg

SEQ ID NO: 2484 - DNA, 24 bp, Artificial Sequence
  Description of Artificial Sequence:  Hypothetical Probe Sequence
tccccagcaggagagtagccccat

SEQ ID NO: 2485 - DNA, 24 bp, Artificial Sequence
  Description of Artificial Sequence:  Hypothetical Probe Sequence
tccccagccagctctgtgtcacgg

SEQ ID NO: 2486 - DNA, 24 bp, Artificial Sequence
  Description of Artificial Sequence:  Hypothetical Probe Sequence
tccccagcggaccgaatgtctgtc

SEQ ID NO: 2487 - DNA, 24 bp, Artificial Sequence
  Description of Artificial Sequence:  Hypothetical Probe Sequence
tccccagcagccggtagcttccat

SEQ ID NO: 2488 - DNA, 24 bp, Artificial Sequence
  Description of Artificial Sequence:  Hypothetical Probe Sequence
tcccgacctgattgattgtctgcg

SEQ ID NO: 2489 - DNA, 24 bp, Artificial Sequence
  Description of Artificial Sequence:  Hypothetical Probe Sequence
tcccgaccttagaatcgtgcccta

SEQ ID NO: 2490 - DNA, 24 bp, Artificial Sequence
  Description of Artificial Sequence:  Hypothetical Probe Sequence
tcccgaccaatcttgagaccgtgc

SEQ ID NO: 2491 - DNA, 24 bp, Artificial Sequence
  Description of Artificial Sequence:  Hypothetical Probe Sequence
tcccgacctacattgaacggacct

SEQ ID NO: 2492 - DNA, 24 bp, Artificial Sequence
  Description of Artificial Sequence:  Hypothetical Probe Sequence
tcccgacctgtctcccgagtaaag

SEQ ID NO: 2493 - DNA, 24 bp, Artificial Sequence
  Description of Artificial Sequence:  Hypothetical Probe Sequence
tcccgacccgttttagcgtttcgt

SEQ ID NO: 2494 - DNA, 24 bp, Artificial Sequence
  Description of Artificial Sequence:  Hypothetical Probe Sequence
tcccgaccctcaggtagcaacacg

SEQ ID NO: 2495 - DNA, 24 bp, Artificial Sequence
  Description of Artificial Sequence:  Hypothetical Probe Sequence
tcccgaccctgtaggacttgagcc

SEQ ID NO: 2496 - DNA, 24 bp, Artificial Sequence
  Description of Artificial Sequence:  Hypothetical Probe Sequence
tcccgaccgtctaaaggaccgatg

SEQ ID NO: 2497 - DNA, 24 bp, Artificial Sequence
  Description of Artificial Sequence:  Hypothetical Probe Sequence
tcccgaccgagtgtcttgcgtctg

SEQ ID NO: 2498 - DNA, 24 bp, Artificial Sequence
  Description of Artificial Sequence:  Hypothetical Probe Sequence
tcccgaccgcaaaggagatgccta

SEQ ID NO: 2499 - DNA, 24 bp, Artificial Sequence
  Description of Artificial Sequence:  Hypothetical Probe Sequence
tcccgacccctaatacgatgagcc

SEQ ID NO: 2500 - DNA, 24 bp, Artificial Sequence
  Description of Artificial Sequence:  Hypothetical Probe Sequence
tcccgacccacggtgcagcctaca

SEQ ID NO: 2501 - DNA, 24 bp, Artificial Sequence
  Description of Artificial Sequence:  Hypothetical Probe Sequence
tcccgtgcttgatctgagtgcagc

SEQ ID NO: 2502 - DNA, 24 bp, Artificial Sequence
  Description of Artificial Sequence:  Hypothetical Probe Sequence
tcccgtgcttagtgatagcccgtt

SEQ ID NO: 2503 - DNA, 24 bp, Artificial Sequence
  Description of Artificial Sequence:  Hypothetical Probe Sequence
tcccgtgctgtcccatcgttccat

SEQ ID NO: 2504 - DNA, 24 bp, Artificial Sequence
  Description of Artificial Sequence:  Hypothetical Probe Sequence
tcccgtgcctcaaatcgtgcagtg

SEQ ID NO: 2505 - DNA, 24 bp, Artificial Sequence
  Description of Artificial Sequence:  Hypothetical Probe Sequence
tcccgtgccgaacgaactcaacct

SEQ ID NO: 2506 - DNA, 24 bp, Artificial Sequence
  Description of Artificial Sequence:  Hypothetical Probe Sequence
tcccgtgcgtctctgtacggtccc

SEQ ID NO: 2507 - DNA, 24 bp, Artificial Sequence
  Description of Artificial Sequence:  Hypothetical Probe Sequence
tcccgtgcacctgtctgatggcaa

SEQ ID NO: 2508 - DNA, 24 bp, Artificial Sequence
  Description of Artificial Sequence:  Hypothetical Probe Sequence
tcccgtgctcccgcttgtgctctg

SEQ ID NO: 2509 - DNA, 24 bp, Artificial Sequence
  Description of Artificial Sequence:  Hypothetical Probe Sequence
tcccgtgcgaccttgaagtgggac

SEQ ID NO: 2510 - DNA, 24 bp, Artificial Sequence
  Description of Artificial Sequence:  Hypothetical Probe Sequence
tcccgtgcgtgcttaggtgcgagt

SEQ ID NO: 2511 - DNA, 24 bp, Artificial Sequence
  Description of Artificial Sequence:  Hypothetical Probe Sequence
tcccgtgcacggaaagcctaggac

SEQ ID NO: 2512 - DNA, 24 bp, Artificial Sequence
  Description of Artificial Sequence:  Hypothetical Probe Sequence
tcccgtgcagccaggattagacgg

SEQ ID NO: 2513 - DNA, 24 bp, Artificial Sequence
  Description of Artificial Sequence:  Hypothetical Probe Sequence
tcccggacaatcatcgaggagacc

SEQ ID NO: 2514 - DNA, 24 bp, Artificial Sequence
  Description of Artificial Sequence:  Hypothetical Probe Sequence
tcccggacatactgtcggactgcg

SEQ ID NO: 2515 - DNA, 24 bp, Artificial Sequence
  Description of Artificial Sequence:  Hypothetical Probe Sequence
tcccggacaaagtcccttagacgg

SEQ ID NO: 2516 - DNA, 24 bp, Artificial Sequence
  Description of Artificial Sequence:  Hypothetical Probe Sequence
tcccggactacacttgacgggtct

SEQ ID NO: 2517 - DNA, 24 bp, Artificial Sequence
  Description of Artificial Sequence:  Hypothetical Probe Sequence
tcccggactcgtcgaagacctcgt

SEQ ID NO: 2518 - DNA, 24 bp, Artificial Sequence
  Description of Artificial Sequence:  Hypothetical Probe Sequence
tcccggaccttgccatctcaatcg

SEQ ID NO: 2519 - DNA, 24 bp, Artificial Sequence
  Description of Artificial Sequence:  Hypothetical Probe Sequence
tcccggaccgttcacgctcagatg

SEQ ID NO: 2520 - DNA, 24 bp, Artificial Sequence
  Description of Artificial Sequence:  Hypothetical Probe Sequence
tcccggacgtctatactccccgaa

SEQ ID NO: 2521 - DNA, 24 bp, Artificial Sequence
  Description of Artificial Sequence:  Hypothetical Probe Sequence
tcccggacatcggagtctcatgcg

SEQ ID NO: 2522 - DNA, 24 bp, Artificial Sequence
  Description of Artificial Sequence:  Hypothetical Probe Sequence
tcccggacgatgccatatcgcttg

SEQ ID NO: 2523 - DNA, 24 bp, Artificial Sequence
  Description of Artificial Sequence:  Hypothetical Probe Sequence
tcccggactgcgaatccctacgaa

SEQ ID NO: 2524 - DNA, 24 bp, Artificial Sequence
  Description of Artificial Sequence:  Hypothetical Probe Sequence
tcccggaccacgttgacgaagacc

SEQ ID NO: 2525 - DNA, 24 bp, Artificial Sequence
  Description of Artificial Sequence:  Hypothetical Probe Sequence
tcccggacgaccggacaaagggta

SEQ ID NO: 2526 - DNA, 24 bp, Artificial Sequence
  Description of Artificial Sequence:  Hypothetical Probe Sequence
tcccggacgtgcaaagtctgacgg

SEQ ID NO: 2527 - DNA, 24 bp, Artificial Sequence
  Description of Artificial Sequence:  Hypothetical Probe Sequence
tcccggacggacgcaaaggatgtc

SEQ ID NO: 2528 - DNA, 24 bp, Artificial Sequence
  Description of Artificial Sequence:  Hypothetical Probe Sequence
tcccggacagccacctagccagtg

SEQ ID NO: 2529 - DNA, 24 bp, Artificial Sequence
  Description of Artificial Sequence:  Hypothetical Probe Sequence
tcccacggttgactgtaggatgcg

SEQ ID NO: 2530 - DNA, 24 bp, Artificial Sequence
  Description of Artificial Sequence:  Hypothetical Probe Sequence
tcccacgggctttctgcgttgagt

SEQ ID NO: 2531 - DNA, 24 bp, Artificial Sequence
  Description of Artificial Sequence:  Hypothetical Probe Sequence
tcccacgggtctggtagcttgtgc

SEQ ID NO: 2532 - DNA, 24 bp, Artificial Sequence
  Description of Artificial Sequence:  Hypothetical Probe Sequence
tcccacggcctatcccatactccc

SEQ ID NO: 2533 - DNA, 24 bp, Artificial Sequence
  Description of Artificial Sequence:  Hypothetical Probe Sequence
tcccacggtgcgcctaatacgcaa

SEQ ID NO: 2534 - DNA, 24 bp, Artificial Sequence
  Description of Artificial Sequence:  Hypothetical Probe Sequence
tcccacgggaccatacctgttgcg

SEQ ID NO: 2535 - DNA, 24 bp, Artificial Sequence
  Description of Artificial Sequence:  Hypothetical Probe Sequence
tcccacgggtgcatcgttagacgg

SEQ ID NO: 2536 - DNA, 24 bp, Artificial Sequence
  Description of Artificial Sequence:  Hypothetical Probe Sequence
tcccagccttgatctgatcggctt

SEQ ID NO: 2537 - DNA, 24 bp, Artificial Sequence
  Description of Artificial Sequence:  Hypothetical Probe Sequence
tcccagcctgatgatgtgcgctca

SEQ ID NO: 2538 - DNA, 24 bp, Artificial Sequence
  Description of Artificial Sequence:  Hypothetical Probe Sequence
tcccagccttagagtgcttggctt

SEQ ID NO: 2539 - DNA, 24 bp, Artificial Sequence
  Description of Artificial Sequence:  Hypothetical Probe Sequence
tcccagccatacaatcacgggtgc

SEQ ID NO: 2540 - DNA, 24 bp, Artificial Sequence
  Description of Artificial Sequence:  Hypothetical Probe Sequence
tcccagcctctgttgagtgcgacc

SEQ ID NO: 2541 - DNA, 24 bp, Artificial Sequence
  Description of Artificial Sequence:  Hypothetical Probe Sequence
tcccagcctcgtgtctacggatcg

SEQ ID NO: 2542 - DNA, 24 bp, Artificial Sequence
  Description of Artificial Sequence:  Hypothetical Probe Sequence
tcccagccctcattagtcccggta

SEQ ID NO: 2543 - DNA, 24 bp, Artificial Sequence
  Description of Artificial Sequence:  Hypothetical Probe Sequence
tcccagccgcttcctaaccttcgt

SEQ ID NO: 2544 - DNA, 24 bp, Artificial Sequence
  Description of Artificial Sequence:  Hypothetical Probe Sequence
tcccagccggtattaggaccccat

SEQ ID NO: 2545 - DNA, 24 bp, Artificial Sequence
  Description of Artificial Sequence:  Hypothetical Probe Sequence
tcccagccagtgttagcctatgcg

SEQ ID NO: 2546 - DNA, 24 bp, Artificial Sequence
  Description of Artificial Sequence:  Hypothetical Probe Sequence
tcccagccacctatactgcggagt

SEQ ID NO: 2547 - DNA, 24 bp, Artificial Sequence
  Description of Artificial Sequence:  Hypothetical Probe Sequence
tcccagccatcggtgctgatagcc

SEQ ID NO: 2548 - DNA, 24 bp, Artificial Sequence
  Description of Artificial Sequence:  Hypothetical Probe Sequence
tcccagcctcccaccttgatcgaa

SEQ ID NO: 2549 - DNA, 24 bp, Artificial Sequence
  Description of Artificial Sequence:  Hypothetical Probe Sequence
tcccagcccacgggtaagcctctg

SEQ ID NO: 2550 - DNA, 24 bp, Artificial Sequence
  Description of Artificial Sequence:  Hypothetical Probe Sequence
tcccagcccagccttggatgatcg

SEQ ID NO: 2551 - DNA, 24 bp, Artificial Sequence
  Description of Artificial Sequence:  Hypothetical Probe Sequence
tcccagccgtgcaaagaggagcaa

SEQ ID NO: 2552 - DNA, 24 bp, Artificial Sequence
  Description of Artificial Sequence:  Hypothetical Probe Sequence
tgcgttgattgagagtacggcgtt

SEQ ID NO: 2553 - DNA, 24 bp, Artificial Sequence
  Description of Artificial Sequence:  Hypothetical Probe Sequence
tgcgttgaaaagatcgtgcgcgtt

SEQ ID NO: 2554 - DNA, 24 bp, Artificial Sequence
  Description of Artificial Sequence:  Hypothetical Probe Sequence
tgcgttgacgttctgtcctatgcg

SEQ ID NO: 2555 - DNA, 24 bp, Artificial Sequence
  Description of Artificial Sequence:  Hypothetical Probe Sequence
tgcgttgaccattcgtatcgcgaa

SEQ ID NO: 2556 - DNA, 24 bp, Artificial Sequence
  Description of Artificial Sequence:  Hypothetical Probe Sequence
tgcgttgacacgcgttttgacgaa

SEQ ID NO: 2557 - DNA, 24 bp, Artificial Sequence
  Description of Artificial Sequence:  Hypothetical Probe Sequence
tgcgttgaggacgatgtcccccat

SEQ ID NO: 2558 - DNA, 24 bp, Artificial Sequence
  Description of Artificial Sequence:  Hypothetical Probe Sequence
tgcgttgaagccagtgcgaagatg

SEQ ID NO: 2559 - DNA, 24 bp, Artificial Sequence
  Description of Artificial Sequence:  Hypothetical Probe Sequence
tgcgtgattgtccagccttggtgc

SEQ ID NO: 2560 - DNA, 24 bp, Artificial Sequence
  Description of Artificial Sequence:  Hypothetical Probe Sequence
tgcgtgatcttgggactccccgtt

SEQ ID NO: 2561 - DNA, 24 bp, Artificial Sequence
  Description of Artificial Sequence:  Hypothetical Probe Sequence
tgcgtgatgctttcccacctgtgc

SEQ ID NO: 2562 - DNA, 24 bp, Artificial Sequence
  Description of Artificial Sequence:  Hypothetical Probe Sequence
tgcgtgatgagtcagccagccacg

SEQ ID NO: 2563 - DNA, 24 bp, Artificial Sequence
  Description of Artificial Sequence:  Hypothetical Probe Sequence
tgcgtgatgcaactgtccattgcg

SEQ ID NO: 2564 - DNA, 24 bp, Artificial Sequence
  Description of Artificial Sequence:  Hypothetical Probe Sequence
tgcgtgattcccacctcttgcagc

SEQ ID NO: 2565 - DNA, 24 bp, Artificial Sequence
  Description of Artificial Sequence:  Hypothetical Probe Sequence
tgcgtgatggacccatatcgcacg

SEQ ID NO: 2566 - DNA, 24 bp, Artificial Sequence
  Description of Artificial Sequence:  Hypothetical Probe Sequence
tgcgtgatagcccagcaatcgcaa

SEQ ID NO: 2567 - DNA, 24 bp, Artificial Sequence
  Description of Artificial Sequence:  Hypothetical Probe Sequence
tgcgttagttgagaccgcttacgg

SEQ ID NO: 2568 - DNA, 24 bp, Artificial Sequence
  Description of Artificial Sequence:  Hypothetical Probe Sequence
tgcgttagaaaggacccacgcgtt

SEQ ID NO: 2569 - DNA, 24 bp, Artificial Sequence
  Description of Artificial Sequence:  Hypothetical Probe Sequence
tgcgttagcgaatgtcggacttga

SEQ ID NO: 2570 - DNA, 24 bp, Artificial Sequence
  Description of Artificial Sequence:  Hypothetical Probe Sequence
tgcgttaggctttcccagtggacc

SEQ ID NO: 2571 - DNA, 24 bp, Artificial Sequence
  Description of Artificial Sequence:  Hypothetical Probe Sequence
tgcgttagtgcgcgaaatactgcg

SEQ ID NO: 2572 - DNA, 24 bp, Artificial Sequence
  Description of Artificial Sequence:  Hypothetical Probe Sequence
tgcgttaggtgcttgagcaacagc

SEQ ID NO: 2573 - DNA, 24 bp, Artificial Sequence
  Description of Artificial Sequence:  Hypothetical Probe Sequence
tgcgttagacgggatgtgcggatg

SEQ ID NO: 2574 - DNA, 24 bp, Artificial Sequence
  Description of Artificial Sequence:  Hypothetical Probe Sequence
tgcgttagagccgcttgatgagcc

SEQ ID NO: 2575 - DNA, 24 bp, Artificial Sequence
  Description of Artificial Sequence:  Hypothetical Probe Sequence
tgcgaatcaaagatcgtccccacg

SEQ ID NO: 2576 - DNA, 24 bp, Artificial Sequence
  Description of Artificial Sequence:  Hypothetical Probe Sequence
tgcgaatctcgttcgtcacgctca

SEQ ID NO: 2577 - DNA, 24 bp, Artificial Sequence
  Description of Artificial Sequence:  Hypothetical Probe Sequence
tgcgaatcctcagacccgaacagc

SEQ ID NO: 2578 - DNA, 24 bp, Artificial Sequence
  Description of Artificial Sequence:  Hypothetical Probe Sequence
tgcgaatcccattcccgtctcttg

SEQ ID NO: 2579 - DNA, 24 bp, Artificial Sequence
  Description of Artificial Sequence:  Hypothetical Probe Sequence
tgcgaatcgagtagccgtgctgat

SEQ ID NO: 2580 - DNA, 24 bp, Artificial Sequence
  Description of Artificial Sequence:  Hypothetical Probe Sequence
tgcgaatcagtgcagctgcgaaag

SEQ ID NO: 2581 - DNA, 24 bp, Artificial Sequence
  Description of Artificial Sequence:  Hypothetical Probe Sequence
tgcgaatccacgcgaactcaagga

SEQ ID NO: 2582 - DNA, 24 bp, Artificial Sequence
  Description of Artificial Sequence:  Hypothetical Probe Sequence
tgcgatacggtatgatagccgcaa

SEQ ID NO: 2583 - DNA, 24 bp, Artificial Sequence
  Description of Artificial Sequence:  Hypothetical Probe Sequence
tgcgatacgcaactgtgcaatccc

SEQ ID NO: 2584 - DNA, 24 bp, Artificial Sequence
  Description of Artificial Sequence:  Hypothetical Probe Sequence
tgcgataccctagcttgtgcgcaa

SEQ ID NO: 2585 - DNA, 24 bp, Artificial Sequence
  Description of Artificial Sequence:  Hypothetical Probe Sequence
tgcgatacgatggctttcccaaag

SEQ ID NO: 2586 - DNA, 24 bp, Artificial Sequence
  Description of Artificial Sequence:  Hypothetical Probe Sequence
tgcgaaagaaagtcccgcttttga

SEQ ID NO: 2587 - DNA, 24 bp, Artificial Sequence
  Description of Artificial Sequence:  Hypothetical Probe Sequence
tgcgaaagtcgtcttgtgcgagga

SEQ ID NO: 2588 - DNA, 24 bp, Artificial Sequence
  Description of Artificial Sequence:  Hypothetical Probe Sequence
tgcgaaagcgttggacatcggtct

SEQ ID NO: 2589 - DNA, 24 bp, Artificial Sequence
  Description of Artificial Sequence:  Hypothetical Probe Sequence
tgcgaaagggtatcgtcacggatg

SEQ ID NO: 2590 - DNA, 24 bp, Artificial Sequence
  Description of Artificial Sequence:  Hypothetical Probe Sequence
tgcgaaaggagtgatgcacgggta

SEQ ID NO: 2591 - DNA, 24 bp, Artificial Sequence
  Description of Artificial Sequence:  Hypothetical Probe Sequence
tgcgaaagacctttagacgggctt

SEQ ID NO: 2592 - DNA, 24 bp, Artificial Sequence
  Description of Artificial Sequence:  Hypothetical Probe Sequence
tgcgaaagtccccgttgagtgctt

SEQ ID NO: 2593 - DNA, 24 bp, Artificial Sequence
  Description of Artificial Sequence:  Hypothetical Probe Sequence
tgcgtacaaaagtgcgcttggctt

SEQ ID NO: 2594 - DNA, 24 bp, Artificial Sequence
  Description of Artificial Sequence:  Hypothetical Probe Sequence
tgcgtacaacctacggtcccctgt

SEQ ID NO: 2595 - DNA, 24 bp, Artificial Sequence
  Description of Artificial Sequence:  Hypothetical Probe Sequence
tgcgtacagaccacggacggggta

SEQ ID NO: 2596 - DNA, 24 bp, Artificial Sequence
  Description of Artificial Sequence:  Hypothetical Probe Sequence
tgcgtctgttgatcccgagtcacg

SEQ ID NO: 2597 - DNA, 24 bp, Artificial Sequence
  Description of Artificial Sequence:  Hypothetical Probe Sequence
tgcgtctgtgatgtgcacgggctt

SEQ ID NO: 2598 - DNA, 24 bp, Artificial Sequence
  Description of Artificial Sequence:  Hypothetical Probe Sequence
tgcgtctgtgtctgcgatcgtcgt

SEQ ID NO: 2599 - DNA, 24 bp, Artificial Sequence
  Description of Artificial Sequence:  Hypothetical Probe Sequence
tgcgtctgtcgtcctacacggcaa

SEQ ID NO: 2600 - DNA, 24 bp, Artificial Sequence
  Description of Artificial Sequence:  Hypothetical Probe Sequence
tgcgtctgcttgaaaggtgcatcg

SEQ ID NO: 2601 - DNA, 24 bp, Artificial Sequence
  Description of Artificial Sequence:  Hypothetical Probe Sequence
tgcgtctgctcaaggatgcgagga

SEQ ID NO: 2602 - DNA, 24 bp, Artificial Sequence
  Description of Artificial Sequence:  Hypothetical Probe Sequence
tgcgtctggcttcacgatacgctt

SEQ ID NO: 2603 - DNA, 24 bp, Artificial Sequence
  Description of Artificial Sequence:  Hypothetical Probe Sequence
tgcgtctggtctagtgacggtgcg

SEQ ID NO: 2604 - DNA, 24 bp, Artificial Sequence
  Description of Artificial Sequence:  Hypothetical Probe Sequence
tgcgtctggcaaatcgttgacacg

SEQ ID NO: 2605 - DNA, 24 bp, Artificial Sequence
  Description of Artificial Sequence:  Hypothetical Probe Sequence
tgcgtctgagtgtccctgcgctca

SEQ ID NO: 2606 - DNA, 24 bp, Artificial Sequence
  Description of Artificial Sequence:  Hypothetical Probe Sequence
tgcgtctgatcgaaagcagcctca

SEQ ID NO: 2607 - DNA, 24 bp, Artificial Sequence
  Description of Artificial Sequence:  Hypothetical Probe Sequence
tgcgtctgcctattgacacggctt

SEQ ID NO: 2608 - DNA, 24 bp, Artificial Sequence
  Description of Artificial Sequence:  Hypothetical Probe Sequence
tgcgtctgcagcttagcgtttctg

SEQ ID NO: 2609 - DNA, 24 bp, Artificial Sequence
  Description of Artificial Sequence:  Hypothetical Probe Sequence
tgcgtgtctgattgcgtccccacg

SEQ ID NO: 2610 - DNA, 24 bp, Artificial Sequence
  Description of Artificial Sequence:  Hypothetical Probe Sequence
tgcgtgtctctgcacggtgctcgt

SEQ ID NO: 2611 - DNA, 24 bp, Artificial Sequence
  Description of Artificial Sequence:  Hypothetical Probe Sequence
tgcgtgtctgtcgtgcggacgctt

SEQ ID NO: 2612 - DNA, 24 bp, Artificial Sequence
  Description of Artificial Sequence:  Hypothetical Probe Sequence
tgcgtgtcgcttatacagccagcc

SEQ ID NO: 2613 - DNA, 24 bp, Artificial Sequence
  Description of Artificial Sequence:  Hypothetical Probe Sequence
tgcgtgtcgagttcccagccaatc

SEQ ID NO: 2614 - DNA, 24 bp, Artificial Sequence
  Description of Artificial Sequence:  Hypothetical Probe Sequence
tgcgtgtcacctatcgatcgccta

SEQ ID NO: 2615 - DNA, 24 bp, Artificial Sequence
  Description of Artificial Sequence:  Hypothetical Probe Sequence
tgcgtgtcaggaggtatcccggta

SEQ ID NO: 2616 - DNA, 24 bp, Artificial Sequence
  Description of Artificial Sequence:  Hypothetical Probe Sequence
tgcgtgtcgatggaccctgtgacc

SEQ ID NO: 2617 - DNA, 24 bp, Artificial Sequence
  Description of Artificial Sequence:  Hypothetical Probe Sequence
tgcgtgtctccccgaatcgtccat

SEQ ID NO: 2618 - DNA, 24 bp, Artificial Sequence
  Description of Artificial Sequence:  Hypothetical Probe Sequence
tgcgtgtcgacctcgtcgttctca

SEQ ID NO: 2619 - DNA, 24 bp, Artificial Sequence
  Description of Artificial Sequence:  Hypothetical Probe Sequence
tgcgtcgtctcaaccttcgtgctt

SEQ ID NO: 2620 - DNA, 24 bp, Artificial Sequence
  Description of Artificial Sequence:  Hypothetical Probe Sequence
tgcgtcgtctgtttaggtcttgcg

SEQ ID NO: 2621 - DNA, 24 bp, Artificial Sequence
  Description of Artificial Sequence:  Hypothetical Probe Sequence
tgcgtcgtgtctagtgagcccacg

SEQ ID NO: 2622 - DNA, 24 bp, Artificial Sequence
  Description of Artificial Sequence:  Hypothetical Probe Sequence
tgcgtcgtcctatgcgaggaaatc

SEQ ID NO: 2623 - DNA, 24 bp, Artificial Sequence
  Description of Artificial Sequence:  Hypothetical Probe Sequence
tgcgtcgtgatgcgttctgtgcaa

SEQ ID NO: 2624 - DNA, 24 bp, Artificial Sequence
  Description of Artificial Sequence:  Hypothetical Probe Sequence
tgcgtcgttccccctattagcacg

SEQ ID NO: 2625 - DNA, 24 bp, Artificial Sequence
  Description of Artificial Sequence:  Hypothetical Probe Sequence
tgcgtcgttgcgggactcgtatcg

SEQ ID NO: 2626 - DNA, 24 bp, Artificial Sequence
  Description of Artificial Sequence:  Hypothetical Probe Sequence
tgcgtcgtcacgcacgctgttgat

SEQ ID NO: 2627 - DNA, 24 bp, Artificial Sequence
  Description of Artificial Sequence:  Hypothetical Probe Sequence
tgcgtcgtgacccctagacccttg

SEQ ID NO: 2628 - DNA, 24 bp, Artificial Sequence
  Description of Artificial Sequence:  Hypothetical Probe Sequence
tgcgtcgtggactcgtcacgttga

SEQ ID NO: 2629 - DNA, 24 bp, Artificial Sequence
  Description of Artificial Sequence:  Hypothetical Probe Sequence
tgcgcttgttagagccttgaatcg

SEQ ID NO: 2630 - DNA, 24 bp, Artificial Sequence
  Description of Artificial Sequence:  Hypothetical Probe Sequence
tgcgcttgtacaataccagcgtgc

SEQ ID NO: 2631 - DNA, 24 bp, Artificial Sequence
  Description of Artificial Sequence:  Hypothetical Probe Sequence
tgcgcttgtctgcgaacgttagga

SEQ ID NO: 2632 - DNA, 24 bp, Artificial Sequence
  Description of Artificial Sequence:  Hypothetical Probe Sequence
tgcgcttgcgtttcgttgatgacc

SEQ ID NO: 2633 - DNA, 24 bp, Artificial Sequence
  Description of Artificial Sequence:  Hypothetical Probe Sequence
tgcgcttgctcaataccgaaacct

SEQ ID NO: 2634 - DNA, 24 bp, Artificial Sequence
  Description of Artificial Sequence:  Hypothetical Probe Sequence
tgcgcttgctgtcgaaccattctg

SEQ ID NO: 2635 - DNA, 24 bp, Artificial Sequence
  Description of Artificial Sequence:  Hypothetical Probe Sequence
tgcgcttggagtatcgaatcccat

SEQ ID NO: 2636 - DNA, 24 bp, Artificial Sequence
  Description of Artificial Sequence:  Hypothetical Probe Sequence
tgcgcttgagtgaatccttgccat

SEQ ID NO: 2637 - DNA, 24 bp, Artificial Sequence
  Description of Artificial Sequence:  Hypothetical Probe Sequence
tgcgcttgatcgatcgagtgcttg

SEQ ID NO: 2638 - DNA, 24 bp, Artificial Sequence
  Description of Artificial Sequence:  Hypothetical Probe Sequence
tgcgcttggatgacgggagttaca

SEQ ID NO: 2639 - DNA, 24 bp, Artificial Sequence
  Description of Artificial Sequence:  Hypothetical Probe Sequence
tgcgcttgcagccacggagtcttg

SEQ ID NO: 2640 - DNA, 24 bp, Artificial Sequence
  Description of Artificial Sequence:  Hypothetical Probe Sequence
tgcgcttggtgcacctcgtttcgt

SEQ ID NO: 2641 - DNA, 24 bp, Artificial Sequence
  Description of Artificial Sequence:  Hypothetical Probe Sequence
tgcgcttgagccgaccacctatcg

SEQ ID NO: 2642 - DNA, 24 bp, Artificial Sequence
  Description of Artificial Sequence:  Hypothetical Probe Sequence
tgcgcgttaatccctaccatcgaa

SEQ ID NO: 2643 - DNA, 24 bp, Artificial Sequence
  Description of Artificial Sequence:  Hypothetical Probe Sequence
tgcgcgttatactctgagccgatg

SEQ ID NO: 2644 - DNA, 24 bp, Artificial Sequence
  Description of Artificial Sequence:  Hypothetical Probe Sequence
tgcgcgttaaagaatcgcaaaaag

SEQ ID NO: 2645 - DNA, 24 bp, Artificial Sequence
  Description of Artificial Sequence:  Hypothetical Probe Sequence
tgcgcgtttctgcttgatcgtcgt

SEQ ID NO: 2646 - DNA, 24 bp, Artificial Sequence
  Description of Artificial Sequence:  Hypothetical Probe Sequence
tgcgcgtttcgtcgaacgaagtct

SEQ ID NO: 2647 - DNA, 24 bp, Artificial Sequence
  Description of Artificial Sequence:  Hypothetical Probe Sequence
tgcgcgttcgttagtgcttgctca

SEQ ID NO: 2648 - DNA, 24 bp, Artificial Sequence
  Description of Artificial Sequence:  Hypothetical Probe Sequence
tgcgcgttggtaccatttagcgaa

SEQ ID NO: 2649 - DNA, 24 bp, Artificial Sequence
  Description of Artificial Sequence:  Hypothetical Probe Sequence
tgcgcgttgtctggtagacccttg

SEQ ID NO: 2650 - DNA, 24 bp, Artificial Sequence
  Description of Artificial Sequence:  Hypothetical Probe Sequence
tgcgcgttatcgttgattgaacgg

SEQ ID NO: 2651 - DNA, 24 bp, Artificial Sequence
  Description of Artificial Sequence:  Hypothetical Probe Sequence
tgcgcgttgatgtcccttgaagtg

SEQ ID NO: 2652 - DNA, 24 bp, Artificial Sequence
  Description of Artificial Sequence:  Hypothetical Probe Sequence
tgcgcgtttcccgcttacctggac

SEQ ID NO: 2653 - DNA, 24 bp, Artificial Sequence
  Description of Artificial Sequence:  Hypothetical Probe Sequence
tgcgcgttcacggagtcacgccta

SEQ ID NO: 2654 - DNA, 24 bp, Artificial Sequence
  Description of Artificial Sequence:  Hypothetical Probe Sequence
tgcgcgttcagcttagagcctccc

SEQ ID NO: 2655 - DNA, 24 bp, Artificial Sequence
  Description of Artificial Sequence:  Hypothetical Probe Sequence
tgcgcgttgacctcccatacgagt

SEQ ID NO: 2656 - DNA, 24 bp, Artificial Sequence
  Description of Artificial Sequence:  Hypothetical Probe Sequence
tgcgcgttacggggtagatggtgc

SEQ ID NO: 2657 - DNA, 24 bp, Artificial Sequence
  Description of Artificial Sequence:  Hypothetical Probe Sequence
tgcgctcatgataatcagccggac

SEQ ID NO: 2658 - DNA, 24 bp, Artificial Sequence
  Description of Artificial Sequence:  Hypothetical Probe Sequence
tgcgctcattagcacgcacggagt

SEQ ID NO: 2659 - DNA, 24 bp, Artificial Sequence
  Description of Artificial Sequence:  Hypothetical Probe Sequence
tgcgctcaaaagctcaatcgtccc

SEQ ID NO: 2660 - DNA, 24 bp, Artificial Sequence
  Description of Artificial Sequence:  Hypothetical Probe Sequence
tgcgctcatacatgcgggtatgat

SEQ ID NO: 2661 - DNA, 24 bp, Artificial Sequence
  Description of Artificial Sequence:  Hypothetical Probe Sequence
tgcgctcatctgatcgtgtccgtt

SEQ ID NO: 2662 - DNA, 24 bp, Artificial Sequence
  Description of Artificial Sequence:  Hypothetical Probe Sequence
tgcgctcacgttatcgcttgagga

SEQ ID NO: 2663 - DNA, 24 bp, Artificial Sequence
  Description of Artificial Sequence:  Hypothetical Probe Sequence
tgcgctcactgttcccgtctgatg

SEQ ID NO: 2664 - DNA, 24 bp, Artificial Sequence
  Description of Artificial Sequence:  Hypothetical Probe Sequence
tgcgctcagcaaagtgctcagcaa

SEQ ID NO: 2665 - DNA, 24 bp, Artificial Sequence
  Description of Artificial Sequence:  Hypothetical Probe Sequence
tgcgctcacctacgaaaaagggac

SEQ ID NO: 2666 - DNA, 24 bp, Artificial Sequence
  Description of Artificial Sequence:  Hypothetical Probe Sequence
tgcgctcagatggtgcgagtggac

SEQ ID NO: 2667 - DNA, 24 bp, Artificial Sequence
  Description of Artificial Sequence:  Hypothetical Probe Sequence
tgcgctgttgataaagtgcggacc

SEQ ID NO: 2668 - DNA, 24 bp, Artificial Sequence
  Description of Artificial Sequence:  Hypothetical Probe Sequence
tgcgctgtaatcgcttgtcttgcg

SEQ ID NO: 2669 - DNA, 24 bp, Artificial Sequence
  Description of Artificial Sequence:  Hypothetical Probe Sequence
tgcgctgtatacgaccacggtccc

SEQ ID NO: 2670 - DNA, 24 bp, Artificial Sequence
  Description of Artificial Sequence:  Hypothetical Probe Sequence
tgcgctgttacacctaacggagga

SEQ ID NO: 2671 - DNA, 24 bp, Artificial Sequence
  Description of Artificial Sequence:  Hypothetical Probe Sequence
tgcgctgttctgtgatagccgtgc

SEQ ID NO: 2672 - DNA, 24 bp, Artificial Sequence
  Description of Artificial Sequence:  Hypothetical Probe Sequence
tgcgctgttgtcaatcgcaagacc

SEQ ID NO: 2673 - DNA, 24 bp, Artificial Sequence
  Description of Artificial Sequence:  Hypothetical Probe Sequence
tgcgctgtcttggaccagtgccat

SEQ ID NO: 2674 - DNA, 24 bp, Artificial Sequence
  Description of Artificial Sequence:  Hypothetical Probe Sequence
tgcgctgtctcaccattctgcgtt

SEQ ID NO: 2675 - DNA, 24 bp, Artificial Sequence
  Description of Artificial Sequence:  Hypothetical Probe Sequence
tgcgctgtctgttctgcgaaatcg

SEQ ID NO: 2676 - DNA, 24 bp, Artificial Sequence
  Description of Artificial Sequence:  Hypothetical Probe Sequence
tgcgctgtccatcctaaaagcgtt

SEQ ID NO: 2677 - DNA, 24 bp, Artificial Sequence
  Description of Artificial Sequence:  Hypothetical Probe Sequence
tgcgctgtcgaaaatcccatccta

SEQ ID NO: 2678 - DNA, 24 bp, Artificial Sequence
  Description of Artificial Sequence:  Hypothetical Probe Sequence
tgcgctgtggtagagttcccggac

SEQ ID NO: 2679 - DNA, 24 bp, Artificial Sequence
  Description of Artificial Sequence:  Hypothetical Probe Sequence
tgcgctgtagtgggaccgttgctt

SEQ ID NO: 2680 - DNA, 24 bp, Artificial Sequence
  Description of Artificial Sequence:  Hypothetical Probe Sequence
tgcgctgtcagcttagctcatgcg

SEQ ID NO: 2681 - DNA, 24 bp, Artificial Sequence
  Description of Artificial Sequence:  Hypothetical Probe Sequence
tgcgctgtgaccggacccatacct

SEQ ID NO: 2682 - DNA, 24 bp, Artificial Sequence
  Description of Artificial Sequence:  Hypothetical Probe Sequence
tgcgctgtacgggtgctctgctca

SEQ ID NO: 2683 - DNA, 24 bp, Artificial Sequence
  Description of Artificial Sequence:  Hypothetical Probe Sequence
tgcgctgtagccgagtcttgcgtt

SEQ ID NO: 2684 - DNA, 24 bp, Artificial Sequence
  Description of Artificial Sequence:  Hypothetical Probe Sequence
tgcgccatttgaacctatcggctt

SEQ ID NO: 2685 - DNA, 24 bp, Artificial Sequence
  Description of Artificial Sequence:  Hypothetical Probe Sequence
tgcgccatttaggagtcgttgctt

SEQ ID NO: 2686 - DNA, 24 bp, Artificial Sequence
  Description of Artificial Sequence:  Hypothetical Probe Sequence
tgcgccataatctctgtgcgctca

SEQ ID NO: 2687 - DNA, 24 bp, Artificial Sequence
  Description of Artificial Sequence:  Hypothetical Probe Sequence
tgcgccatcgaagtctttgaacgg

SEQ ID NO: 2688 - DNA, 24 bp, Artificial Sequence
  Description of Artificial Sequence:  Hypothetical Probe Sequence
tgcgccatgtctgatggaccctca

SEQ ID NO: 2689 - DNA, 24 bp, Artificial Sequence
  Description of Artificial Sequence:  Hypothetical Probe Sequence
tgcgccatatcggtctcagcgctt

SEQ ID NO: 2690 - DNA, 24 bp, Artificial Sequence
  Description of Artificial Sequence:  Hypothetical Probe Sequence
tgcgccattccctcgttacatccc

SEQ ID NO: 2691 - DNA, 24 bp, Artificial Sequence
  Description of Artificial Sequence:  Hypothetical Probe Sequence
tgcgccatgacctgatcttgacgg

SEQ ID NO: 2692 - DNA, 24 bp, Artificial Sequence
  Description of Artificial Sequence:  Hypothetical Probe Sequence
tgcgccatggacccatcgaagatg

SEQ ID NO: 2693 - DNA, 24 bp, Artificial Sequence
  Description of Artificial Sequence:  Hypothetical Probe Sequence
tgcgccatacggctgtctcatgcg

SEQ ID NO: 2694 - DNA, 24 bp, Artificial Sequence
  Description of Artificial Sequence:  Hypothetical Probe Sequence
tgcgcgaatgatcgttcttgggac

SEQ ID NO: 2695 - DNA, 24 bp, Artificial Sequence
  Description of Artificial Sequence:  Hypothetical Probe Sequence
tgcgcgaaaatcaaagcagctgtc

SEQ ID NO: 2696 - DNA, 24 bp, Artificial Sequence
  Description of Artificial Sequence:  Hypothetical Probe Sequence
tgcgcgaactcagaccaggacacg

SEQ ID NO: 2697 - DNA, 24 bp, Artificial Sequence
  Description of Artificial Sequence:  Hypothetical Probe Sequence
tgcgcgaaccatctgttgtccgaa

SEQ ID NO: 2698 - DNA, 24 bp, Artificial Sequence
  Description of Artificial Sequence:  Hypothetical Probe Sequence
tgcgcgaacgaaagccaaagaatc

SEQ ID NO: 2699 - DNA, 24 bp, Artificial Sequence
  Description of Artificial Sequence:  Hypothetical Probe Sequence
tgcgcgaagcaactcaccatcgaa

SEQ ID NO: 2700 - DNA, 24 bp, Artificial Sequence
  Description of Artificial Sequence:  Hypothetical Probe Sequence
tgcgcgaaatcgtgatccatcagc

SEQ ID NO: 2701 - DNA, 24 bp, Artificial Sequence
  Description of Artificial Sequence:  Hypothetical Probe Sequence
tgcgcgaaaggagatggtgcccta

SEQ ID NO: 2702 - DNA, 24 bp, Artificial Sequence
  Description of Artificial Sequence:  Hypothetical Probe Sequence
tgcgcgaatccccctacagccttg

SEQ ID NO: 2703 - DNA, 24 bp, Artificial Sequence
  Description of Artificial Sequence:  Hypothetical Probe Sequence
tgcggcttatacaatcgcttgcaa

SEQ ID NO: 2704 - DNA, 24 bp, Artificial Sequence
  Description of Artificial Sequence:  Hypothetical Probe Sequence
tgcggctttctgcagctcgtgacc

SEQ ID NO: 2705 - DNA, 24 bp, Artificial Sequence
  Description of Artificial Sequence:  Hypothetical Probe Sequence
tgcggcttcttgctgtgaccgatg

SEQ ID NO: 2706 - DNA, 24 bp, Artificial Sequence
  Description of Artificial Sequence:  Hypothetical Probe Sequence
tgcggcttctcaagtgagtgcgaa

SEQ ID NO: 2707 - DNA, 24 bp, Artificial Sequence
  Description of Artificial Sequence:  Hypothetical Probe Sequence
tgcggcttcgaattgatctgacgg

SEQ ID NO: 2708 - DNA, 24 bp, Artificial Sequence
  Description of Artificial Sequence:  Hypothetical Probe Sequence
tgcggcttgcaatctgaaagagcc

SEQ ID NO: 2709 - DNA, 24 bp, Artificial Sequence
  Description of Artificial Sequence:  Hypothetical Probe Sequence
tgcggctttccccagccctagagt

SEQ ID NO: 2710 - DNA, 24 bp, Artificial Sequence
  Description of Artificial Sequence:  Hypothetical Probe Sequence
tgcggcttcacgggaccgaactca

SEQ ID NO: 2711 - DNA, 24 bp, Artificial Sequence
  Description of Artificial Sequence:  Hypothetical Probe Sequence
tgcggcttagccgacccgaattag

SEQ ID NO: 2712 - DNA, 24 bp, Artificial Sequence
  Description of Artificial Sequence:  Hypothetical Probe Sequence
tgcgggtaaaagaggaggaccgtt

SEQ ID NO: 2713 - DNA, 24 bp, Artificial Sequence
  Description of Artificial Sequence:  Hypothetical Probe Sequence
tgcgggtatacaccatacggatcg

SEQ ID NO: 2714 - DNA, 24 bp, Artificial Sequence
  Description of Artificial Sequence:  Hypothetical Probe Sequence
tgcgggtatgtccacgaaagcacg

SEQ ID NO: 2715 - DNA, 24 bp, Artificial Sequence
  Description of Artificial Sequence:  Hypothetical Probe Sequence
tgcgggtacgttcagccttggtct

SEQ ID NO: 2716 - DNA, 24 bp, Artificial Sequence
  Description of Artificial Sequence:  Hypothetical Probe Sequence
tgcgggtactcagcaacgtttcgt

SEQ ID NO: 2717 - DNA, 24 bp, Artificial Sequence
  Description of Artificial Sequence:  Hypothetical Probe Sequence
tgcgggtactgtgcaacttgtccc

SEQ ID NO: 2718 - DNA, 24 bp, Artificial Sequence
  Description of Artificial Sequence:  Hypothetical Probe Sequence
tgcgggtagcttagccgagtagga

SEQ ID NO: 2719 - DNA, 24 bp, Artificial Sequence
  Description of Artificial Sequence:  Hypothetical Probe Sequence
tgcgggtagagtggaccttgccta

SEQ ID NO: 2720 - DNA, 24 bp, Artificial Sequence
  Description of Artificial Sequence:  Hypothetical Probe Sequence
tgcgggtacctagacccagctctg

SEQ ID NO: 2721 - DNA, 24 bp, Artificial Sequence
  Description of Artificial Sequence:  Hypothetical Probe Sequence
tgcgggtacacgtgtcacggagtg

SEQ ID NO: 2722 - DNA, 24 bp, Artificial Sequence
  Description of Artificial Sequence:  Hypothetical Probe Sequence
tgcgggtagtgctgtctgtcgctt

SEQ ID NO: 2723 - DNA, 24 bp, Artificial Sequence
  Description of Artificial Sequence:  Hypothetical Probe Sequence
tgcgggtaggaccctagagttgcg

SEQ ID NO: 2724 - DNA, 24 bp, Artificial Sequence
  Description of Artificial Sequence:  Hypothetical Probe Sequence
tgcgggtaagccgtctgcaacacg

SEQ ID NO: 2725 - DNA, 24 bp, Artificial Sequence
  Description of Artificial Sequence:  Hypothetical Probe Sequence
tgcggtcttgatcgaatcgtacgg

SEQ ID NO: 2726 - DNA, 24 bp, Artificial Sequence
  Description of Artificial Sequence:  Hypothetical Probe Sequence
tgcggtctttagctgttcgttgcg

SEQ ID NO: 2727 - DNA, 24 bp, Artificial Sequence
  Description of Artificial Sequence:  Hypothetical Probe Sequence
tgcggtctaaaggatgcagcgctt

SEQ ID NO: 2728 - DNA, 24 bp, Artificial Sequence
  Description of Artificial Sequence:  Hypothetical Probe Sequence
tgcggtcttctgtcccttagtgcg

SEQ ID NO: 2729 - DNA, 24 bp, Artificial Sequence
  Description of Artificial Sequence:  Hypothetical Probe Sequence
tgcggtcttgtccagccgttaaag

SEQ ID NO: 2730 - DNA, 24 bp, Artificial Sequence
  Description of Artificial Sequence:  Hypothetical Probe Sequence
tgcggtctcttgggtatccccagc

SEQ ID NO: 2731 - DNA, 24 bp, Artificial Sequence
  Description of Artificial Sequence:  Hypothetical Probe Sequence
tgcggtctctgtttgaatcgacgg

SEQ ID NO: 2732 - DNA, 24 bp, Artificial Sequence
  Description of Artificial Sequence:  Hypothetical Probe Sequence
tgcggtctcgaaaggagcaaagga

SEQ ID NO: 2733 - DNA, 24 bp, Artificial Sequence
  Description of Artificial Sequence:  Hypothetical Probe Sequence
tgcggtctggtatcccgaccccat

SEQ ID NO: 2734 - DNA, 24 bp, Artificial Sequence
  Description of Artificial Sequence:  Hypothetical Probe Sequence
tgcggtctgagtagtgtgcgtccc

SEQ ID NO: 2735 - DNA, 24 bp, Artificial Sequence
  Description of Artificial Sequence:  Hypothetical Probe Sequence
tgcggtctacctgcaaaaaggcaa

SEQ ID NO: 2736 - DNA, 24 bp, Artificial Sequence
  Description of Artificial Sequence:  Hypothetical Probe Sequence
tgcggtctatcggaccgatgccta

SEQ ID NO: 2737 - DNA, 24 bp, Artificial Sequence
  Description of Artificial Sequence:  Hypothetical Probe Sequence
tgcggtctaggaaaaggacccgaa

SEQ ID NO: 2738 - DNA, 24 bp, Artificial Sequence
  Description of Artificial Sequence:  Hypothetical Probe Sequence
tgcggtctgatgaaagcttgtgcg

SEQ ID NO: 2739 - DNA, 24 bp, Artificial Sequence
  Description of Artificial Sequence:  Hypothetical Probe Sequence
tgcggtctcagccgaacttgagga

SEQ ID NO: 2740 - DNA, 24 bp, Artificial Sequence
  Description of Artificial Sequence:  Hypothetical Probe Sequence
tgcggagttgatagccttagcacg

SEQ ID NO: 2741 - DNA, 24 bp, Artificial Sequence
  Description of Artificial Sequence:  Hypothetical Probe Sequence
tgcggagtatacgtgcggtaacgg

SEQ ID NO: 2742 - DNA, 24 bp, Artificial Sequence
  Description of Artificial Sequence:  Hypothetical Probe Sequence
tgcggagttctgatacgcaacacg

SEQ ID NO: 2743 - DNA, 24 bp, Artificial Sequence
  Description of Artificial Sequence:  Hypothetical Probe Sequence
tgcggagttcgttctggaccccta

SEQ ID NO: 2744 - DNA, 24 bp, Artificial Sequence
  Description of Artificial Sequence:  Hypothetical Probe Sequence
tgcggagtgcaagacccgaataca

SEQ ID NO: 2745 - DNA, 24 bp, Artificial Sequence
  Description of Artificial Sequence:  Hypothetical Probe Sequence
tgcggagttccctgtcgatgtcgt

SEQ ID NO: 2746 - DNA, 24 bp, Artificial Sequence
  Description of Artificial Sequence:  Hypothetical Probe Sequence
tgcggagtgtgcgtgcaccttctg

SEQ ID NO: 2747 - DNA, 24 bp, Artificial Sequence
  Description of Artificial Sequence:  Hypothetical Probe Sequence
tgcggagtggaccgttgagttccc

SEQ ID NO: 2748 - DNA, 24 bp, Artificial Sequence
  Description of Artificial Sequence:  Hypothetical Probe Sequence
tgcggcaattgagatgcgtttgat

SEQ ID NO: 2749 - DNA, 24 bp, Artificial Sequence
  Description of Artificial Sequence:  Hypothetical Probe Sequence
tgcggcaattagcgttacctgctt

SEQ ID NO: 2750 - DNA, 24 bp, Artificial Sequence
  Description of Artificial Sequence:  Hypothetical Probe Sequence
tgcggcaaaatcttagcagcggta

SEQ ID NO: 2751 - DNA, 24 bp, Artificial Sequence
  Description of Artificial Sequence:  Hypothetical Probe Sequence
tgcggcaaaaagttagggaccagc

SEQ ID NO: 2752 - DNA, 24 bp, Artificial Sequence
  Description of Artificial Sequence:  Hypothetical Probe Sequence
tgcggcaatctgataccttgacgg

SEQ ID NO: 2753 - DNA, 24 bp, Artificial Sequence
  Description of Artificial Sequence:  Hypothetical Probe Sequence
tgcggcaacgaatgattccctctg

SEQ ID NO: 2754 - DNA, 24 bp, Artificial Sequence
  Description of Artificial Sequence:  Hypothetical Probe Sequence
tgcggcaagcttaaaggagtgctt

SEQ ID NO: 2755 - DNA, 24 bp, Artificial Sequence
  Description of Artificial Sequence:  Hypothetical Probe Sequence
tgcggcaagtctgacccacgctca

SEQ ID NO: 2756 - DNA, 24 bp, Artificial Sequence
  Description of Artificial Sequence:  Hypothetical Probe Sequence
tgcggcaagagtatcgatcggtct

SEQ ID NO: 2757 - DNA, 24 bp, Artificial Sequence
  Description of Artificial Sequence:  Hypothetical Probe Sequence
tgcggcaagatgaggaaaaggtgc

SEQ ID NO: 2758 - DNA, 24 bp, Artificial Sequence
  Description of Artificial Sequence:  Hypothetical Probe Sequence
tgcggcaatcccgcttataccgaa

SEQ ID NO: 2759 - DNA, 24 bp, Artificial Sequence
  Description of Artificial Sequence:  Hypothetical Probe Sequence
tgcggcaacagcaaagacctcgtt

SEQ ID NO: 2760 - DNA, 24 bp, Artificial Sequence
  Description of Artificial Sequence:  Hypothetical Probe Sequence
tgcggcaagacccctaacctggac

SEQ ID NO: 2761 - DNA, 24 bp, Artificial Sequence
  Description of Artificial Sequence:  Hypothetical Probe Sequence
tgcggcaagtgcaaagcgaaggta

SEQ ID NO: 2762 - DNA, 24 bp, Artificial Sequence
  Description of Artificial Sequence:  Hypothetical Probe Sequence
tgcgagtgtctgagcccagcgcaa

SEQ ID NO: 2763 - DNA, 24 bp, Artificial Sequence
  Description of Artificial Sequence:  Hypothetical Probe Sequence
tgcgagtgtcgttgcgaggattga

SEQ ID NO: 2764 - DNA, 24 bp, Artificial Sequence
  Description of Artificial Sequence:  Hypothetical Probe Sequence
tgcgagtgcttgcagcatacagcc

SEQ ID NO: 2765 - DNA, 24 bp, Artificial Sequence
  Description of Artificial Sequence:  Hypothetical Probe Sequence
tgcgagtggcttccattgatagcc

SEQ ID NO: 2766 - DNA, 24 bp, Artificial Sequence
  Description of Artificial Sequence:  Hypothetical Probe Sequence
tgcgagtgggtacttgtccccgtt

SEQ ID NO: 2767 - DNA, 24 bp, Artificial Sequence
  Description of Artificial Sequence:  Hypothetical Probe Sequence
tgcgagtgacctcgaatcccgcaa

SEQ ID NO: 2768 - DNA, 24 bp, Artificial Sequence
  Description of Artificial Sequence:  Hypothetical Probe Sequence
tgcgagtgaggagatgcgttccat

SEQ ID NO: 2769 - DNA, 24 bp, Artificial Sequence
  Description of Artificial Sequence:  Hypothetical Probe Sequence
tgcgagtgtgcggtgccttgagtg

SEQ ID NO: 2770 - DNA, 24 bp, Artificial Sequence
  Description of Artificial Sequence:  Hypothetical Probe Sequence
tgcgagtgcagcacctagtgtgcg

SEQ ID NO: 2771 - DNA, 24 bp, Artificial Sequence
  Description of Artificial Sequence:  Hypothetical Probe Sequence
tgcgaccttgatcagcgtgcaaag

SEQ ID NO: 2772 - DNA, 24 bp, Artificial Sequence
  Description of Artificial Sequence:  Hypothetical Probe Sequence
tgcgacctaaaggtgctgcgtcgt

SEQ ID NO: 2773 - DNA, 24 bp, Artificial Sequence
  Description of Artificial Sequence:  Hypothetical Probe Sequence
tgcgaccttacaggacaggaacgg

SEQ ID NO: 2774 - DNA, 24 bp, Artificial Sequence
  Description of Artificial Sequence:  Hypothetical Probe Sequence
tgcgaccttcgtgtctgacctgcg

SEQ ID NO: 2775 - DNA, 24 bp, Artificial Sequence
  Description of Artificial Sequence:  Hypothetical Probe Sequence
tgcgacctcttgcgtttcccctgt

SEQ ID NO: 2776 - DNA, 24 bp, Artificial Sequence
  Description of Artificial Sequence:  Hypothetical Probe Sequence
tgcgacctctcattaggaccagcc

SEQ ID NO: 2777 - DNA, 24 bp, Artificial Sequence
  Description of Artificial Sequence:  Hypothetical Probe Sequence
tgcgacctctgtcagcccatgtgc

SEQ ID NO: 2778 - DNA, 24 bp, Artificial Sequence
  Description of Artificial Sequence:  Hypothetical Probe Sequence
tgcgacctccatgcaacttggtct

SEQ ID NO: 2779 - DNA, 24 bp, Artificial Sequence
  Description of Artificial Sequence:  Hypothetical Probe Sequence
tgcgacctcgaagcttaaagcgaa

SEQ ID NO: 2780 - DNA, 24 bp, Artificial Sequence
  Description of Artificial Sequence:  Hypothetical Probe Sequence
tgcgacctggtaaaagcttgtccc

SEQ ID NO: 2781 - DNA, 24 bp, Artificial Sequence
  Description of Artificial Sequence:  Hypothetical Probe Sequence
tgcgacctagtgaccttgcgacct

SEQ ID NO: 2782 - DNA, 24 bp, Artificial Sequence
  Description of Artificial Sequence:  Hypothetical Probe Sequence
tgcgacctacctcctaacggggta

SEQ ID NO: 2783 - DNA, 24 bp, Artificial Sequence
  Description of Artificial Sequence:  Hypothetical Probe Sequence
tgcgacctatcgcagcatacacgg

SEQ ID NO: 2784 - DNA, 24 bp, Artificial Sequence
  Description of Artificial Sequence:  Hypothetical Probe Sequence
tgcgaccttccccgaacacgaatc

SEQ ID NO: 2785 - DNA, 24 bp, Artificial Sequence
  Description of Artificial Sequence:  Hypothetical Probe Sequence
tgcgaccttgcggtgcaggattga

SEQ ID NO: 2786 - DNA, 24 bp, Artificial Sequence
  Description of Artificial Sequence:  Hypothetical Probe Sequence
tgcgacctcacgttgacacggacc

SEQ ID NO: 2787 - DNA, 24 bp, Artificial Sequence
  Description of Artificial Sequence:  Hypothetical Probe Sequence
tgcgacctggaccgttcgaaccta

SEQ ID NO: 2788 - DNA, 24 bp, Artificial Sequence
  Description of Artificial Sequence:  Hypothetical Probe Sequence
tgcgatcgttgatccccagcttag

SEQ ID NO: 2789 - DNA, 24 bp, Artificial Sequence
  Description of Artificial Sequence:  Hypothetical Probe Sequence
tgcgatcgtgataatcgatgccat

SEQ ID NO: 2790 - DNA, 24 bp, Artificial Sequence
  Description of Artificial Sequence:  Hypothetical Probe Sequence
tgcgatcgtgtcgcttcacgagga

SEQ ID NO: 2791 - DNA, 24 bp, Artificial Sequence
  Description of Artificial Sequence:  Hypothetical Probe Sequence
tgcgatcgcttgtcgtggacagtg

SEQ ID NO: 2792 - DNA, 24 bp, Artificial Sequence
  Description of Artificial Sequence:  Hypothetical Probe Sequence
tgcgatcgccatggtacacgctgt

SEQ ID NO: 2793 - DNA, 24 bp, Artificial Sequence
  Description of Artificial Sequence:  Hypothetical Probe Sequence
tgcgatcgggtaaatccttgctca

SEQ ID NO: 2794 - DNA, 24 bp, Artificial Sequence
  Description of Artificial Sequence:  Hypothetical Probe Sequence
tgcgatcgagtggcaaccatccat

SEQ ID NO: 2795 - DNA, 24 bp, Artificial Sequence
  Description of Artificial Sequence:  Hypothetical Probe Sequence
tgcgatcgatcgtgtccttggtgc

SEQ ID NO: 2796 - DNA, 24 bp, Artificial Sequence
  Description of Artificial Sequence:  Hypothetical Probe Sequence
tgcgatcgcctacctacgaaccat

SEQ ID NO: 2797 - DNA, 24 bp, Artificial Sequence
  Description of Artificial Sequence:  Hypothetical Probe Sequence
tgcgatcgtcccgtctccatacgg

SEQ ID NO: 2798 - DNA, 24 bp, Artificial Sequence
  Description of Artificial Sequence:  Hypothetical Probe Sequence
tgcgatcgcagcaaagtgtcagcc

SEQ ID NO: 2799 - DNA, 24 bp, Artificial Sequence
  Description of Artificial Sequence:  Hypothetical Probe Sequence
tgcgatcgacggacctgcaaagtg

SEQ ID NO: 2800 - DNA, 24 bp, Artificial Sequence
  Description of Artificial Sequence:  Hypothetical Probe Sequence
tgcgatcgagccatacagccgtct

SEQ ID NO: 2801 - DNA, 24 bp, Artificial Sequence
  Description of Artificial Sequence:  Hypothetical Probe Sequence
tgcgaggattagcacgatcgccat

SEQ ID NO: 2802 - DNA, 24 bp, Artificial Sequence
  Description of Artificial Sequence:  Hypothetical Probe Sequence
tgcgaggatgtctccctcccaatc

SEQ ID NO: 2803 - DNA, 24 bp, Artificial Sequence
  Description of Artificial Sequence:  Hypothetical Probe Sequence
tgcgaggacttgcacgtacatgcg

SEQ ID NO: 2804 - DNA, 24 bp, Artificial Sequence
  Description of Artificial Sequence:  Hypothetical Probe Sequence
tgcgaggactgtagccccatcacg

SEQ ID NO: 2805 - DNA, 24 bp, Artificial Sequence
  Description of Artificial Sequence:  Hypothetical Probe Sequence
tgcgaggagcaaaaaggaccacct

SEQ ID NO: 2806 - DNA, 24 bp, Artificial Sequence
  Description of Artificial Sequence:  Hypothetical Probe Sequence
tgcgaggaagtgagtgggaccacg

SEQ ID NO: 2807 - DNA, 24 bp, Artificial Sequence
  Description of Artificial Sequence:  Hypothetical Probe Sequence
tgcgaggaaggatgcgttagagga

SEQ ID NO: 2808 - DNA, 24 bp, Artificial Sequence
  Description of Artificial Sequence:  Hypothetical Probe Sequence
tgcgaggacagccgttcagcttga

SEQ ID NO: 2809 - DNA, 24 bp, Artificial Sequence
  Description of Artificial Sequence:  Hypothetical Probe Sequence
tgcgaggaacgggagtcacgcttg

SEQ ID NO: 2810 - DNA, 24 bp, Artificial Sequence
  Description of Artificial Sequence:  Hypothetical Probe Sequence
tgcgcctattgacgaatgtcgctt

SEQ ID NO: 2811 - DNA, 24 bp, Artificial Sequence
  Description of Artificial Sequence:  Hypothetical Probe Sequence
tgcgcctatacaagccggaccttg

SEQ ID NO: 2812 - DNA, 24 bp, Artificial Sequence
  Description of Artificial Sequence:  Hypothetical Probe Sequence
tgcgcctatgtcaggaagccaatc

SEQ ID NO: 2813 - DNA, 24 bp, Artificial Sequence
  Description of Artificial Sequence:  Hypothetical Probe Sequence
tgcgcctacttgtgcgttgaaatc

SEQ ID NO: 2814 - DNA, 24 bp, Artificial Sequence
  Description of Artificial Sequence:  Hypothetical Probe Sequence
tgcgcctacgaaataccagcacct

SEQ ID NO: 2815 - DNA, 24 bp, Artificial Sequence
  Description of Artificial Sequence:  Hypothetical Probe Sequence
tgcgcctaggtaaatccgttagcc

SEQ ID NO: 2816 - DNA, 24 bp, Artificial Sequence
  Description of Artificial Sequence:  Hypothetical Probe Sequence
tgcgcctagtctcacgcagctaca

SEQ ID NO: 2817 - DNA, 24 bp, Artificial Sequence
  Description of Artificial Sequence:  Hypothetical Probe Sequence
tgcgcctatcccgcaatgtcgagt

SEQ ID NO: 2818 - DNA, 24 bp, Artificial Sequence
  Description of Artificial Sequence:  Hypothetical Probe Sequence
tgcgcctatgcgagtgcctaagga

SEQ ID NO: 2819 - DNA, 24 bp, Artificial Sequence
  Description of Artificial Sequence:  Hypothetical Probe Sequence
tgcgcctacacggatgaaagacgg

SEQ ID NO: 2820 - DNA, 24 bp, Artificial Sequence
  Description of Artificial Sequence:  Hypothetical Probe Sequence
tgcgcctaggacaccttgcgtaca

SEQ ID NO: 2821 - DNA, 24 bp, Artificial Sequence
  Description of Artificial Sequence:  Hypothetical Probe Sequence
tgcgcctaacggcctaacctgtgc

SEQ ID NO: 2822 - DNA, 24 bp, Artificial Sequence
  Description of Artificial Sequence:  Hypothetical Probe Sequence
tgcgcctaagccctcaaggaagga

SEQ ID NO: 2823 - DNA, 24 bp, Artificial Sequence
  Description of Artificial Sequence:  Hypothetical Probe Sequence
tgcggatgttgagtgcgctttgtc

SEQ ID NO: 2824 - DNA, 24 bp, Artificial Sequence
  Description of Artificial Sequence:  Hypothetical Probe Sequence
tgcggatgtgatgcttccatgctt

SEQ ID NO: 2825 - DNA, 24 bp, Artificial Sequence
  Description of Artificial Sequence:  Hypothetical Probe Sequence
tgcggatgtgtccgttaaagcgaa

SEQ ID NO: 2826 - DNA, 24 bp, Artificial Sequence
  Description of Artificial Sequence:  Hypothetical Probe Sequence
tgcggatgcgttgatgcagctctg

SEQ ID NO: 2827 - DNA, 24 bp, Artificial Sequence
  Description of Artificial Sequence:  Hypothetical Probe Sequence
tgcggatgctcaatacgtcttccc

SEQ ID NO: 2828 - DNA, 24 bp, Artificial Sequence
  Description of Artificial Sequence:  Hypothetical Probe Sequence
tgcggatgctgtgatggcaactca

SEQ ID NO: 2829 - DNA, 24 bp, Artificial Sequence
  Description of Artificial Sequence:  Hypothetical Probe Sequence
tgcggatggcaaagtgaggatgcg

SEQ ID NO: 2830 - DNA, 24 bp, Artificial Sequence
  Description of Artificial Sequence:  Hypothetical Probe Sequence
tgcggatgcctatcgtcgttggac

SEQ ID NO: 2831 - DNA, 24 bp, Artificial Sequence
  Description of Artificial Sequence:  Hypothetical Probe Sequence
tgcggatgcacgcgttggacagtg

SEQ ID NO: 2832 - DNA, 24 bp, Artificial Sequence
  Description of Artificial Sequence:  Hypothetical Probe Sequence
tgcggatggtgccgaacttgacct

SEQ ID NO: 2833 - DNA, 24 bp, Artificial Sequence
  Description of Artificial Sequence:  Hypothetical Probe Sequence
tgcggatgggacttgacagcccat

SEQ ID NO: 2834 - DNA, 24 bp, Artificial Sequence
  Description of Artificial Sequence:  Hypothetical Probe Sequence
tgcggatgacggtgtcaatcgctt

SEQ ID NO: 2835 - DNA, 24 bp, Artificial Sequence
  Description of Artificial Sequence:  Hypothetical Probe Sequence
tgcgtcccaatctctgaccttccc

SEQ ID NO: 2836 - DNA, 24 bp, Artificial Sequence
  Description of Artificial Sequence:  Hypothetical Probe Sequence
tgcgtcccaaagcttggcaactgt

SEQ ID NO: 2837 - DNA, 24 bp, Artificial Sequence
  Description of Artificial Sequence:  Hypothetical Probe Sequence
tgcgtccctcgtaaaggtctcgaa

SEQ ID NO: 2838 - DNA, 24 bp, Artificial Sequence
  Description of Artificial Sequence:  Hypothetical Probe Sequence
tgcgtccccttgcttgaatcagcc

SEQ ID NO: 2839 - DNA, 24 bp, Artificial Sequence
  Description of Artificial Sequence:  Hypothetical Probe Sequence
tgcgtccccgttgatggcttggac

SEQ ID NO: 2840 - DNA, 24 bp, Artificial Sequence
  Description of Artificial Sequence:  Hypothetical Probe Sequence
tgcgtcccccataatcaatccagc

SEQ ID NO: 2841 - DNA, 24 bp, Artificial Sequence
  Description of Artificial Sequence:  Hypothetical Probe Sequence
tgcgtccccgaaccatacctcagc

SEQ ID NO: 2842 - DNA, 24 bp, Artificial Sequence
  Description of Artificial Sequence:  Hypothetical Probe Sequence
tgcgtcccggtaatacaggaagcc

SEQ ID NO: 2843 - DNA, 24 bp, Artificial Sequence
  Description of Artificial Sequence:  Hypothetical Probe Sequence
tgcgtcccgtctgagttgtcgctt

SEQ ID NO: 2844 - DNA, 24 bp, Artificial Sequence
  Description of Artificial Sequence:  Hypothetical Probe Sequence
tgcgtcccacctatcgctgtcgtt

SEQ ID NO: 2845 - DNA, 24 bp, Artificial Sequence
  Description of Artificial Sequence:  Hypothetical Probe Sequence
tgcgtccctccctcccagtgatcg

SEQ ID NO: 2846 - DNA, 24 bp, Artificial Sequence
  Description of Artificial Sequence:  Hypothetical Probe Sequence
tgcgtcccggacctcaagtgacgg

SEQ ID NO: 2847 - DNA, 24 bp, Artificial Sequence
  Description of Artificial Sequence:  Hypothetical Probe Sequence
tgcgtcccacggaggaaatcccta

SEQ ID NO: 2848 - DNA, 24 bp, Artificial Sequence
  Description of Artificial Sequence:  Hypothetical Probe Sequence
tgcgtgcgataccttgcctaacct

SEQ ID NO: 2849 - DNA, 24 bp, Artificial Sequence
  Description of Artificial Sequence:  Hypothetical Probe Sequence
tgcgtgcgtctgatacggacggac

SEQ ID NO: 2850 - DNA, 24 bp, Artificial Sequence
  Description of Artificial Sequence:  Hypothetical Probe Sequence
tgcgtgcgtgtcctcacagcccta

SEQ ID NO: 2851 - DNA, 24 bp, Artificial Sequence
  Description of Artificial Sequence:  Hypothetical Probe Sequence
tgcgtgcgtcgtcagctgtcagga

SEQ ID NO: 2852 - DNA, 24 bp, Artificial Sequence
  Description of Artificial Sequence:  Hypothetical Probe Sequence
tgcgtgcggcttagtggcaaagga

SEQ ID NO: 2853 - DNA, 24 bp, Artificial Sequence
  Description of Artificial Sequence:  Hypothetical Probe Sequence
tgcgtgcggagtcctacgttggac

SEQ ID NO: 2854 - DNA, 24 bp, Artificial Sequence
  Description of Artificial Sequence:  Hypothetical Probe Sequence
tgcgtgcgatcgcgtttgtcctgt

SEQ ID NO: 2855 - DNA, 24 bp, Artificial Sequence
  Description of Artificial Sequence:  Hypothetical Probe Sequence
tgcgtgcgcctaccatcttgctgt

SEQ ID NO: 2856 - DNA, 24 bp, Artificial Sequence
  Description of Artificial Sequence:  Hypothetical Probe Sequence
tgcgtgcgtcccgctttgtctcgt

SEQ ID NO: 2857 - DNA, 24 bp, Artificial Sequence
  Description of Artificial Sequence:  Hypothetical Probe Sequence
tgcgcacgttgaaaagaggaagcc

SEQ ID NO: 2858 - DNA, 24 bp, Artificial Sequence
  Description of Artificial Sequence:  Hypothetical Probe Sequence
tgcgcacgttagcgttacggtgat

SEQ ID NO: 2859 - DNA, 24 bp, Artificial Sequence
  Description of Artificial Sequence:  Hypothetical Probe Sequence
tgcgcacgaaagacctagccgtct

SEQ ID NO: 2860 - DNA, 24 bp, Artificial Sequence
  Description of Artificial Sequence:  Hypothetical Probe Sequence
tgcgcacgtcgtcacggaccatac

SEQ ID NO: 2861 - DNA, 24 bp, Artificial Sequence
  Description of Artificial Sequence:  Hypothetical Probe Sequence
tgcgcacgctgtccatcacgagga

SEQ ID NO: 2862 - DNA, 24 bp, Artificial Sequence
  Description of Artificial Sequence:  Hypothetical Probe Sequence
tgcgcacggtctaatcgtgctgtc

SEQ ID NO: 2863 - DNA, 24 bp, Artificial Sequence
  Description of Artificial Sequence:  Hypothetical Probe Sequence
tgcgcacgcctattaggagtagcc

SEQ ID NO: 2864 - DNA, 24 bp, Artificial Sequence
  Description of Artificial Sequence:  Hypothetical Probe Sequence
tgcgcacggatgctgttctggtgc

SEQ ID NO: 2865 - DNA, 24 bp, Artificial Sequence
  Description of Artificial Sequence:  Hypothetical Probe Sequence
tgcgcacgtcccaccttcgtgatg

SEQ ID NO: 2866 - DNA, 24 bp, Artificial Sequence
  Description of Artificial Sequence:  Hypothetical Probe Sequence
tgcgcacggaccagtgtcgtcgaa

SEQ ID NO: 2867 - DNA, 24 bp, Artificial Sequence
  Description of Artificial Sequence:  Hypothetical Probe Sequence
tgcgcacgggactcgtggtaggac

SEQ ID NO: 2868 - DNA, 24 bp, Artificial Sequence
  Description of Artificial Sequence:  Hypothetical Probe Sequence
tgcgcacgagccgtctaggaacgg

SEQ ID NO: 2869 - DNA, 24 bp, Artificial Sequence
  Description of Artificial Sequence:  Hypothetical Probe Sequence
tgcgcagcttgacagcaggagctt

SEQ ID NO: 2870 - DNA, 24 bp, Artificial Sequence
  Description of Artificial Sequence:  Hypothetical Probe Sequence
tgcgcagctgatttagcgaagctt

SEQ ID NO: 2871 - DNA, 24 bp, Artificial Sequence
  Description of Artificial Sequence:  Hypothetical Probe Sequence
tgcgcagcttaggcttaatcgcaa

SEQ ID NO: 2872 - DNA, 24 bp, Artificial Sequence
  Description of Artificial Sequence:  Hypothetical Probe Sequence
tgcgcagcatactctgcagcctca

SEQ ID NO: 2873 - DNA, 24 bp, Artificial Sequence
  Description of Artificial Sequence:  Hypothetical Probe Sequence
tgcgcagctcgtgtctcagcccta

SEQ ID NO: 2874 - DNA, 24 bp, Artificial Sequence
  Description of Artificial Sequence:  Hypothetical Probe Sequence
tgcgcagcccatttaggcttatcg

SEQ ID NO: 2875 - DNA, 24 bp, Artificial Sequence
  Description of Artificial Sequence:  Hypothetical Probe Sequence
tgcgcagcggtactcaacggagtg

SEQ ID NO: 2876 - DNA, 24 bp, Artificial Sequence
  Description of Artificial Sequence:  Hypothetical Probe Sequence
tgcgcagcgagtgcaaatacacgg

SEQ ID NO: 2877 - DNA, 24 bp, Artificial Sequence
  Description of Artificial Sequence:  Hypothetical Probe Sequence
tgcgcagcatcgttagggtatccc

SEQ ID NO: 2878 - DNA, 24 bp, Artificial Sequence
  Description of Artificial Sequence:  Hypothetical Probe Sequence
tgcgcagccctagatgtcgtagcc

SEQ ID NO: 2879 - DNA, 24 bp, Artificial Sequence
  Description of Artificial Sequence:  Hypothetical Probe Sequence
tgcgcagcgatgataccacgagga

SEQ ID NO: 2880 - DNA, 24 bp, Artificial Sequence
  Description of Artificial Sequence:  Hypothetical Probe Sequence
tgcgcagccagccagccctactca

SEQ ID NO: 2881 - DNA, 24 bp, Artificial Sequence
  Description of Artificial Sequence:  Hypothetical Probe Sequence
tgcgcagcgaccaaagaaaggcaa

SEQ ID NO: 2882 - DNA, 24 bp, Artificial Sequence
  Description of Artificial Sequence:  Hypothetical Probe Sequence
tgcgcagcagcctcgttctgtcgt

SEQ ID NO: 2883 - DNA, 24 bp, Artificial Sequence
  Description of Artificial Sequence:  Hypothetical Probe Sequence
tgcggacctgatcgaatgtcggta

SEQ ID NO: 2884 - DNA, 24 bp, Artificial Sequence
  Description of Artificial Sequence:  Hypothetical Probe Sequence
tgcggaccaatcaggagaccgatg

SEQ ID NO: 2885 - DNA, 24 bp, Artificial Sequence
  Description of Artificial Sequence:  Hypothetical Probe Sequence
tgcggaccatacaatctgcggtct

SEQ ID NO: 2886 - DNA, 24 bp, Artificial Sequence
  Description of Artificial Sequence:  Hypothetical Probe Sequence
tgcggacctacactgttcccggac

SEQ ID NO: 2887 - DNA, 24 bp, Artificial Sequence
  Description of Artificial Sequence:  Hypothetical Probe Sequence
tgcggacctgtctgatacgggacc

SEQ ID NO: 2888 - DNA, 24 bp, Artificial Sequence
  Description of Artificial Sequence:  Hypothetical Probe Sequence
tgcggacccgttgcaattagggac

SEQ ID NO: 2889 - DNA, 24 bp, Artificial Sequence
  Description of Artificial Sequence:  Hypothetical Probe Sequence
tgcggaccccatctgttctggctt

SEQ ID NO: 2890 - DNA, 24 bp, Artificial Sequence
  Description of Artificial Sequence:  Hypothetical Probe Sequence
tgcggacccgaacttgatcggatg

SEQ ID NO: 2891 - DNA, 24 bp, Artificial Sequence
  Description of Artificial Sequence:  Hypothetical Probe Sequence
tgcggaccgagtccatgtgctgtc

SEQ ID NO: 2892 - DNA, 24 bp, Artificial Sequence
  Description of Artificial Sequence:  Hypothetical Probe Sequence
tgcggaccaggaaaaggtcttcgt

SEQ ID NO: 2893 - DNA, 24 bp, Artificial Sequence
  Description of Artificial Sequence:  Hypothetical Probe Sequence
tgcggaccgatgtgtcagtgacgg

SEQ ID NO: 2894 - DNA, 24 bp, Artificial Sequence
  Description of Artificial Sequence:  Hypothetical Probe Sequence
tgcggacccagctcgtcttgctgt

SEQ ID NO: 2895 - DNA, 24 bp, Artificial Sequence
  Description of Artificial Sequence:  Hypothetical Probe Sequence
tgcggaccgaccggtagcaaccat

SEQ ID NO: 2896 - DNA, 24 bp, Artificial Sequence
  Description of Artificial Sequence:  Hypothetical Probe Sequence
tgcggaccacggaaagccatgtct

SEQ ID NO: 2897 - DNA, 24 bp, Artificial Sequence
  Description of Artificial Sequence:  Hypothetical Probe Sequence
tgcggtgcaatcacggcctagtct

SEQ ID NO: 2898 - DNA, 24 bp, Artificial Sequence
  Description of Artificial Sequence:  Hypothetical Probe Sequence
tgcggtgcaaagcgttcacgtctg

SEQ ID NO: 2899 - DNA, 24 bp, Artificial Sequence
  Description of Artificial Sequence:  Hypothetical Probe Sequence
tgcggtgctgtccctatcccgtct

SEQ ID NO: 2900 - DNA, 24 bp, Artificial Sequence
  Description of Artificial Sequence:  Hypothetical Probe Sequence
tgcggtgccgttatcgaaaggacc

SEQ ID NO: 2901 - DNA, 24 bp, Artificial Sequence
  Description of Artificial Sequence:  Hypothetical Probe Sequence
tgcggtgcacctccatccatcttg

SEQ ID NO: 2902 - DNA, 24 bp, Artificial Sequence
  Description of Artificial Sequence:  Hypothetical Probe Sequence
tgcggtgctcccctgtacggagga

SEQ ID NO: 2903 - DNA, 24 bp, Artificial Sequence
  Description of Artificial Sequence:  Hypothetical Probe Sequence
tgcggtgcagcccctaccatgctt

SEQ ID NO: 2904 - DNA, 24 bp, Artificial Sequence
  Description of Artificial Sequence:  Hypothetical Probe Sequence
tgcgggacttgagtctgtgcggta

SEQ ID NO: 2905 - DNA, 24 bp, Artificial Sequence
  Description of Artificial Sequence:  Hypothetical Probe Sequence
tgcgggactgatttgacagcccta

SEQ ID NO: 2906 - DNA, 24 bp, Artificial Sequence
  Description of Artificial Sequence:  Hypothetical Probe Sequence
tgcgggacatacgcttagccagga

SEQ ID NO: 2907 - DNA, 24 bp, Artificial Sequence
  Description of Artificial Sequence:  Hypothetical Probe Sequence
tgcgggacaaagttagcgttgtgc

SEQ ID NO: 2908 - DNA, 24 bp, Artificial Sequence
  Description of Artificial Sequence:  Hypothetical Probe Sequence
tgcgggactgtctctgagccccta

SEQ ID NO: 2909 - DNA, 24 bp, Artificial Sequence
  Description of Artificial Sequence:  Hypothetical Probe Sequence
tgcgggaccttgttaggagttgcg

SEQ ID NO: 2910 - DNA, 24 bp, Artificial Sequence
  Description of Artificial Sequence:  Hypothetical Probe Sequence
tgcgggaccgttggtatcccaatc

SEQ ID NO: 2911 - DNA, 24 bp, Artificial Sequence
  Description of Artificial Sequence:  Hypothetical Probe Sequence
tgcgggacctcagaccacctgctt

SEQ ID NO: 2912 - DNA, 24 bp, Artificial Sequence
  Description of Artificial Sequence:  Hypothetical Probe Sequence
tgcgggacctgtaatccgttcagc

SEQ ID NO: 2913 - DNA, 24 bp, Artificial Sequence
  Description of Artificial Sequence:  Hypothetical Probe Sequence
tgcgggaccgaacgttctcagtgc

SEQ ID NO: 2914 - DNA, 24 bp, Artificial Sequence
  Description of Artificial Sequence:  Hypothetical Probe Sequence
tgcgggacgcttgcttatactgcg

SEQ ID NO: 2915 - DNA, 24 bp, Artificial Sequence
  Description of Artificial Sequence:  Hypothetical Probe Sequence
tgcgggacgtctacctgcttgatg

SEQ ID NO: 2916 - DNA, 24 bp, Artificial Sequence
  Description of Artificial Sequence:  Hypothetical Probe Sequence
tgcgggacagtgacggacctacct

SEQ ID NO: 2917 - DNA, 24 bp, Artificial Sequence
  Description of Artificial Sequence:  Hypothetical Probe Sequence
tgcgggacatcgctcatcgtcgaa

SEQ ID NO: 2918 - DNA, 24 bp, Artificial Sequence
  Description of Artificial Sequence:  Hypothetical Probe Sequence
tgcgggaccctatacagcaatccc

SEQ ID NO: 2919 - DNA, 24 bp, Artificial Sequence
  Description of Artificial Sequence:  Hypothetical Probe Sequence
tgcgggacgatggtgcgatgagtg

SEQ ID NO: 2920 - DNA, 24 bp, Artificial Sequence
  Description of Artificial Sequence:  Hypothetical Probe Sequence
tgcgggactgcgtgtcccattctg

SEQ ID NO: 2921 - DNA, 24 bp, Artificial Sequence
  Description of Artificial Sequence:  Hypothetical Probe Sequence
tgcgggacagccatacgcaagctt

SEQ ID NO: 2922 - DNA, 24 bp, Artificial Sequence
  Description of Artificial Sequence:  Hypothetical Probe Sequence
tgcgacggttaggctttctggctt

SEQ ID NO: 2923 - DNA, 24 bp, Artificial Sequence
  Description of Artificial Sequence:  Hypothetical Probe Sequence
tgcgacggaatcaatcatcgacgg

SEQ ID NO: 2924 - DNA, 24 bp, Artificial Sequence
  Description of Artificial Sequence:  Hypothetical Probe Sequence
tgcgacggtctgcgaattagcgtt

SEQ ID NO: 2925 - DNA, 24 bp, Artificial Sequence
  Description of Artificial Sequence:  Hypothetical Probe Sequence
tgcgacggctcattgaagtggtgc

SEQ ID NO: 2926 - DNA, 24 bp, Artificial Sequence
  Description of Artificial Sequence:  Hypothetical Probe Sequence
tgcgacggctgtccatacctgtgc

SEQ ID NO: 2927 - DNA, 24 bp, Artificial Sequence
  Description of Artificial Sequence:  Hypothetical Probe Sequence
tgcgacgggtctcttggagtagcc

SEQ ID NO: 2928 - DNA, 24 bp, Artificial Sequence
  Description of Artificial Sequence:  Hypothetical Probe Sequence
tgcgacgggagtcgttaaaggctt

SEQ ID NO: 2929 - DNA, 24 bp, Artificial Sequence
  Description of Artificial Sequence:  Hypothetical Probe Sequence
tgcgacggagtgacctcacgccta

SEQ ID NO: 2930 - DNA, 24 bp, Artificial Sequence
  Description of Artificial Sequence:  Hypothetical Probe Sequence
tgcgacggaggatgtcggactcgt

SEQ ID NO: 2931 - DNA, 24 bp, Artificial Sequence
  Description of Artificial Sequence:  Hypothetical Probe Sequence
tgcgacgggatggtgctgtcatcg

SEQ ID NO: 2932 - DNA, 24 bp, Artificial Sequence
  Description of Artificial Sequence:  Hypothetical Probe Sequence
tgcgacgggtgcggtaaggagtgc

SEQ ID NO: 2933 - DNA, 24 bp, Artificial Sequence
  Description of Artificial Sequence:  Hypothetical Probe Sequence
tgcgacggggacgcttagcctgat

SEQ ID NO: 2934 - DNA, 24 bp, Artificial Sequence
  Description of Artificial Sequence:  Hypothetical Probe Sequence
tgcgagccttgatgtctctgtgcg

SEQ ID NO: 2935 - DNA, 24 bp, Artificial Sequence
  Description of Artificial Sequence:  Hypothetical Probe Sequence
tgcgagcctgattctggcaagacc

SEQ ID NO: 2936 - DNA, 24 bp, Artificial Sequence
  Description of Artificial Sequence:  Hypothetical Probe Sequence
tgcgagccttaggcaatctgcttg

SEQ ID NO: 2937 - DNA, 24 bp, Artificial Sequence
  Description of Artificial Sequence:  Hypothetical Probe Sequence
tgcgagccaaagggacataccagc

SEQ ID NO: 2938 - DNA, 24 bp, Artificial Sequence
  Description of Artificial Sequence:  Hypothetical Probe Sequence
tgcgagcctacaaaaggtgcctgt

SEQ ID NO: 2939 - DNA, 24 bp, Artificial Sequence
  Description of Artificial Sequence:  Hypothetical Probe Sequence
tgcgagcctgtcgacctacaacgg

SEQ ID NO: 2940 - DNA, 24 bp, Artificial Sequence
  Description of Artificial Sequence:  Hypothetical Probe Sequence
tgcgagccctcaggtaggaccgaa

SEQ ID NO: 2941 - DNA, 24 bp, Artificial Sequence
  Description of Artificial Sequence:  Hypothetical Probe Sequence
tgcgagccccatggtaagccaatc

SEQ ID NO: 2942 - DNA, 24 bp, Artificial Sequence
  Description of Artificial Sequence:  Hypothetical Probe Sequence
tgcgagccggtatgtcagcctcgt

SEQ ID NO: 2943 - DNA, 24 bp, Artificial Sequence
  Description of Artificial Sequence:  Hypothetical Probe Sequence
tgcgagccaggagatgcgaagacc

SEQ ID NO: 2944 - DNA, 24 bp, Artificial Sequence
  Description of Artificial Sequence:  Hypothetical Probe Sequence
tgcgagcccctatctgagccttga

SEQ ID NO: 2945 - DNA, 24 bp, Artificial Sequence
  Description of Artificial Sequence:  Hypothetical Probe Sequence
tgcgagcctcccgcttgatgctgt

SEQ ID NO: 2946 - DNA, 24 bp, Artificial Sequence
  Description of Artificial Sequence:  Hypothetical Probe Sequence
tgcgagcccacgtgtcgcttctgt

SEQ ID NO: 2947 - DNA, 24 bp, Artificial Sequence
  Description of Artificial Sequence:  Hypothetical Probe Sequence
tgcgagcccagccagcgtctttga

SEQ ID NO: 2948 - DNA, 24 bp, Artificial Sequence
  Description of Artificial Sequence:  Hypothetical Probe Sequence
tgcgagccggactcgtgcttgagt

SEQ ID NO: 2949 - DNA, 24 bp, Artificial Sequence
  Description of Artificial Sequence:  Hypothetical Probe Sequence
tgcgagccacggcagctgatcgtt

SEQ ID NO: 2950 - DNA, 24 bp, Artificial Sequence
  Description of Artificial Sequence:  Hypothetical Probe Sequence
tgcgagccagccgatgggtacacg

SEQ ID NO: 2951 - DNA, 24 bp, Artificial Sequence
  Description of Artificial Sequence:  Hypothetical Probe Sequence
cacgttgaccattgcgccattcgt

SEQ ID NO: 2952 - DNA, 24 bp, Artificial Sequence
  Description of Artificial Sequence:  Hypothetical Probe Sequence
cacgttgagcaaacggaaagtgcg

SEQ ID NO: 2953 - DNA, 24 bp, Artificial Sequence
  Description of Artificial Sequence:  Hypothetical Probe Sequence
cacgttgaatcgcacggaccctca

SEQ ID NO: 2954 - DNA, 24 bp, Artificial Sequence
  Description of Artificial Sequence:  Hypothetical Probe Sequence
cacgtgattcgtgtgccgttcgaa

SEQ ID NO: 2955 - DNA, 24 bp, Artificial Sequence
  Description of Artificial Sequence:  Hypothetical Probe Sequence
cacgtgattcccaatcgcaagcaa

SEQ ID NO: 2956 - DNA, 24 bp, Artificial Sequence
  Description of Artificial Sequence:  Hypothetical Probe Sequence
cacgtgatgtgcccattccccgaa

SEQ ID NO: 2957 - DNA, 24 bp, Artificial Sequence
  Description of Artificial Sequence:  Hypothetical Probe Sequence
cacgttagcacggcaaagtggctt

SEQ ID NO: 2958 - DNA, 24 bp, Artificial Sequence
  Description of Artificial Sequence:  Hypothetical Probe Sequence
cacgaatccacggaccacggagtg

SEQ ID NO: 2959 - DNA, 24 bp, Artificial Sequence
  Description of Artificial Sequence:  Hypothetical Probe Sequence
cacgatacgcaaaaagacgggcaa

SEQ ID NO: 2960 - DNA, 24 bp, Artificial Sequence
  Description of Artificial Sequence:  Hypothetical Probe Sequence
cacgatactgcgtctgacggcgaa

SEQ ID NO: 2961 - DNA, 24 bp, Artificial Sequence
  Description of Artificial Sequence:  Hypothetical Probe Sequence
cacgatacacggacggaggaagcc

SEQ ID NO: 2962 - DNA, 24 bp, Artificial Sequence
  Description of Artificial Sequence:  Hypothetical Probe Sequence
cacgaaagctgtggaccgaagtgc

SEQ ID NO: 2963 - DNA, 24 bp, Artificial Sequence
  Description of Artificial Sequence:  Hypothetical Probe Sequence
cacgaaagggtaatcgcttgtgcg

SEQ ID NO: 2964 - DNA, 24 bp, Artificial Sequence
  Description of Artificial Sequence:  Hypothetical Probe Sequence
cacgaaagcctaagtgcacgcagc

SEQ ID NO: 2965 - DNA, 24 bp, Artificial Sequence
  Description of Artificial Sequence:  Hypothetical Probe Sequence
cacgaaagtgcgatacaccttgcg

SEQ ID NO: 2966 - DNA, 24 bp, Artificial Sequence
  Description of Artificial Sequence:  Hypothetical Probe Sequence
cacgaaaggtgcaaagagccctca

SEQ ID NO: 2967 - DNA, 24 bp, Artificial Sequence
  Description of Artificial Sequence:  Hypothetical Probe Sequence
cacgaaagggacacctgtgctgcg

SEQ ID NO: 2968 - DNA, 24 bp, Artificial Sequence
  Description of Artificial Sequence:  Hypothetical Probe Sequence
cacgtctgcgttatactgcggctt

SEQ ID NO: 2969 - DNA, 24 bp, Artificial Sequence
  Description of Artificial Sequence:  Hypothetical Probe Sequence
cacgtctgtgcgtgatacgggtgc

SEQ ID NO: 2970 - DNA, 24 bp, Artificial Sequence
  Description of Artificial Sequence:  Hypothetical Probe Sequence
cacgtctgcacggcttaaagcacg

SEQ ID NO: 2971 - DNA, 24 bp, Artificial Sequence
  Description of Artificial Sequence:  Hypothetical Probe Sequence
cacgtctgcagcatcgaccttcgt

SEQ ID NO: 2972 - DNA, 24 bp, Artificial Sequence
  Description of Artificial Sequence:  Hypothetical Probe Sequence
cacgtctggacccttggacctgcg

SEQ ID NO: 2973 - DNA, 24 bp, Artificial Sequence
  Description of Artificial Sequence:  Hypothetical Probe Sequence
cacgtgtccgttaggagcaatccc

SEQ ID NO: 2974 - DNA, 24 bp, Artificial Sequence
  Description of Artificial Sequence:  Hypothetical Probe Sequence
cacgtgtcgaccgatggaccggac

SEQ ID NO: 2975 - DNA, 24 bp, Artificial Sequence
  Description of Artificial Sequence:  Hypothetical Probe Sequence
cacgtgtcagccgatggcaacgaa

SEQ ID NO: 2976 - DNA, 24 bp, Artificial Sequence
  Description of Artificial Sequence:  Hypothetical Probe Sequence
cacgtcgttctgcgttacggacgg

SEQ ID NO: 2977 - DNA, 24 bp, Artificial Sequence
  Description of Artificial Sequence:  Hypothetical Probe Sequence
cacgtcgttcgtccatcgaagtgc

SEQ ID NO: 2978 - DNA, 24 bp, Artificial Sequence
  Description of Artificial Sequence:  Hypothetical Probe Sequence
cacgtcgtccataaagagcccacg

SEQ ID NO: 2979 - DNA, 24 bp, Artificial Sequence
  Description of Artificial Sequence:  Hypothetical Probe Sequence
cacgtcgtacctgtcttgcgagcc

SEQ ID NO: 2980 - DNA, 24 bp, Artificial Sequence
  Description of Artificial Sequence:  Hypothetical Probe Sequence
cacgtcgtggacgcaagatgcacg

SEQ ID NO: 2981 - DNA, 24 bp, Artificial Sequence
  Description of Artificial Sequence:  Hypothetical Probe Sequence
cacgcttgtgtcggaccgaaacgg

SEQ ID NO: 2982 - DNA, 24 bp, Artificial Sequence
  Description of Artificial Sequence:  Hypothetical Probe Sequence
cacgcttgagtgagtggtgcggac

SEQ ID NO: 2983 - DNA, 24 bp, Artificial Sequence
  Description of Artificial Sequence:  Hypothetical Probe Sequence
cacgcttgacctcgttagccccat

SEQ ID NO: 2984 - DNA, 24 bp, Artificial Sequence
  Description of Artificial Sequence:  Hypothetical Probe Sequence
cacgcttgtccctcgttgatgcaa

SEQ ID NO: 2985 - DNA, 24 bp, Artificial Sequence
  Description of Artificial Sequence:  Hypothetical Probe Sequence
cacgcttgagcctctgacctgcaa

SEQ ID NO: 2986 - DNA, 24 bp, Artificial Sequence
  Description of Artificial Sequence:  Hypothetical Probe Sequence
cacgcgtttacaaggacacgcacg

SEQ ID NO: 2987 - DNA, 24 bp, Artificial Sequence
  Description of Artificial Sequence:  Hypothetical Probe Sequence
cacgcgtttgtcgcttaatcgtgc

SEQ ID NO: 2988 - DNA, 24 bp, Artificial Sequence
  Description of Artificial Sequence:  Hypothetical Probe Sequence
cacgcgtttcgtgatgcgaattga

SEQ ID NO: 2989 - DNA, 24 bp, Artificial Sequence
  Description of Artificial Sequence:  Hypothetical Probe Sequence
cacgcgttcttgcgttcgtttgat

SEQ ID NO: 2990 - DNA, 24 bp, Artificial Sequence
  Description of Artificial Sequence:  Hypothetical Probe Sequence
cacgcgttcgaagtgcgtctacct

SEQ ID NO: 2991 - DNA, 24 bp, Artificial Sequence
  Description of Artificial Sequence:  Hypothetical Probe Sequence
cacgcgttgtctttagtgcgctca

SEQ ID NO: 2992 - DNA, 24 bp, Artificial Sequence
  Description of Artificial Sequence:  Hypothetical Probe Sequence
cacgcgttgcaagcaatgtcctca

SEQ ID NO: 2993 - DNA, 24 bp, Artificial Sequence
  Description of Artificial Sequence:  Hypothetical Probe Sequence
cacgcgttcctatgatgacccagc

SEQ ID NO: 2994 - DNA, 24 bp, Artificial Sequence
  Description of Artificial Sequence:  Hypothetical Probe Sequence
cacgcgttgatgctcaaggatccc

SEQ ID NO: 2995 - DNA, 24 bp, Artificial Sequence
  Description of Artificial Sequence:  Hypothetical Probe Sequence
cacgcgtttccctgatagcccttg

SEQ ID NO: 2996 - DNA, 24 bp, Artificial Sequence
  Description of Artificial Sequence:  Hypothetical Probe Sequence
cacgcgttagcccacgtccctgat

SEQ ID NO: 2997 - DNA, 24 bp, Artificial Sequence
  Description of Artificial Sequence:  Hypothetical Probe Sequence
cacgctcaaatcagcccacggtgc

SEQ ID NO: 2998 - DNA, 24 bp, Artificial Sequence
  Description of Artificial Sequence:  Hypothetical Probe Sequence
cacgctcacgaaaaagccatgtgc

SEQ ID NO: 2999 - DNA, 24 bp, Artificial Sequence
  Description of Artificial Sequence:  Hypothetical Probe Sequence
cacgctcaggtaatcgatcgcacg

SEQ ID NO: 3000 - DNA, 24 bp, Artificial Sequence
  Description of Artificial Sequence:  Hypothetical Probe Sequence
cacgctcatcccccatccattgat

SEQ ID NO: 3001 - DNA, 24 bp, Artificial Sequence
  Description of Artificial Sequence:  Hypothetical Probe Sequence
cacgctgtatcgacctcagccagc

SEQ ID NO: 3002 - DNA, 24 bp, Artificial Sequence
  Description of Artificial Sequence:  Hypothetical Probe Sequence
cacgctgttgcgctcaaggacgaa

SEQ ID NO: 3003 - DNA, 24 bp, Artificial Sequence
  Description of Artificial Sequence:  Hypothetical Probe Sequence
cacgccattacaacctcagctgcg

SEQ ID NO: 3004 - DNA, 24 bp, Artificial Sequence
  Description of Artificial Sequence:  Hypothetical Probe Sequence
cacgccattctgcttggtgcagga

SEQ ID NO: 3005 - DNA, 24 bp, Artificial Sequence
  Description of Artificial Sequence:  Hypothetical Probe Sequence
cacgccattcgttctgggacagga

SEQ ID NO: 3006 - DNA, 24 bp, Artificial Sequence
  Description of Artificial Sequence:  Hypothetical Probe Sequence
cacgccatcttgaatccacgccta

SEQ ID NO: 3007 - DNA, 24 bp, Artificial Sequence
  Description of Artificial Sequence:  Hypothetical Probe Sequence
cacgccatccatcgttggtacgtt

SEQ ID NO: 3008 - DNA, 24 bp, Artificial Sequence
  Description of Artificial Sequence:  Hypothetical Probe Sequence
cacgccatggtaaggaacggacct

SEQ ID NO: 3009 - DNA, 24 bp, Artificial Sequence
  Description of Artificial Sequence:  Hypothetical Probe Sequence
cacgccatgtctcagctgtcgcaa

SEQ ID NO: 3010 - DNA, 24 bp, Artificial Sequence
  Description of Artificial Sequence:  Hypothetical Probe Sequence
cacgccatgagtgtgcgcttctgt

SEQ ID NO: 3011 - DNA, 24 bp, Artificial Sequence
  Description of Artificial Sequence:  Hypothetical Probe Sequence
cacgccatagtgtgtctcccgacc

SEQ ID NO: 3012 - DNA, 24 bp, Artificial Sequence
  Description of Artificial Sequence:  Hypothetical Probe Sequence
cacgccataggacgttacggtcgt

SEQ ID NO: 3013 - DNA, 24 bp, Artificial Sequence
  Description of Artificial Sequence:  Hypothetical Probe Sequence
cacgccattgcggcttcagctgtc

SEQ ID NO: 3014 - DNA, 24 bp, Artificial Sequence
  Description of Artificial Sequence:  Hypothetical Probe Sequence
cacgccatcacgctcaggactccc

SEQ ID NO: 3015 - DNA, 24 bp, Artificial Sequence
  Description of Artificial Sequence:  Hypothetical Probe Sequence
cacgccatgacctacatgcgccta

SEQ ID NO: 3016 - DNA, 24 bp, Artificial Sequence
  Description of Artificial Sequence:  Hypothetical Probe Sequence
cacgccatacggagtgagccaaag

SEQ ID NO: 3017 - DNA, 24 bp, Artificial Sequence
  Description of Artificial Sequence:  Hypothetical Probe Sequence
cacgcgaattgacgttgcttcagc

SEQ ID NO: 3018 - DNA, 24 bp, Artificial Sequence
  Description of Artificial Sequence:  Hypothetical Probe Sequence
cacgcgaaaatcgagtcacggctt

SEQ ID NO: 3019 - DNA, 24 bp, Artificial Sequence
  Description of Artificial Sequence:  Hypothetical Probe Sequence
cacgcgaatctgaatccttgcagc

SEQ ID NO: 3020 - DNA, 24 bp, Artificial Sequence
  Description of Artificial Sequence:  Hypothetical Probe Sequence
cacgcgaacttgttgaggacgctt

SEQ ID NO: 3021 - DNA, 24 bp, Artificial Sequence
  Description of Artificial Sequence:  Hypothetical Probe Sequence
cacgcgaactgtcagccctatccc

SEQ ID NO: 3022 - DNA, 24 bp, Artificial Sequence
  Description of Artificial Sequence:  Hypothetical Probe Sequence
cacgcgaagcttccattcgtctgt

SEQ ID NO: 3023 - DNA, 24 bp, Artificial Sequence
  Description of Artificial Sequence:  Hypothetical Probe Sequence
cacgcgaaggtactcatcccgtct

SEQ ID NO: 3024 - DNA, 24 bp, Artificial Sequence
  Description of Artificial Sequence:  Hypothetical Probe Sequence
cacgcgaagtcttcccgatgtctg

SEQ ID NO: 3025 - DNA, 24 bp, Artificial Sequence
  Description of Artificial Sequence:  Hypothetical Probe Sequence
cacgcgaagcaacgaaatacccat

SEQ ID NO: 3026 - DNA, 24 bp, Artificial Sequence
  Description of Artificial Sequence:  Hypothetical Probe Sequence
cacgcgaagatgttagagccgacc

SEQ ID NO: 3027 - DNA, 24 bp, Artificial Sequence
  Description of Artificial Sequence:  Hypothetical Probe Sequence
cacgcgaatcccggtacgaacgtt

SEQ ID NO: 3028 - DNA, 24 bp, Artificial Sequence
  Description of Artificial Sequence:  Hypothetical Probe Sequence
cacgcgaatgcggatgcttggatg

SEQ ID NO: 3029 - DNA, 24 bp, Artificial Sequence
  Description of Artificial Sequence:  Hypothetical Probe Sequence
cacggcttttagtgatggactgcg

SEQ ID NO: 3030 - DNA, 24 bp, Artificial Sequence
  Description of Artificial Sequence:  Hypothetical Probe Sequence
cacggctttcgtgtctgcttcacg

SEQ ID NO: 3031 - DNA, 24 bp, Artificial Sequence
  Description of Artificial Sequence:  Hypothetical Probe Sequence
cacggcttgcaagcaactgtgtgc

SEQ ID NO: 3032 - DNA, 24 bp, Artificial Sequence
  Description of Artificial Sequence:  Hypothetical Probe Sequence
cacggcttatcggtgcgctttctg

SEQ ID NO: 3033 - DNA, 24 bp, Artificial Sequence
  Description of Artificial Sequence:  Hypothetical Probe Sequence
cacggctttcccgtgcctgtcttg

SEQ ID NO: 3034 - DNA, 24 bp, Artificial Sequence
  Description of Artificial Sequence:  Hypothetical Probe Sequence
cacggcttggacctgttgtcgctt

SEQ ID NO: 3035 - DNA, 24 bp, Artificial Sequence
  Description of Artificial Sequence:  Hypothetical Probe Sequence
cacggcttagccccataggatccc

SEQ ID NO: 3036 - DNA, 24 bp, Artificial Sequence
  Description of Artificial Sequence:  Hypothetical Probe Sequence
cacgggtatgatcagcgatgcacg

SEQ ID NO: 3037 - DNA, 24 bp, Artificial Sequence
  Description of Artificial Sequence:  Hypothetical Probe Sequence
cacgggtatcgtgcttcagcggta

SEQ ID NO: 3038 - DNA, 24 bp, Artificial Sequence
  Description of Artificial Sequence:  Hypothetical Probe Sequence
cacgggtaccatgtctgtgcgtgc

SEQ ID NO: 3039 - DNA, 24 bp, Artificial Sequence
  Description of Artificial Sequence:  Hypothetical Probe Sequence
cacgggtagcttaaagtcccgtgc

SEQ ID NO: 3040 - DNA, 24 bp, Artificial Sequence
  Description of Artificial Sequence:  Hypothetical Probe Sequence
cacgggtagcaaagtgatcgtccc

SEQ ID NO: 3041 - DNA, 24 bp, Artificial Sequence
  Description of Artificial Sequence:  Hypothetical Probe Sequence
cacgggtaaggacacgtcgtcgtt

SEQ ID NO: 3042 - DNA, 24 bp, Artificial Sequence
  Description of Artificial Sequence:  Hypothetical Probe Sequence
cacgggtagatgtgcgtccctgcg

SEQ ID NO: 3043 - DNA, 24 bp, Artificial Sequence
  Description of Artificial Sequence:  Hypothetical Probe Sequence
cacgggtagaccagccgcaatcgt

SEQ ID NO: 3044 - DNA, 24 bp, Artificial Sequence
  Description of Artificial Sequence:  Hypothetical Probe Sequence
cacgggtaggacaaagggacggta

SEQ ID NO: 3045 - DNA, 24 bp, Artificial Sequence
  Description of Artificial Sequence:  Hypothetical Probe Sequence
cacggtcttgatcacggcaagtgc

SEQ ID NO: 3046 - DNA, 24 bp, Artificial Sequence
  Description of Artificial Sequence:  Hypothetical Probe Sequence
cacggtcttctgtgcgccattgtc

SEQ ID NO: 3047 - DNA, 24 bp, Artificial Sequence
  Description of Artificial Sequence:  Hypothetical Probe Sequence
cacggtctgcaaggtatcccagcc

SEQ ID NO: 3048 - DNA, 24 bp, Artificial Sequence
  Description of Artificial Sequence:  Hypothetical Probe Sequence
cacggtcttgcgcacgacctccta

SEQ ID NO: 3049 - DNA, 24 bp, Artificial Sequence
  Description of Artificial Sequence:  Hypothetical Probe Sequence
cacggtctacggttgaagccctgt

SEQ ID NO: 3050 - DNA, 24 bp, Artificial Sequence
  Description of Artificial Sequence:  Hypothetical Probe Sequence
cacggagttgatcagctgcggcaa

SEQ ID NO: 3051 - DNA, 24 bp, Artificial Sequence
  Description of Artificial Sequence:  Hypothetical Probe Sequence
cacggagttcgtttagcagcccat

SEQ ID NO: 3052 - DNA, 24 bp, Artificial Sequence
  Description of Artificial Sequence:  Hypothetical Probe Sequence
cacggagtgcttacggcacgatac

SEQ ID NO: 3053 - DNA, 24 bp, Artificial Sequence
  Description of Artificial Sequence:  Hypothetical Probe Sequence
cacggagtaggagaccgtgcgctt

SEQ ID NO: 3054 - DNA, 24 bp, Artificial Sequence
  Description of Artificial Sequence:  Hypothetical Probe Sequence
cacggagtagccggaccagcgagt

SEQ ID NO: 3055 - DNA, 24 bp, Artificial Sequence
  Description of Artificial Sequence:  Hypothetical Probe Sequence
cacggcaattgatctgcctacacg

SEQ ID NO: 3056 - DNA, 24 bp, Artificial Sequence
  Description of Artificial Sequence:  Hypothetical Probe Sequence
cacggcaatgtcacggaaagtcgt

SEQ ID NO: 3057 - DNA, 24 bp, Artificial Sequence
  Description of Artificial Sequence:  Hypothetical Probe Sequence
cacggcaacttgaatcatcggacc

SEQ ID NO: 3058 - DNA, 24 bp, Artificial Sequence
  Description of Artificial Sequence:  Hypothetical Probe Sequence
cacggcaaggtactcagacctccc

SEQ ID NO: 3059 - DNA, 24 bp, Artificial Sequence
  Description of Artificial Sequence:  Hypothetical Probe Sequence
cacggcaacctaaggaatcgctca

SEQ ID NO: 3060 - DNA, 24 bp, Artificial Sequence
  Description of Artificial Sequence:  Hypothetical Probe Sequence
cacggcaagatgttgagacccgaa

SEQ ID NO: 3061 - DNA, 24 bp, Artificial Sequence
  Description of Artificial Sequence:  Hypothetical Probe Sequence
cacggcaatccccctacgaaacct

SEQ ID NO: 3062 - DNA, 24 bp, Artificial Sequence
  Description of Artificial Sequence:  Hypothetical Probe Sequence
cacggcaatgcgtctgcacgtgat

SEQ ID NO: 3063 - DNA, 24 bp, Artificial Sequence
  Description of Artificial Sequence:  Hypothetical Probe Sequence
cacggcaacacggtgcatcgtctg

SEQ ID NO: 3064 - DNA, 24 bp, Artificial Sequence
  Description of Artificial Sequence:  Hypothetical Probe Sequence
cacgagtggcttatcgcgttagcc

SEQ ID NO: 3065 - DNA, 24 bp, Artificial Sequence
  Description of Artificial Sequence:  Hypothetical Probe Sequence
cacgagtggatgaggatgcgcagc

SEQ ID NO: 3066 - DNA, 24 bp, Artificial Sequence
  Description of Artificial Sequence:  Hypothetical Probe Sequence
cacgagtgtcccgcaaccattccc

SEQ ID NO: 3067 - DNA, 24 bp, Artificial Sequence
  Description of Artificial Sequence:  Hypothetical Probe Sequence
cacgagtggaccaatccagccacg

SEQ ID NO: 3068 - DNA, 24 bp, Artificial Sequence
  Description of Artificial Sequence:  Hypothetical Probe Sequence
cacgaccttgatggaccgaatccc

SEQ ID NO: 3069 - DNA, 24 bp, Artificial Sequence
  Description of Artificial Sequence:  Hypothetical Probe Sequence
cacgaccttctgcgaaacggcagc

SEQ ID NO: 3070 - DNA, 24 bp, Artificial Sequence
  Description of Artificial Sequence:  Hypothetical Probe Sequence
cacgaccttcgtgcaaagccagtg

SEQ ID NO: 3071 - DNA, 24 bp, Artificial Sequence
  Description of Artificial Sequence:  Hypothetical Probe Sequence
cacgacctccatatcggaccgtgc

SEQ ID NO: 3072 - DNA, 24 bp, Artificial Sequence
  Description of Artificial Sequence:  Hypothetical Probe Sequence
cacgacctatcgtgcgtgcgggac

SEQ ID NO: 3073 - DNA, 24 bp, Artificial Sequence
  Description of Artificial Sequence:  Hypothetical Probe Sequence
cacgacctgatgtgcggacccttg

SEQ ID NO: 3074 - DNA, 24 bp, Artificial Sequence
  Description of Artificial Sequence:  Hypothetical Probe Sequence
cacgacctggacggtacacgcagc

SEQ ID NO: 3075 - DNA, 24 bp, Artificial Sequence
  Description of Artificial Sequence:  Hypothetical Probe Sequence
cacgatcgaatcacgggaccgtct

SEQ ID NO: 3076 - DNA, 24 bp, Artificial Sequence
  Description of Artificial Sequence:  Hypothetical Probe Sequence
cacgatcgctgtagtgatcgccat

SEQ ID NO: 3077 - DNA, 24 bp, Artificial Sequence
  Description of Artificial Sequence:  Hypothetical Probe Sequence
cacgatcgggtatacaacggtccc

SEQ ID NO: 3078 - DNA, 24 bp, Artificial Sequence
  Description of Artificial Sequence:  Hypothetical Probe Sequence
cacgatcggtctcttgtccccgaa

SEQ ID NO: 3079 - DNA, 24 bp, Artificial Sequence
  Description of Artificial Sequence:  Hypothetical Probe Sequence
cacgatcgagtgccatcagcgcaa

SEQ ID NO: 3080 - DNA, 24 bp, Artificial Sequence
  Description of Artificial Sequence:  Hypothetical Probe Sequence
cacgatcgacctcgaaacggtgtc

SEQ ID NO: 3081 - DNA, 24 bp, Artificial Sequence
  Description of Artificial Sequence:  Hypothetical Probe Sequence
cacgatcgagccgatgagccacct

SEQ ID NO: 3082 - DNA, 24 bp, Artificial Sequence
  Description of Artificial Sequence:  Hypothetical Probe Sequence
cacgaggaaaaggcaatcccgagt

SEQ ID NO: 3083 - DNA, 24 bp, Artificial Sequence
  Description of Artificial Sequence:  Hypothetical Probe Sequence
cacgaggatcgtcttgacggctgt

SEQ ID NO: 3084 - DNA, 24 bp, Artificial Sequence
  Description of Artificial Sequence:  Hypothetical Probe Sequence
cacgaggacttgtgcgctcagacc

SEQ ID NO: 3085 - DNA, 24 bp, Artificial Sequence
  Description of Artificial Sequence:  Hypothetical Probe Sequence
cacgaggaccattccccagcgacc

SEQ ID NO: 3086 - DNA, 24 bp, Artificial Sequence
  Description of Artificial Sequence:  Hypothetical Probe Sequence
cacgaggaaccttgcgaaagctgt

SEQ ID NO: 3087 - DNA, 24 bp, Artificial Sequence
  Description of Artificial Sequence:  Hypothetical Probe Sequence
cacgaggacacggcttctcaagcc

SEQ ID NO: 3088 - DNA, 24 bp, Artificial Sequence
  Description of Artificial Sequence:  Hypothetical Probe Sequence
cacgaggacagcgcttcagctccc

SEQ ID NO: 3089 - DNA, 24 bp, Artificial Sequence
  Description of Artificial Sequence:  Hypothetical Probe Sequence
cacgaggaggacagtggacccgtt

SEQ ID NO: 3090 - DNA, 24 bp, Artificial Sequence
  Description of Artificial Sequence:  Hypothetical Probe Sequence
cacgaggaagccttgaacggtcgt

SEQ ID NO: 3091 - DNA, 24 bp, Artificial Sequence
  Description of Artificial Sequence:  Hypothetical Probe Sequence
cacgcctaaatcgaccatcggtgc

SEQ ID NO: 3092 - DNA, 24 bp, Artificial Sequence
  Description of Artificial Sequence:  Hypothetical Probe Sequence
cacgcctagcttcgttagcctcgt

SEQ ID NO: 3093 - DNA, 24 bp, Artificial Sequence
  Description of Artificial Sequence:  Hypothetical Probe Sequence
cacgcctaatcgtgcgtctgctgt

SEQ ID NO: 3094 - DNA, 24 bp, Artificial Sequence
  Description of Artificial Sequence:  Hypothetical Probe Sequence
cacgcctagatgggtacagcgtgc

SEQ ID NO: 3095 - DNA, 24 bp, Artificial Sequence
  Description of Artificial Sequence:  Hypothetical Probe Sequence
cacggatgtcgtcttgggacgctt

SEQ ID NO: 3096 - DNA, 24 bp, Artificial Sequence
  Description of Artificial Sequence:  Hypothetical Probe Sequence
cacggatgcttgtcccccattgat

SEQ ID NO: 3097 - DNA, 24 bp, Artificial Sequence
  Description of Artificial Sequence:  Hypothetical Probe Sequence
cacggatgctcagctttgtcccat

SEQ ID NO: 3098 - DNA, 24 bp, Artificial Sequence
  Description of Artificial Sequence:  Hypothetical Probe Sequence
cacggatgggtatcgtagccctgt

SEQ ID NO: 3099 - DNA, 24 bp, Artificial Sequence
  Description of Artificial Sequence:  Hypothetical Probe Sequence
cacggatggagtcagccctaagcc

SEQ ID NO: 3100 - DNA, 24 bp, Artificial Sequence
  Description of Artificial Sequence:  Hypothetical Probe Sequence
cacggatgcagcgaccagtgggac

SEQ ID NO: 3101 - DNA, 24 bp, Artificial Sequence
  Description of Artificial Sequence:  Hypothetical Probe Sequence
cacggatggtgccgttcacgtgtc

SEQ ID NO: 3102 - DNA, 24 bp, Artificial Sequence
  Description of Artificial Sequence:  Hypothetical Probe Sequence
cacgtcccaatcgtgcgcaatctg

SEQ ID NO: 3103 - DNA, 24 bp, Artificial Sequence
  Description of Artificial Sequence:  Hypothetical Probe Sequence
cacgtccctctggtgcagccacct

SEQ ID NO: 3104 - DNA, 24 bp, Artificial Sequence
  Description of Artificial Sequence:  Hypothetical Probe Sequence
cacgtcccgcttggtaggtagacc

SEQ ID NO: 3105 - DNA, 24 bp, Artificial Sequence
  Description of Artificial Sequence:  Hypothetical Probe Sequence
cacgtcccggtagcttgatgggac

SEQ ID NO: 3106 - DNA, 24 bp, Artificial Sequence
  Description of Artificial Sequence:  Hypothetical Probe Sequence
cacgtccctgcgggtacttgccat

SEQ ID NO: 3107 - DNA, 24 bp, Artificial Sequence
  Description of Artificial Sequence:  Hypothetical Probe Sequence
cacgtcccacggtgatctcaatcg

SEQ ID NO: 3108 - DNA, 24 bp, Artificial Sequence
  Description of Artificial Sequence:  Hypothetical Probe Sequence
cacgtgcgttgaagtgcgttgacc

SEQ ID NO: 3109 - DNA, 24 bp, Artificial Sequence
  Description of Artificial Sequence:  Hypothetical Probe Sequence
cacgtgcgatacacggggacgagt

SEQ ID NO: 3110 - DNA, 24 bp, Artificial Sequence
  Description of Artificial Sequence:  Hypothetical Probe Sequence
cacgtgcgtacatcccaggacgaa

SEQ ID NO: 3111 - DNA, 24 bp, Artificial Sequence
  Description of Artificial Sequence:  Hypothetical Probe Sequence
cacgtgcgtctgcgtttctgcagc

SEQ ID NO: 3112 - DNA, 24 bp, Artificial Sequence
  Description of Artificial Sequence:  Hypothetical Probe Sequence
cacgtgcgtgtctcgttcgtccta

SEQ ID NO: 3113 - DNA, 24 bp, Artificial Sequence
  Description of Artificial Sequence:  Hypothetical Probe Sequence
cacgtgcggcttcctatctggtgc

SEQ ID NO: 3114 - DNA, 24 bp, Artificial Sequence
  Description of Artificial Sequence:  Hypothetical Probe Sequence
cacgtgcgggtaagtgcacgagtg

SEQ ID NO: 3115 - DNA, 24 bp, Artificial Sequence
  Description of Artificial Sequence:  Hypothetical Probe Sequence
cacgtgcggagtcgttgagtcacg

SEQ ID NO: 3116 - DNA, 24 bp, Artificial Sequence
  Description of Artificial Sequence:  Hypothetical Probe Sequence
cacgtgcggcaaggtacagccttg

SEQ ID NO: 3117 - DNA, 24 bp, Artificial Sequence
  Description of Artificial Sequence:  Hypothetical Probe Sequence
cacgtgcgagtgccatgacccttg

SEQ ID NO: 3118 - DNA, 24 bp, Artificial Sequence
  Description of Artificial Sequence:  Hypothetical Probe Sequence
cacgtgcgatcgaaagagcctcgt

SEQ ID NO: 3119 - DNA, 24 bp, Artificial Sequence
  Description of Artificial Sequence:  Hypothetical Probe Sequence
cacgtgcgcctactgtgaccacgg

SEQ ID NO: 3120 - DNA, 24 bp, Artificial Sequence
  Description of Artificial Sequence:  Hypothetical Probe Sequence
cacgtgcgtgcggcaatacatgcg

SEQ ID NO: 3121 - DNA, 24 bp, Artificial Sequence
  Description of Artificial Sequence:  Hypothetical Probe Sequence
cacgtgcgacggcctaaaagtccc

SEQ ID NO: 3122 - DNA, 24 bp, Artificial Sequence
  Description of Artificial Sequence:  Hypothetical Probe Sequence
cacgcacgttgaaatctcccctgt

SEQ ID NO: 3123 - DNA, 24 bp, Artificial Sequence
  Description of Artificial Sequence:  Hypothetical Probe Sequence
cacgcacgtctggcttcagcgtct

SEQ ID NO: 3124 - DNA, 24 bp, Artificial Sequence
  Description of Artificial Sequence:  Hypothetical Probe Sequence
cacgcacgtcgtctcatgcggagt

SEQ ID NO: 3125 - DNA, 24 bp, Artificial Sequence
  Description of Artificial Sequence:  Hypothetical Probe Sequence
cacgcacgccataaagaaaggctt

SEQ ID NO: 3126 - DNA, 24 bp, Artificial Sequence
  Description of Artificial Sequence:  Hypothetical Probe Sequence
cacgcacggtcttacacgtttgcg

SEQ ID NO: 3127 - DNA, 24 bp, Artificial Sequence
  Description of Artificial Sequence:  Hypothetical Probe Sequence
cacgcacgatcgcagcaatcagga

SEQ ID NO: 3128 - DNA, 24 bp, Artificial Sequence
  Description of Artificial Sequence:  Hypothetical Probe Sequence
cacgcacgcagccgaagagtcagc

SEQ ID NO: 3129 - DNA, 24 bp, Artificial Sequence
  Description of Artificial Sequence:  Hypothetical Probe Sequence
cacgcacggaccgaccgtctttga

SEQ ID NO: 3130 - DNA, 24 bp, Artificial Sequence
  Description of Artificial Sequence:  Hypothetical Probe Sequence
cacgcagcttagcacggtgcgacc

SEQ ID NO: 3131 - DNA, 24 bp, Artificial Sequence
  Description of Artificial Sequence:  Hypothetical Probe Sequence
cacgcagctctgcagcccatggta

SEQ ID NO: 3132 - DNA, 24 bp, Artificial Sequence
  Description of Artificial Sequence:  Hypothetical Probe Sequence
cacgcagccttgggtaaaagagcc

SEQ ID NO: 3133 - DNA, 24 bp, Artificial Sequence
  Description of Artificial Sequence:  Hypothetical Probe Sequence
cacgcagcctcaacggacggatac

SEQ ID NO: 3134 - DNA, 24 bp, Artificial Sequence
  Description of Artificial Sequence:  Hypothetical Probe Sequence
cacgcagcggtacgttatcgctca

SEQ ID NO: 3135 - DNA, 24 bp, Artificial Sequence
  Description of Artificial Sequence:  Hypothetical Probe Sequence
cacgcagcgtctgagttcccctca

SEQ ID NO: 3136 - DNA, 24 bp, Artificial Sequence
  Description of Artificial Sequence:  Hypothetical Probe Sequence
cacgcagcacctttgatcgtacgg

SEQ ID NO: 3137 - DNA, 24 bp, Artificial Sequence
  Description of Artificial Sequence:  Hypothetical Probe Sequence
cacgcagcatcgcctagaccccta

SEQ ID NO: 3138 - DNA, 24 bp, Artificial Sequence
  Description of Artificial Sequence:  Hypothetical Probe Sequence
cacgcagcgatgggtagaccgatg

SEQ ID NO: 3139 - DNA, 24 bp, Artificial Sequence
  Description of Artificial Sequence:  Hypothetical Probe Sequence
cacgcagctccccttggtgcagtg

SEQ ID NO: 3140 - DNA, 24 bp, Artificial Sequence
  Description of Artificial Sequence:  Hypothetical Probe Sequence
cacggaccaatctgcgacctacgg

SEQ ID NO: 3141 - DNA, 24 bp, Artificial Sequence
  Description of Artificial Sequence:  Hypothetical Probe Sequence
cacggacctctgcgttcacgatcg

SEQ ID NO: 3142 - DNA, 24 bp, Artificial Sequence
  Description of Artificial Sequence:  Hypothetical Probe Sequence
cacggaccccatgatggtgcgtct

SEQ ID NO: 3143 - DNA, 24 bp, Artificial Sequence
  Description of Artificial Sequence:  Hypothetical Probe Sequence
cacggaccgcaatcgtcttggatg

SEQ ID NO: 3144 - DNA, 24 bp, Artificial Sequence
  Description of Artificial Sequence:  Hypothetical Probe Sequence
cacggaccatcgaatccgaatgtc

SEQ ID NO: 3145 - DNA, 24 bp, Artificial Sequence
  Description of Artificial Sequence:  Hypothetical Probe Sequence
cacggaccaggaggtatgtctgcg

SEQ ID NO: 3146 - DNA, 24 bp, Artificial Sequence
  Description of Artificial Sequence:  Hypothetical Probe Sequence
cacggaccgatgttagccatcgaa

SEQ ID NO: 3147 - DNA, 24 bp, Artificial Sequence
  Description of Artificial Sequence:  Hypothetical Probe Sequence
cacggtgcttagacgggtgccttg

SEQ ID NO: 3148 - DNA, 24 bp, Artificial Sequence
  Description of Artificial Sequence:  Hypothetical Probe Sequence
cacggtgcaatcccatcacgctgt

SEQ ID NO: 3149 - DNA, 24 bp, Artificial Sequence
  Description of Artificial Sequence:  Hypothetical Probe Sequence
cacggtgcaaagaaagcagcccta

SEQ ID NO: 3150 - DNA, 24 bp, Artificial Sequence
  Description of Artificial Sequence:  Hypothetical Probe Sequence
cacggtgctctgcttgcgaaccat

SEQ ID NO: 3151 - DNA, 24 bp, Artificial Sequence
  Description of Artificial Sequence:  Hypothetical Probe Sequence
cacggtgccttgcgaactcacacg

SEQ ID NO: 3152 - DNA, 24 bp, Artificial Sequence
  Description of Artificial Sequence:  Hypothetical Probe Sequence
cacggtgcctcaacctctcaacgg

SEQ ID NO: 3153 - DNA, 24 bp, Artificial Sequence
  Description of Artificial Sequence:  Hypothetical Probe Sequence
cacggtgccgaaaggagaccacct

SEQ ID NO: 3154 - DNA, 24 bp, Artificial Sequence
  Description of Artificial Sequence:  Hypothetical Probe Sequence
cacggtgcgagtgcaaagccttag

SEQ ID NO: 3155 - DNA, 24 bp, Artificial Sequence
  Description of Artificial Sequence:  Hypothetical Probe Sequence
cacggtgcacctaggagcaagtgc

SEQ ID NO: 3156 - DNA, 24 bp, Artificial Sequence
  Description of Artificial Sequence:  Hypothetical Probe Sequence
cacggtgcaggaatcgaggaggac

SEQ ID NO: 3157 - DNA, 24 bp, Artificial Sequence
  Description of Artificial Sequence:  Hypothetical Probe Sequence
cacggtgccctaacctcctatccc

SEQ ID NO: 3158 - DNA, 24 bp, Artificial Sequence
  Description of Artificial Sequence:  Hypothetical Probe Sequence
cacggtgctccccagcctgtgatg

SEQ ID NO: 3159 - DNA, 24 bp, Artificial Sequence
  Description of Artificial Sequence:  Hypothetical Probe Sequence
cacggtgctgcgtgatgtgcagga

SEQ ID NO: 3160 - DNA, 24 bp, Artificial Sequence
  Description of Artificial Sequence:  Hypothetical Probe Sequence
cacggtgcggacgtgcagcctgat

SEQ ID NO: 3161 - DNA, 24 bp, Artificial Sequence
  Description of Artificial Sequence:  Hypothetical Probe Sequence
cacgggacttgagcttcgtttgcg

SEQ ID NO: 3162 - DNA, 24 bp, Artificial Sequence
  Description of Artificial Sequence:  Hypothetical Probe Sequence
cacgggacaatcttgaagccgagt

SEQ ID NO: 3163 - DNA, 24 bp, Artificial Sequence
  Description of Artificial Sequence:  Hypothetical Probe Sequence
cacgggacatacagccaccttccc

SEQ ID NO: 3164 - DNA, 24 bp, Artificial Sequence
  Description of Artificial Sequence:  Hypothetical Probe Sequence
cacgggacctcactcagcttgtgc

SEQ ID NO: 3165 - DNA, 24 bp, Artificial Sequence
  Description of Artificial Sequence:  Hypothetical Probe Sequence
cacgggacctgtcttgagtgcacg

SEQ ID NO: 3166 - DNA, 24 bp, Artificial Sequence
  Description of Artificial Sequence:  Hypothetical Probe Sequence
cacgggacgagtttgaatcgatcg

SEQ ID NO: 3167 - DNA, 24 bp, Artificial Sequence
  Description of Artificial Sequence:  Hypothetical Probe Sequence
cacgggaccctagtgcggacaatc

SEQ ID NO: 3168 - DNA, 24 bp, Artificial Sequence
  Description of Artificial Sequence:  Hypothetical Probe Sequence
cacgggacgaccacggtgatggta

SEQ ID NO: 3169 - DNA, 24 bp, Artificial Sequence
  Description of Artificial Sequence:  Hypothetical Probe Sequence
cacgacggaatctcgttgattccc

SEQ ID NO: 3170 - DNA, 24 bp, Artificial Sequence
  Description of Artificial Sequence:  Hypothetical Probe Sequence
cacgacggtacaagcccagcttga

SEQ ID NO: 3171 - DNA, 24 bp, Artificial Sequence
  Description of Artificial Sequence:  Hypothetical Probe Sequence
cacgacggtgtcgtgcgtgcaatc

SEQ ID NO: 3172 - DNA, 24 bp, Artificial Sequence
  Description of Artificial Sequence:  Hypothetical Probe Sequence
cacgacggagtgcttgttgatgcg

SEQ ID NO: 3173 - DNA, 24 bp, Artificial Sequence
  Description of Artificial Sequence:  Hypothetical Probe Sequence
cacgacggatcgcgtttcgtctca

SEQ ID NO: 3174 - DNA, 24 bp, Artificial Sequence
  Description of Artificial Sequence:  Hypothetical Probe Sequence
cacgacggcagctctggcttctca

SEQ ID NO: 3175 - DNA, 24 bp, Artificial Sequence
  Description of Artificial Sequence:  Hypothetical Probe Sequence
cacgacggggacaggaaatccttg

SEQ ID NO: 3176 - DNA, 24 bp, Artificial Sequence
  Description of Artificial Sequence:  Hypothetical Probe Sequence
cacgagccaaagtgcggagtgtct

SEQ ID NO: 3177 - DNA, 24 bp, Artificial Sequence
  Description of Artificial Sequence:  Hypothetical Probe Sequence
cacgagcctacaacggtgcgaaag

SEQ ID NO: 3178 - DNA, 24 bp, Artificial Sequence
  Description of Artificial Sequence:  Hypothetical Probe Sequence
cacgagcctctgaatcgcttcacg

SEQ ID NO: 3179 - DNA, 24 bp, Artificial Sequence
  Description of Artificial Sequence:  Hypothetical Probe Sequence
cacgagcctgtcagcccctattga

SEQ ID NO: 3180 - DNA, 24 bp, Artificial Sequence
  Description of Artificial Sequence:  Hypothetical Probe Sequence
cacgagccctcacgttggacgtct

SEQ ID NO: 3181 - DNA, 24 bp, Artificial Sequence
  Description of Artificial Sequence:  Hypothetical Probe Sequence
cacgagccgcttacctaggaatcg

SEQ ID NO: 3182 - DNA, 24 bp, Artificial Sequence
  Description of Artificial Sequence:  Hypothetical Probe Sequence
cacgagccagtgcgttagcccttg

SEQ ID NO: 3183 - DNA, 24 bp, Artificial Sequence
  Description of Artificial Sequence:  Hypothetical Probe Sequence
cacgagccacctcagcagtgcagc

SEQ ID NO: 3184 - DNA, 24 bp, Artificial Sequence
  Description of Artificial Sequence:  Hypothetical Probe Sequence
cacgagcctgcggaccggactgat

SEQ ID NO: 3185 - DNA, 24 bp, Artificial Sequence
  Description of Artificial Sequence:  Hypothetical Probe Sequence
cacgagcccacggcaacagctctg

SEQ ID NO: 3186 - DNA, 24 bp, Artificial Sequence
  Description of Artificial Sequence:  Hypothetical Probe Sequence
cacgagccgtgcgagtcttgtgcg

SEQ ID NO: 3187 - DNA, 24 bp, Artificial Sequence
  Description of Artificial Sequence:  Hypothetical Probe Sequence
cacgagccggacctcatcgtcagc

SEQ ID NO: 3188 - DNA, 24 bp, Artificial Sequence
  Description of Artificial Sequence:  Hypothetical Probe Sequence
cagcttgagtgccgaaagccggac

SEQ ID NO: 3189 - DNA, 24 bp, Artificial Sequence
  Description of Artificial Sequence:  Hypothetical Probe Sequence
cagctgatgcttggacagcccagc

SEQ ID NO: 3190 - DNA, 24 bp, Artificial Sequence
  Description of Artificial Sequence:  Hypothetical Probe Sequence
cagctgatgcaacacgcttggtgc

SEQ ID NO: 3191 - DNA, 24 bp, Artificial Sequence
  Description of Artificial Sequence:  Hypothetical Probe Sequence
cagctgattcccagtgcacggtgc

SEQ ID NO: 3192 - DNA, 24 bp, Artificial Sequence
  Description of Artificial Sequence:  Hypothetical Probe Sequence
cagcaatctcgtacggcacgcgtt

SEQ ID NO: 3193 - DNA, 24 bp, Artificial Sequence
  Description of Artificial Sequence:  Hypothetical Probe Sequence
cagcaatcctcacgttagccgtgc

SEQ ID NO: 3194 - DNA, 24 bp, Artificial Sequence
  Description of Artificial Sequence:  Hypothetical Probe Sequence
cagcaatcggtaacggcttgctgt

SEQ ID NO: 3195 - DNA, 24 bp, Artificial Sequence
  Description of Artificial Sequence:  Hypothetical Probe Sequence
cagcaatcgtcttccccagctccc

SEQ ID NO: 3196 - DNA, 24 bp, Artificial Sequence
  Description of Artificial Sequence:  Hypothetical Probe Sequence
cagcaatcatcgaaagcacgcttg

SEQ ID NO: 3197 - DNA, 24 bp, Artificial Sequence
  Description of Artificial Sequence:  Hypothetical Probe Sequence
cagcatactcccacggacggcgaa

SEQ ID NO: 3198 - DNA, 24 bp, Artificial Sequence
  Description of Artificial Sequence:  Hypothetical Probe Sequence
cagcatactgcgcacgtgcgtccc

SEQ ID NO: 3199 - DNA, 24 bp, Artificial Sequence
  Description of Artificial Sequence:  Hypothetical Probe Sequence
cagcaaaggtgcgtctagccagcc

SEQ ID NO: 3200 - DNA, 24 bp, Artificial Sequence
  Description of Artificial Sequence:  Hypothetical Probe Sequence
cagcaaagacggcacgagtgagcc

SEQ ID NO: 3201 - DNA, 24 bp, Artificial Sequence
  Description of Artificial Sequence:  Hypothetical Probe Sequence
cagctctggatgagccacggcacg

SEQ ID NO: 3202 - DNA, 24 bp, Artificial Sequence
  Description of Artificial Sequence:  Hypothetical Probe Sequence
cagctgtccttgtcccgctttccc

SEQ ID NO: 3203 - DNA, 24 bp, Artificial Sequence
  Description of Artificial Sequence:  Hypothetical Probe Sequence
cagctgtcctcatgcgtgcggacc

SEQ ID NO: 3204 - DNA, 24 bp, Artificial Sequence
  Description of Artificial Sequence:  Hypothetical Probe Sequence
cagctgtcgtgcccatgcaaccta

SEQ ID NO: 3205 - DNA, 24 bp, Artificial Sequence
  Description of Artificial Sequence:  Hypothetical Probe Sequence
cagctgtcagcccgaaacctacgg

SEQ ID NO: 3206 - DNA, 24 bp, Artificial Sequence
  Description of Artificial Sequence:  Hypothetical Probe Sequence
cagctcgttcccgcttggacaaag

SEQ ID NO: 3207 - DNA, 24 bp, Artificial Sequence
  Description of Artificial Sequence:  Hypothetical Probe Sequence
cagctcgtcagctcgtgagttgcg

SEQ ID NO: 3208 - DNA, 24 bp, Artificial Sequence
  Description of Artificial Sequence:  Hypothetical Probe Sequence
cagccttgaaaggcttagcctgcg

SEQ ID NO: 3209 - DNA, 24 bp, Artificial Sequence
  Description of Artificial Sequence:  Hypothetical Probe Sequence
cagccttgtctggaccagccctgt

SEQ ID NO: 3210 - DNA, 24 bp, Artificial Sequence
  Description of Artificial Sequence:  Hypothetical Probe Sequence
cagccttgtcgtatacgtgcgacc

SEQ ID NO: 3211 - DNA, 24 bp, Artificial Sequence
  Description of Artificial Sequence:  Hypothetical Probe Sequence
cagccttgagtggacctgcgggta

SEQ ID NO: 3212 - DNA, 24 bp, Artificial Sequence
  Description of Artificial Sequence:  Hypothetical Probe Sequence
cagccttgaggagcaagaccacgg

SEQ ID NO: 3213 - DNA, 24 bp, Artificial Sequence
  Description of Artificial Sequence:  Hypothetical Probe Sequence
cagccttgtcccctcaatcgagcc

SEQ ID NO: 3214 - DNA, 24 bp, Artificial Sequence
  Description of Artificial Sequence:  Hypothetical Probe Sequence
cagccttggacccgttcgttgatg

SEQ ID NO: 3215 - DNA, 24 bp, Artificial Sequence
  Description of Artificial Sequence:  Hypothetical Probe Sequence
cagccttgacgggcaagtctcgaa

SEQ ID NO: 3216 - DNA, 24 bp, Artificial Sequence
  Description of Artificial Sequence:  Hypothetical Probe Sequence
cagccgtttacatctgtccccgtt

SEQ ID NO: 3217 - DNA, 24 bp, Artificial Sequence
  Description of Artificial Sequence:  Hypothetical Probe Sequence
cagccgtttctgaaagcagcagga

SEQ ID NO: 3218 - DNA, 24 bp, Artificial Sequence
  Description of Artificial Sequence:  Hypothetical Probe Sequence
cagccgttgcttagccctcatctg

SEQ ID NO: 3219 - DNA, 24 bp, Artificial Sequence
  Description of Artificial Sequence:  Hypothetical Probe Sequence
cagccgttggtaacctgaccctca

SEQ ID NO: 3220 - DNA, 24 bp, Artificial Sequence
  Description of Artificial Sequence:  Hypothetical Probe Sequence
cagccgttgcaaatcggtctccat

SEQ ID NO: 3221 - DNA, 24 bp, Artificial Sequence
  Description of Artificial Sequence:  Hypothetical Probe Sequence
cagccgttatcggatgaccttccc

SEQ ID NO: 3222 - DNA, 24 bp, Artificial Sequence
  Description of Artificial Sequence:  Hypothetical Probe Sequence
cagccgttcctaacggataccacg

SEQ ID NO: 3223 - DNA, 24 bp, Artificial Sequence
  Description of Artificial Sequence:  Hypothetical Probe Sequence
cagccgttgtgctcgtaaaggcaa

SEQ ID NO: 3224 - DNA, 24 bp, Artificial Sequence
  Description of Artificial Sequence:  Hypothetical Probe Sequence
cagccgttggacgatggcttgatg

SEQ ID NO: 3225 - DNA, 24 bp, Artificial Sequence
  Description of Artificial Sequence:  Hypothetical Probe Sequence
cagccgttagccgcttagccaaag

SEQ ID NO: 3226 - DNA, 24 bp, Artificial Sequence
  Description of Artificial Sequence:  Hypothetical Probe Sequence
cagcctcatcgtaaaggtgcgctt

SEQ ID NO: 3227 - DNA, 24 bp, Artificial Sequence
  Description of Artificial Sequence:  Hypothetical Probe Sequence
cagcctcaccatcagcgtgcgagt

SEQ ID NO: 3228 - DNA, 24 bp, Artificial Sequence
  Description of Artificial Sequence:  Hypothetical Probe Sequence
cagcctcacgaacgaacgttccat

SEQ ID NO: 3229 - DNA, 24 bp, Artificial Sequence
  Description of Artificial Sequence:  Hypothetical Probe Sequence
cagcctcagctttcgtgcaatccc

SEQ ID NO: 3230 - DNA, 24 bp, Artificial Sequence
  Description of Artificial Sequence:  Hypothetical Probe Sequence
cagcctcagcaagaccgagtcacg

SEQ ID NO: 3231 - DNA, 24 bp, Artificial Sequence
  Description of Artificial Sequence:  Hypothetical Probe Sequence
cagcctcaacctaatcgaccgctt

SEQ ID NO: 3232 - DNA, 24 bp, Artificial Sequence
  Description of Artificial Sequence:  Hypothetical Probe Sequence
cagcctcatcccgaccaaagtccc

SEQ ID NO: 3233 - DNA, 24 bp, Artificial Sequence
  Description of Artificial Sequence:  Hypothetical Probe Sequence
cagcctcagacctgattccctgcg

SEQ ID NO: 3234 - DNA, 24 bp, Artificial Sequence
  Description of Artificial Sequence:  Hypothetical Probe Sequence
cagcctgtttgatcgtttgaacgg

SEQ ID NO: 3235 - DNA, 24 bp, Artificial Sequence
  Description of Artificial Sequence:  Hypothetical Probe Sequence
cagcctgttgatcgaatcccgtgc

SEQ ID NO: 3236 - DNA, 24 bp, Artificial Sequence
  Description of Artificial Sequence:  Hypothetical Probe Sequence
cagcctgttctgcgttgcaaacgg

SEQ ID NO: 3237 - DNA, 24 bp, Artificial Sequence
  Description of Artificial Sequence:  Hypothetical Probe Sequence
cagcctgtctcaagccggacgacc

SEQ ID NO: 3238 - DNA, 24 bp, Artificial Sequence
  Description of Artificial Sequence:  Hypothetical Probe Sequence
cagcctgtccatctcatgcggctt

SEQ ID NO: 3239 - DNA, 24 bp, Artificial Sequence
  Description of Artificial Sequence:  Hypothetical Probe Sequence
cagcctgtgcttctcatcccgatg

SEQ ID NO: 3240 - DNA, 24 bp, Artificial Sequence
  Description of Artificial Sequence:  Hypothetical Probe Sequence
cagcctgtgtgccgaagcttacct

SEQ ID NO: 3241 - DNA, 24 bp, Artificial Sequence
  Description of Artificial Sequence:  Hypothetical Probe Sequence
cagcccattacacacgcacgtccc

SEQ ID NO: 3242 - DNA, 24 bp, Artificial Sequence
  Description of Artificial Sequence:  Hypothetical Probe Sequence
cagcccattctgccatccatagcc

SEQ ID NO: 3243 - DNA, 24 bp, Artificial Sequence
  Description of Artificial Sequence:  Hypothetical Probe Sequence
cagcccatcttgtgatcacggctt

SEQ ID NO: 3244 - DNA, 24 bp, Artificial Sequence
  Description of Artificial Sequence:  Hypothetical Probe Sequence
cagcccatcgttgcttccatccat

SEQ ID NO: 3245 - DNA, 24 bp, Artificial Sequence
  Description of Artificial Sequence:  Hypothetical Probe Sequence
cagcccatgtctccatgaccacgg

SEQ ID NO: 3246 - DNA, 24 bp, Artificial Sequence
  Description of Artificial Sequence:  Hypothetical Probe Sequence
cagcccatgagtgcttagccacgg

SEQ ID NO: 3247 - DNA, 24 bp, Artificial Sequence
  Description of Artificial Sequence:  Hypothetical Probe Sequence
cagcccatgcaatctgctcacacg

SEQ ID NO: 3248 - DNA, 24 bp, Artificial Sequence
  Description of Artificial Sequence:  Hypothetical Probe Sequence
cagcccatcctaacggccatacct

SEQ ID NO: 3249 - DNA, 24 bp, Artificial Sequence
  Description of Artificial Sequence:  Hypothetical Probe Sequence
cagcccatcacgaaaggcttgacc

SEQ ID NO: 3250 - DNA, 24 bp, Artificial Sequence
  Description of Artificial Sequence:  Hypothetical Probe Sequence
cagcccatacgggagtgtgcggta

SEQ ID NO: 3251 - DNA, 24 bp, Artificial Sequence
  Description of Artificial Sequence:  Hypothetical Probe Sequence
cagccgaatctgaaagcgaacacg

SEQ ID NO: 3252 - DNA, 24 bp, Artificial Sequence
  Description of Artificial Sequence:  Hypothetical Probe Sequence
cagccgaatgtccgttcttgtccc

SEQ ID NO: 3253 - DNA, 24 bp, Artificial Sequence
  Description of Artificial Sequence:  Hypothetical Probe Sequence
cagccgaagtcttgcgaatcgatg

SEQ ID NO: 3254 - DNA, 24 bp, Artificial Sequence
  Description of Artificial Sequence:  Hypothetical Probe Sequence
cagccgaaagtgatacgtgcgcaa

SEQ ID NO: 3255 - DNA, 24 bp, Artificial Sequence
  Description of Artificial Sequence:  Hypothetical Probe Sequence
cagccgaaaggatgtcatcgagcc

SEQ ID NO: 3256 - DNA, 24 bp, Artificial Sequence
  Description of Artificial Sequence:  Hypothetical Probe Sequence
cagccgaatgcgcttggcaatgtc

SEQ ID NO: 3257 - DNA, 24 bp, Artificial Sequence
  Description of Artificial Sequence:  Hypothetical Probe Sequence
cagccgaacacggcttgctttgat

SEQ ID NO: 3258 - DNA, 24 bp, Artificial Sequence
  Description of Artificial Sequence:  Hypothetical Probe Sequence
cagccgaagacccacgatacgtgc

SEQ ID NO: 3259 - DNA, 24 bp, Artificial Sequence
  Description of Artificial Sequence:  Hypothetical Probe Sequence
cagccgaaacggcacgtgtcatcg

SEQ ID NO: 3260 - DNA, 24 bp, Artificial Sequence
  Description of Artificial Sequence:  Hypothetical Probe Sequence
cagccgaaagccggtagatgcgtt

SEQ ID NO: 3261 - DNA, 24 bp, Artificial Sequence
  Description of Artificial Sequence:  Hypothetical Probe Sequence
cagcgcttaatctgcgtctgccat

SEQ ID NO: 3262 - DNA, 24 bp, Artificial Sequence
  Description of Artificial Sequence:  Hypothetical Probe Sequence
cagcgctttacacgtttgtccagc

SEQ ID NO: 3263 - DNA, 24 bp, Artificial Sequence
  Description of Artificial Sequence:  Hypothetical Probe Sequence
cagcgctttgtccgaaaaagacgg

SEQ ID NO: 3264 - DNA, 24 bp, Artificial Sequence
  Description of Artificial Sequence:  Hypothetical Probe Sequence
cagcgctttcgttcgtttgaatcg

SEQ ID NO: 3265 - DNA, 24 bp, Artificial Sequence
  Description of Artificial Sequence:  Hypothetical Probe Sequence
cagcgcttctcaggacccatccta

SEQ ID NO: 3266 - DNA, 24 bp, Artificial Sequence
  Description of Artificial Sequence:  Hypothetical Probe Sequence
cagcgcttctgtcgaagtgccagc

SEQ ID NO: 3267 - DNA, 24 bp, Artificial Sequence
  Description of Artificial Sequence:  Hypothetical Probe Sequence
cagcgcttatcgcgaaaatcctca

SEQ ID NO: 3268 - DNA, 24 bp, Artificial Sequence
  Description of Artificial Sequence:  Hypothetical Probe Sequence
cagcgctttgcggcttgagttcgt

SEQ ID NO: 3269 - DNA, 24 bp, Artificial Sequence
  Description of Artificial Sequence:  Hypothetical Probe Sequence
cagcgcttagccttgacttggtgc

SEQ ID NO: 3270 - DNA, 24 bp, Artificial Sequence
  Description of Artificial Sequence:  Hypothetical Probe Sequence
cagcggtaccatccatgaccggta

SEQ ID NO: 3271 - DNA, 24 bp, Artificial Sequence
  Description of Artificial Sequence:  Hypothetical Probe Sequence
cagcggtacgaacgaacttgctca

SEQ ID NO: 3272 - DNA, 24 bp, Artificial Sequence
  Description of Artificial Sequence:  Hypothetical Probe Sequence
cagcggtacagcacctgcttgcaa

SEQ ID NO: 3273 - DNA, 24 bp, Artificial Sequence
  Description of Artificial Sequence:  Hypothetical Probe Sequence
cagcgtcttgatggaccagccagc

SEQ ID NO: 3274 - DNA, 24 bp, Artificial Sequence
  Description of Artificial Sequence:  Hypothetical Probe Sequence
cagcgtctccatctcatcgttgcg

SEQ ID NO: 3275 - DNA, 24 bp, Artificial Sequence
  Description of Artificial Sequence:  Hypothetical Probe Sequence
cagcgtctcgaatcgttccctcgt

SEQ ID NO: 3276 - DNA, 24 bp, Artificial Sequence
  Description of Artificial Sequence:  Hypothetical Probe Sequence
cagcgtctgcttatcgtcccacgg

SEQ ID NO: 3277 - DNA, 24 bp, Artificial Sequence
  Description of Artificial Sequence:  Hypothetical Probe Sequence
cagcgtcttgcgaggagatggacc

SEQ ID NO: 3278 - DNA, 24 bp, Artificial Sequence
  Description of Artificial Sequence:  Hypothetical Probe Sequence
cagcgtctggacttgaatcgcgaa

SEQ ID NO: 3279 - DNA, 24 bp, Artificial Sequence
  Description of Artificial Sequence:  Hypothetical Probe Sequence
cagcgtctacggaatcacggggac

SEQ ID NO: 3280 - DNA, 24 bp, Artificial Sequence
  Description of Artificial Sequence:  Hypothetical Probe Sequence
cagcgagttctgcagcgatggctt

SEQ ID NO: 3281 - DNA, 24 bp, Artificial Sequence
  Description of Artificial Sequence:  Hypothetical Probe Sequence
cagcgagtcttggcaacacgcgaa

SEQ ID NO: 3282 - DNA, 24 bp, Artificial Sequence
  Description of Artificial Sequence:  Hypothetical Probe Sequence
cagcgagtcgttatcgtgtcacgg

SEQ ID NO: 3283 - DNA, 24 bp, Artificial Sequence
  Description of Artificial Sequence:  Hypothetical Probe Sequence
cagcgagtcgaaaggacgaaagcc

SEQ ID NO: 3284 - DNA, 24 bp, Artificial Sequence
  Description of Artificial Sequence:  Hypothetical Probe Sequence
cagcgagtgtgcgacctgcgtgat

SEQ ID NO: 3285 - DNA, 24 bp, Artificial Sequence
  Description of Artificial Sequence:  Hypothetical Probe Sequence
cagcgcaatgatcgaaatcgggta

SEQ ID NO: 3286 - DNA, 24 bp, Artificial Sequence
  Description of Artificial Sequence:  Hypothetical Probe Sequence
cagcgcaaatacaatccagcggac

SEQ ID NO: 3287 - DNA, 24 bp, Artificial Sequence
  Description of Artificial Sequence:  Hypothetical Probe Sequence
cagcgcaatctggcttgatgggta

SEQ ID NO: 3288 - DNA, 24 bp, Artificial Sequence
  Description of Artificial Sequence:  Hypothetical Probe Sequence
cagcgcaatgtccgttggacctgt

SEQ ID NO: 3289 - DNA, 24 bp, Artificial Sequence
  Description of Artificial Sequence:  Hypothetical Probe Sequence
cagcgcaaccatggtaatcgagga

SEQ ID NO: 3290 - DNA, 24 bp, Artificial Sequence
  Description of Artificial Sequence:  Hypothetical Probe Sequence
cagcgcaacgaatcgtcttgagga

SEQ ID NO: 3291 - DNA, 24 bp, Artificial Sequence
  Description of Artificial Sequence:  Hypothetical Probe Sequence
cagcgcaaggtagcaagaccggta

SEQ ID NO: 3292 - DNA, 24 bp, Artificial Sequence
  Description of Artificial Sequence:  Hypothetical Probe Sequence
cagcgcaagagtcgttcttggacc

SEQ ID NO: 3293 - DNA, 24 bp, Artificial Sequence
  Description of Artificial Sequence:  Hypothetical Probe Sequence
cagcgcaaagtgtgattcccccta

SEQ ID NO: 3294 - DNA, 24 bp, Artificial Sequence
  Description of Artificial Sequence:  Hypothetical Probe Sequence
cagcgcaaggacgatggaccaaag

SEQ ID NO: 3295 - DNA, 24 bp, Artificial Sequence
  Description of Artificial Sequence:  Hypothetical Probe Sequence
cagcgcaaacggtcgtcacgaatc

SEQ ID NO: 3296 - DNA, 24 bp, Artificial Sequence
  Description of Artificial Sequence:  Hypothetical Probe Sequence
cagcagtgtcgtgtgctccccacg

SEQ ID NO: 3297 - DNA, 24 bp, Artificial Sequence
  Description of Artificial Sequence:  Hypothetical Probe Sequence
cagcagtggcttgtgcctgttccc

SEQ ID NO: 3298 - DNA, 24 bp, Artificial Sequence
  Description of Artificial Sequence:  Hypothetical Probe Sequence
cagcagtgcctaatcgcacgctgt

SEQ ID NO: 3299 - DNA, 24 bp, Artificial Sequence
  Description of Artificial Sequence:  Hypothetical Probe Sequence
cagcagtgtccccttgccattcgt

SEQ ID NO: 3300 - DNA, 24 bp, Artificial Sequence
  Description of Artificial Sequence:  Hypothetical Probe Sequence
cagcagtgggacgtctacggtgcg

SEQ ID NO: 3301 - DNA, 24 bp, Artificial Sequence
  Description of Artificial Sequence:  Hypothetical Probe Sequence
cagcacctcgaaaatctgcggatg

SEQ ID NO: 3302 - DNA, 24 bp, Artificial Sequence
  Description of Artificial Sequence:  Hypothetical Probe Sequence
cagcacctcacgtctgcgaagcaa

SEQ ID NO: 3303 - DNA, 24 bp, Artificial Sequence
  Description of Artificial Sequence:  Hypothetical Probe Sequence
cagcacctgtgcgacctgtccgaa

SEQ ID NO: 3304 - DNA, 24 bp, Artificial Sequence
  Description of Artificial Sequence:  Hypothetical Probe Sequence
cagcacctggacgcttgtgcagga

SEQ ID NO: 3305 - DNA, 24 bp, Artificial Sequence
  Description of Artificial Sequence:  Hypothetical Probe Sequence
cagcatcggcttacctgtgcatcg

SEQ ID NO: 3306 - DNA, 24 bp, Artificial Sequence
  Description of Artificial Sequence:  Hypothetical Probe Sequence
cagcatcgggtaagtgagccgctt

SEQ ID NO: 3307 - DNA, 24 bp, Artificial Sequence
  Description of Artificial Sequence:  Hypothetical Probe Sequence
cagcatcgatcggcaatctggtgc

SEQ ID NO: 3308 - DNA, 24 bp, Artificial Sequence
  Description of Artificial Sequence:  Hypothetical Probe Sequence
cagcatcgacggcacgggtaagtg

SEQ ID NO: 3309 - DNA, 24 bp, Artificial Sequence
  Description of Artificial Sequence:  Hypothetical Probe Sequence
cagcaggaaatcacggtccctccc

SEQ ID NO: 3310 - DNA, 24 bp, Artificial Sequence
  Description of Artificial Sequence:  Hypothetical Probe Sequence
cagcaggatcgtgtctcgaatgcg

SEQ ID NO: 3311 - DNA, 24 bp, Artificial Sequence
  Description of Artificial Sequence:  Hypothetical Probe Sequence
cagcaggacttgacggcacgccta

SEQ ID NO: 3312 - DNA, 24 bp, Artificial Sequence
  Description of Artificial Sequence:  Hypothetical Probe Sequence
cagcaggagcaaatcggtgctcgt

SEQ ID NO: 3313 - DNA, 24 bp, Artificial Sequence
  Description of Artificial Sequence:  Hypothetical Probe Sequence
cagcaggaagtgtgcgctgtcacg

SEQ ID NO: 3314 - DNA, 24 bp, Artificial Sequence
  Description of Artificial Sequence:  Hypothetical Probe Sequence
cagcaggacacggatggcttacgg

SEQ ID NO: 3315 - DNA, 24 bp, Artificial Sequence
  Description of Artificial Sequence:  Hypothetical Probe Sequence
cagcaggagtgctctgggactccc

SEQ ID NO: 3316 - DNA, 24 bp, Artificial Sequence
  Description of Artificial Sequence:  Hypothetical Probe Sequence
cagcaggaagccatacggacagga

SEQ ID NO: 3317 - DNA, 24 bp, Artificial Sequence
  Description of Artificial Sequence:  Hypothetical Probe Sequence
cagccctatcgtgctttgtcgcaa

SEQ ID NO: 3318 - DNA, 24 bp, Artificial Sequence
  Description of Artificial Sequence:  Hypothetical Probe Sequence
cagccctacgaatctgcagctccc

SEQ ID NO: 3319 - DNA, 24 bp, Artificial Sequence
  Description of Artificial Sequence:  Hypothetical Probe Sequence
cagccctagcaaatactccctgcg

SEQ ID NO: 3320 - DNA, 24 bp, Artificial Sequence
  Description of Artificial Sequence:  Hypothetical Probe Sequence
cagccctaagtgagccgtcttccc

SEQ ID NO: 3321 - DNA, 24 bp, Artificial Sequence
  Description of Artificial Sequence:  Hypothetical Probe Sequence
cagccctaaccttcccagccgagt

SEQ ID NO: 3322 - DNA, 24 bp, Artificial Sequence
  Description of Artificial Sequence:  Hypothetical Probe Sequence
cagccctaacggtcgtctgtgcaa

SEQ ID NO: 3323 - DNA, 24 bp, Artificial Sequence
  Description of Artificial Sequence:  Hypothetical Probe Sequence
cagcgatgaatccacgggaccgtt

SEQ ID NO: 3324 - DNA, 24 bp, Artificial Sequence
  Description of Artificial Sequence:  Hypothetical Probe Sequence
cagcgatgtctgacctatcgcgaa

SEQ ID NO: 3325 - DNA, 24 bp, Artificial Sequence
  Description of Artificial Sequence:  Hypothetical Probe Sequence
cagcgatgtgtcccatgctttgcg

SEQ ID NO: 3326 - DNA, 24 bp, Artificial Sequence
  Description of Artificial Sequence:  Hypothetical Probe Sequence
cagcgatgcttgctgtcttgcgtt

SEQ ID NO: 3327 - DNA, 24 bp, Artificial Sequence
  Description of Artificial Sequence:  Hypothetical Probe Sequence
cagcgatgctcagtgctctgagcc

SEQ ID NO: 3328 - DNA, 24 bp, Artificial Sequence
  Description of Artificial Sequence:  Hypothetical Probe Sequence
cagcgatggtcttgattcccgcaa

SEQ ID NO: 3329 - DNA, 24 bp, Artificial Sequence
  Description of Artificial Sequence:  Hypothetical Probe Sequence
cagcgatgaggatcgttcgtgacc

SEQ ID NO: 3330 - DNA, 24 bp, Artificial Sequence
  Description of Artificial Sequence:  Hypothetical Probe Sequence
cagcgatgcctagcaacctaacgg

SEQ ID NO: 3331 - DNA, 24 bp, Artificial Sequence
  Description of Artificial Sequence:  Hypothetical Probe Sequence
cagcgatgtccccttgcctacgtt

SEQ ID NO: 3332 - DNA, 24 bp, Artificial Sequence
  Description of Artificial Sequence:  Hypothetical Probe Sequence
cagcgatggaccgatgagtgcgtt

SEQ ID NO: 3333 - DNA, 24 bp, Artificial Sequence
  Description of Artificial Sequence:  Hypothetical Probe Sequence
cagcgatgacgggatgtcgttccc

SEQ ID NO: 3334 - DNA, 24 bp, Artificial Sequence
  Description of Artificial Sequence:  Hypothetical Probe Sequence
cagcgatgagccctgtgcaatcgt

SEQ ID NO: 3335 - DNA, 24 bp, Artificial Sequence
  Description of Artificial Sequence:  Hypothetical Probe Sequence
cagctcccaaagtcccctgtagcc

SEQ ID NO: 3336 - DNA, 24 bp, Artificial Sequence
  Description of Artificial Sequence:  Hypothetical Probe Sequence
cagctccccgttaaagatcggacc

SEQ ID NO: 3337 - DNA, 24 bp, Artificial Sequence
  Description of Artificial Sequence:  Hypothetical Probe Sequence
cagctcccctgtatcgcgttccta

SEQ ID NO: 3338 - DNA, 24 bp, Artificial Sequence
  Description of Artificial Sequence:  Hypothetical Probe Sequence
cagctccccgaaatcgtgtcgatg

SEQ ID NO: 3339 - DNA, 24 bp, Artificial Sequence
  Description of Artificial Sequence:  Hypothetical Probe Sequence
cagctcccgagtgcttttgaagcc

SEQ ID NO: 3340 - DNA, 24 bp, Artificial Sequence
  Description of Artificial Sequence:  Hypothetical Probe Sequence
cagctcccagtgttagacggccat

SEQ ID NO: 3341 - DNA, 24 bp, Artificial Sequence
  Description of Artificial Sequence:  Hypothetical Probe Sequence
cagctcccacctacctggacgtct

SEQ ID NO: 3342 - DNA, 24 bp, Artificial Sequence
  Description of Artificial Sequence:  Hypothetical Probe Sequence
cagctcccgatggtcttcgtcgtt

SEQ ID NO: 3343 - DNA, 24 bp, Artificial Sequence
  Description of Artificial Sequence:  Hypothetical Probe Sequence
cagctccctcccgagttcccgagt

SEQ ID NO: 3344 - DNA, 24 bp, Artificial Sequence
  Description of Artificial Sequence:  Hypothetical Probe Sequence
cagctccctgcgaatcaggacgaa

SEQ ID NO: 3345 - DNA, 24 bp, Artificial Sequence
  Description of Artificial Sequence:  Hypothetical Probe Sequence
cagctccccacggatgatcgatcg

SEQ ID NO: 3346 - DNA, 24 bp, Artificial Sequence
  Description of Artificial Sequence:  Hypothetical Probe Sequence
cagctcccacggtcgttgtccttg

SEQ ID NO: 3347 - DNA, 24 bp, Artificial Sequence
  Description of Artificial Sequence:  Hypothetical Probe Sequence
cagctgcgttgagtgccgttgtct

SEQ ID NO: 3348 - DNA, 24 bp, Artificial Sequence
  Description of Artificial Sequence:  Hypothetical Probe Sequence
cagctgcgttagtctgggaccgaa

SEQ ID NO: 3349 - DNA, 24 bp, Artificial Sequence
  Description of Artificial Sequence:  Hypothetical Probe Sequence
cagctgcgataccgaaagcccgtt

SEQ ID NO: 3350 - DNA, 24 bp, Artificial Sequence
  Description of Artificial Sequence:  Hypothetical Probe Sequence
cagctgcgtctggacccagcacct

SEQ ID NO: 3351 - DNA, 24 bp, Artificial Sequence
  Description of Artificial Sequence:  Hypothetical Probe Sequence
cagctgcgacctaatcagcctcgt

SEQ ID NO: 3352 - DNA, 24 bp, Artificial Sequence
  Description of Artificial Sequence:  Hypothetical Probe Sequence
cagctgcgatcggctttgatgcaa

SEQ ID NO: 3353 - DNA, 24 bp, Artificial Sequence
  Description of Artificial Sequence:  Hypothetical Probe Sequence
cagctgcggatggcttgagtcagc

SEQ ID NO: 3354 - DNA, 24 bp, Artificial Sequence
  Description of Artificial Sequence:  Hypothetical Probe Sequence
cagctgcgtccctgtccacgttga

SEQ ID NO: 3355 - DNA, 24 bp, Artificial Sequence
  Description of Artificial Sequence:  Hypothetical Probe Sequence
cagctgcgcacgcttgacggtctg

SEQ ID NO: 3356 - DNA, 24 bp, Artificial Sequence
  Description of Artificial Sequence:  Hypothetical Probe Sequence
cagccacgttgattaggaccgcaa

SEQ ID NO: 3357 - DNA, 24 bp, Artificial Sequence
  Description of Artificial Sequence:  Hypothetical Probe Sequence
cagccacgaatcgagttgcggagt

SEQ ID NO: 3358 - DNA, 24 bp, Artificial Sequence
  Description of Artificial Sequence:  Hypothetical Probe Sequence
cagccacgataccgaaggacggac

SEQ ID NO: 3359 - DNA, 24 bp, Artificial Sequence
  Description of Artificial Sequence:  Hypothetical Probe Sequence
cagccacgtctgtgtctcccacgg

SEQ ID NO: 3360 - DNA, 24 bp, Artificial Sequence
  Description of Artificial Sequence:  Hypothetical Probe Sequence
cagccacgtcgtgcaagtcttctg

SEQ ID NO: 3361 - DNA, 24 bp, Artificial Sequence
  Description of Artificial Sequence:  Hypothetical Probe Sequence
cagccacgcgttcgttccatctgt

SEQ ID NO: 3362 - DNA, 24 bp, Artificial Sequence
  Description of Artificial Sequence:  Hypothetical Probe Sequence
cagccacgcgaagtgcaatcgtct

SEQ ID NO: 3363 - DNA, 24 bp, Artificial Sequence
  Description of Artificial Sequence:  Hypothetical Probe Sequence
cagccacgcctatccccctatgtc

SEQ ID NO: 3364 - DNA, 24 bp, Artificial Sequence
  Description of Artificial Sequence:  Hypothetical Probe Sequence
cagccagcttgaggacggtatccc

SEQ ID NO: 3365 - DNA, 24 bp, Artificial Sequence
  Description of Artificial Sequence:  Hypothetical Probe Sequence
cagccagcttaggaccgtgctccc

SEQ ID NO: 3366 - DNA, 24 bp, Artificial Sequence
  Description of Artificial Sequence:  Hypothetical Probe Sequence
cagccagctgtcacggaggagtgc

SEQ ID NO: 3367 - DNA, 24 bp, Artificial Sequence
  Description of Artificial Sequence:  Hypothetical Probe Sequence
cagccagcctcaatacggtatgcg

SEQ ID NO: 3368 - DNA, 24 bp, Artificial Sequence
  Description of Artificial Sequence:  Hypothetical Probe Sequence
cagccagcccatatcgatactgcg

SEQ ID NO: 3369 - DNA, 24 bp, Artificial Sequence
  Description of Artificial Sequence:  Hypothetical Probe Sequence
cagccagcaggacgttcgaattga

SEQ ID NO: 3370 - DNA, 24 bp, Artificial Sequence
  Description of Artificial Sequence:  Hypothetical Probe Sequence
cagccagcgatgttagggacgtct

SEQ ID NO: 3371 - DNA, 24 bp, Artificial Sequence
  Description of Artificial Sequence:  Hypothetical Probe Sequence
cagccagctcccggtacttgagcc

SEQ ID NO: 3372 - DNA, 24 bp, Artificial Sequence
  Description of Artificial Sequence:  Hypothetical Probe Sequence
cagccagcagcccttggatgctca

SEQ ID NO: 3373 - DNA, 24 bp, Artificial Sequence
  Description of Artificial Sequence:  Hypothetical Probe Sequence
cagcgaccaatcatacagcccacg

SEQ ID NO: 3374 - DNA, 24 bp, Artificial Sequence
  Description of Artificial Sequence:  Hypothetical Probe Sequence
cagcgacctcgtaggagcaaccat

SEQ ID NO: 3375 - DNA, 24 bp, Artificial Sequence
  Description of Artificial Sequence:  Hypothetical Probe Sequence
cagcgacccttgcctagacccacg

SEQ ID NO: 3376 - DNA, 24 bp, Artificial Sequence
  Description of Artificial Sequence:  Hypothetical Probe Sequence
cagcgaccgcaacacggtctcttg

SEQ ID NO: 3377 - DNA, 24 bp, Artificial Sequence
  Description of Artificial Sequence:  Hypothetical Probe Sequence
cagcgaccatcgtacacagcccat

SEQ ID NO: 3378 - DNA, 24 bp, Artificial Sequence
  Description of Artificial Sequence:  Hypothetical Probe Sequence
cagcgacctcccaatcggacgagt

SEQ ID NO: 3379 - DNA, 24 bp, Artificial Sequence
  Description of Artificial Sequence:  Hypothetical Probe Sequence
cagcgacccacggctttacatccc

SEQ ID NO: 3380 - DNA, 24 bp, Artificial Sequence
  Description of Artificial Sequence:  Hypothetical Probe Sequence
cagcgaccgacctcgtctgtcgtt

SEQ ID NO: 3381 - DNA, 24 bp, Artificial Sequence
  Description of Artificial Sequence:  Hypothetical Probe Sequence
cagcgaccagccaggaaatccagc

SEQ ID NO: 3382 - DNA, 24 bp, Artificial Sequence
  Description of Artificial Sequence:  Hypothetical Probe Sequence
cagcgtgcatactgcgaaagagcc

SEQ ID NO: 3383 - DNA, 24 bp, Artificial Sequence
  Description of Artificial Sequence:  Hypothetical Probe Sequence
cagcgtgctacaagtgcacgggta

SEQ ID NO: 3384 - DNA, 24 bp, Artificial Sequence
  Description of Artificial Sequence:  Hypothetical Probe Sequence
cagcgtgctctggatggcaatccc

SEQ ID NO: 3385 - DNA, 24 bp, Artificial Sequence
  Description of Artificial Sequence:  Hypothetical Probe Sequence
cagcgtgctcgtagtgacggccta

SEQ ID NO: 3386 - DNA, 24 bp, Artificial Sequence
  Description of Artificial Sequence:  Hypothetical Probe Sequence
cagcgtgcctgtaatctgcgtgtc

SEQ ID NO: 3387 - DNA, 24 bp, Artificial Sequence
  Description of Artificial Sequence:  Hypothetical Probe Sequence
cagcgtgccgaactgtgcttcagc

SEQ ID NO: 3388 - DNA, 24 bp, Artificial Sequence
  Description of Artificial Sequence:  Hypothetical Probe Sequence
cagcgtgcgtctcttgcttgctca

SEQ ID NO: 3389 - DNA, 24 bp, Artificial Sequence
  Description of Artificial Sequence:  Hypothetical Probe Sequence
cagcgtgcaccttcgtcacgacct

SEQ ID NO: 3390 - DNA, 24 bp, Artificial Sequence
  Description of Artificial Sequence:  Hypothetical Probe Sequence
cagcgtgccacgcttgtcgtgtgc

SEQ ID NO: 3391 - DNA, 24 bp, Artificial Sequence
  Description of Artificial Sequence:  Hypothetical Probe Sequence
cagcgtgcgacccacggatgttga

SEQ ID NO: 3392 - DNA, 24 bp, Artificial Sequence
  Description of Artificial Sequence:  Hypothetical Probe Sequence
cagcgtgcggacatcgtgatacgg

SEQ ID NO: 3393 - DNA, 24 bp, Artificial Sequence
  Description of Artificial Sequence:  Hypothetical Probe Sequence
cagcgtgcacggcagcgagtctca

SEQ ID NO: 3394 - DNA, 24 bp, Artificial Sequence
  Description of Artificial Sequence:  Hypothetical Probe Sequence
cagcgtgcagccctcaacggtctg

SEQ ID NO: 3395 - DNA, 24 bp, Artificial Sequence
  Description of Artificial Sequence:  Hypothetical Probe Sequence
cagcggactgatagccaggacacg

SEQ ID NO: 3396 - DNA, 24 bp, Artificial Sequence
  Description of Artificial Sequence:  Hypothetical Probe Sequence
cagcggacaatcaaaggcaaccat

SEQ ID NO: 3397 - DNA, 24 bp, Artificial Sequence
  Description of Artificial Sequence:  Hypothetical Probe Sequence
cagcggactgtcaatccgaaagcc

SEQ ID NO: 3398 - DNA, 24 bp, Artificial Sequence
  Description of Artificial Sequence:  Hypothetical Probe Sequence
cagcggacgagtcgaagcttagga

SEQ ID NO: 3399 - DNA, 24 bp, Artificial Sequence
  Description of Artificial Sequence:  Hypothetical Probe Sequence
cagcggacaccttacaagccagcc

SEQ ID NO: 3400 - DNA, 24 bp, Artificial Sequence
  Description of Artificial Sequence:  Hypothetical Probe Sequence
cagcggacgatgggacacctcgaa

SEQ ID NO: 3401 - DNA, 24 bp, Artificial Sequence
  Description of Artificial Sequence:  Hypothetical Probe Sequence
cagcggactgcggtctggacgacc

SEQ ID NO: 3402 - DNA, 24 bp, Artificial Sequence
  Description of Artificial Sequence:  Hypothetical Probe Sequence
cagcggaccacgccatgctttgtc

SEQ ID NO: 3403 - DNA, 24 bp, Artificial Sequence
  Description of Artificial Sequence:  Hypothetical Probe Sequence
cagcggaccagccctaccatcagc

SEQ ID NO: 3404 - DNA, 24 bp, Artificial Sequence
  Description of Artificial Sequence:  Hypothetical Probe Sequence
cagcggacacggcgaactgtgtgc

SEQ ID NO: 3405 - DNA, 24 bp, Artificial Sequence
  Description of Artificial Sequence:  Hypothetical Probe Sequence
cagcacggttgaaatccctaacgg

SEQ ID NO: 3406 - DNA, 24 bp, Artificial Sequence
  Description of Artificial Sequence:  Hypothetical Probe Sequence
cagcacggtgatgatgcgttagcc

SEQ ID NO: 3407 - DNA, 24 bp, Artificial Sequence
  Description of Artificial Sequence:  Hypothetical Probe Sequence
cagcacggaatctctgggtatgcg

SEQ ID NO: 3408 - DNA, 24 bp, Artificial Sequence
  Description of Artificial Sequence:  Hypothetical Probe Sequence
cagcacggatacaaagcacgtcgt

SEQ ID NO: 3409 - DNA, 24 bp, Artificial Sequence
  Description of Artificial Sequence:  Hypothetical Probe Sequence
cagcacggctgtgaccgcttagtg

SEQ ID NO: 3410 - DNA, 24 bp, Artificial Sequence
  Description of Artificial Sequence:  Hypothetical Probe Sequence
cagcacggcgaagcttgatgagga

SEQ ID NO: 3411 - DNA, 24 bp, Artificial Sequence
  Description of Artificial Sequence:  Hypothetical Probe Sequence
cagcacgggcttgtctcctatgcg

SEQ ID NO: 3412 - DNA, 24 bp, Artificial Sequence
  Description of Artificial Sequence:  Hypothetical Probe Sequence
cagcacggggtacgaatccctaca

SEQ ID NO: 3413 - DNA, 24 bp, Artificial Sequence
  Description of Artificial Sequence:  Hypothetical Probe Sequence
cagcacgggagtatcgagtgagcc

SEQ ID NO: 3414 - DNA, 24 bp, Artificial Sequence
  Description of Artificial Sequence:  Hypothetical Probe Sequence
cagcacggaccttctgcgttccat

SEQ ID NO: 3415 - DNA, 24 bp, Artificial Sequence
  Description of Artificial Sequence:  Hypothetical Probe Sequence
cagcacggatcgtcccagtgacct

SEQ ID NO: 3416 - DNA, 24 bp, Artificial Sequence
  Description of Artificial Sequence:  Hypothetical Probe Sequence
cagcacggaggaacctgagtgcaa

SEQ ID NO: 3417 - DNA, 24 bp, Artificial Sequence
  Description of Artificial Sequence:  Hypothetical Probe Sequence
cagcacggagccacctgtgcctgt

SEQ ID NO: 3418 - DNA, 24 bp, Artificial Sequence
  Description of Artificial Sequence:  Hypothetical Probe Sequence
cagcagcctgataaagagccacgg

SEQ ID NO: 3419 - DNA, 24 bp, Artificial Sequence
  Description of Artificial Sequence:  Hypothetical Probe Sequence
cagcagccaatccttggtgcctca

SEQ ID NO: 3420 - DNA, 24 bp, Artificial Sequence
  Description of Artificial Sequence:  Hypothetical Probe Sequence
cagcagcctctgtcgtggacccta

SEQ ID NO: 3421 - DNA, 24 bp, Artificial Sequence
  Description of Artificial Sequence:  Hypothetical Probe Sequence
cagcagcctgtcgtgcgcaagacc

SEQ ID NO: 3422 - DNA, 24 bp, Artificial Sequence
  Description of Artificial Sequence:  Hypothetical Probe Sequence
cagcagcccgttcctaaggaacct

SEQ ID NO: 3423 - DNA, 24 bp, Artificial Sequence
  Description of Artificial Sequence:  Hypothetical Probe Sequence
cagcagccgtctcttgctcagcaa

SEQ ID NO: 3424 - DNA, 24 bp, Artificial Sequence
  Description of Artificial Sequence:  Hypothetical Probe Sequence
cagcagccgagtgagtcacgcgtt

SEQ ID NO: 3425 - DNA, 24 bp, Artificial Sequence
  Description of Artificial Sequence:  Hypothetical Probe Sequence
cagcagccacctgatgtgtcgcaa

SEQ ID NO: 3426 - DNA, 24 bp, Artificial Sequence
  Description of Artificial Sequence:  Hypothetical Probe Sequence
cagcagccgatgatcgctcacagc

SEQ ID NO: 3427 - DNA, 24 bp, Artificial Sequence
  Description of Artificial Sequence:  Hypothetical Probe Sequence
cagcagccgacctacatcccgtct

SEQ ID NO: 3428 - DNA, 24 bp, Artificial Sequence
  Description of Artificial Sequence:  Hypothetical Probe Sequence
gaccttaggcaaacggcacgcgaa

SEQ ID NO: 3429 - DNA, 24 bp, Artificial Sequence
  Description of Artificial Sequence:  Hypothetical Probe Sequence
gaccaatccgaacgaacgaaacgg

SEQ ID NO: 3430 - DNA, 24 bp, Artificial Sequence
  Description of Artificial Sequence:  Hypothetical Probe Sequence
gaccaatcggacgtgcggactcgt

SEQ ID NO: 3431 - DNA, 24 bp, Artificial Sequence
  Description of Artificial Sequence:  Hypothetical Probe Sequence
gaccaaagcgttagccctgtcagc

SEQ ID NO: 3432 - DNA, 24 bp, Artificial Sequence
  Description of Artificial Sequence:  Hypothetical Probe Sequence
gaccaaagatcgcgttgtgctgcg

SEQ ID NO: 3433 - DNA, 24 bp, Artificial Sequence
  Description of Artificial Sequence:  Hypothetical Probe Sequence
gaccaaaggatgcacggacctgcg

SEQ ID NO: 3434 - DNA, 24 bp, Artificial Sequence
  Description of Artificial Sequence:  Hypothetical Probe Sequence
gaccaaagggacgaccaggaacgg

SEQ ID NO: 3435 - DNA, 24 bp, Artificial Sequence
  Description of Artificial Sequence:  Hypothetical Probe Sequence
gacctctggtgccagcgcttggac

SEQ ID NO: 3436 - DNA, 24 bp, Artificial Sequence
  Description of Artificial Sequence:  Hypothetical Probe Sequence
gacctctgacggcgtttcgttccc

SEQ ID NO: 3437 - DNA, 24 bp, Artificial Sequence
  Description of Artificial Sequence:  Hypothetical Probe Sequence
gacctgtcgtgcaaagccatgacc

SEQ ID NO: 3438 - DNA, 24 bp, Artificial Sequence
  Description of Artificial Sequence:  Hypothetical Probe Sequence
gacctcgtcgaatgcggtctgtgc

SEQ ID NO: 3439 - DNA, 24 bp, Artificial Sequence
  Description of Artificial Sequence:  Hypothetical Probe Sequence
gacctcgtggtatcccgtgcgagt

SEQ ID NO: 3440 - DNA, 24 bp, Artificial Sequence
  Description of Artificial Sequence:  Hypothetical Probe Sequence
gacctcgtcacggcttacggctgt

SEQ ID NO: 3441 - DNA, 24 bp, Artificial Sequence
  Description of Artificial Sequence:  Hypothetical Probe Sequence
gacccttgcgaatcgttacatgcg

SEQ ID NO: 3442 - DNA, 24 bp, Artificial Sequence
  Description of Artificial Sequence:  Hypothetical Probe Sequence
gacccttgggtaccattcccccta

SEQ ID NO: 3443 - DNA, 24 bp, Artificial Sequence
  Description of Artificial Sequence:  Hypothetical Probe Sequence
gacccttgcagccctacagccagc

SEQ ID NO: 3444 - DNA, 24 bp, Artificial Sequence
  Description of Artificial Sequence:  Hypothetical Probe Sequence
gacccgtttacagtgcggacctgt

SEQ ID NO: 3445 - DNA, 24 bp, Artificial Sequence
  Description of Artificial Sequence:  Hypothetical Probe Sequence
gacccgtttctgcacggtctgacc

SEQ ID NO: 3446 - DNA, 24 bp, Artificial Sequence
  Description of Artificial Sequence:  Hypothetical Probe Sequence
gacccgttctcagctttcccgagt

SEQ ID NO: 3447 - DNA, 24 bp, Artificial Sequence
  Description of Artificial Sequence:  Hypothetical Probe Sequence
gacccgttggtacagcaatctgcg

SEQ ID NO: 3448 - DNA, 24 bp, Artificial Sequence
  Description of Artificial Sequence:  Hypothetical Probe Sequence
gacccgttagtgttgatgcgcacg

SEQ ID NO: 3449 - DNA, 24 bp, Artificial Sequence
  Description of Artificial Sequence:  Hypothetical Probe Sequence
gacccgttaggatcccccatcgaa

SEQ ID NO: 3450 - DNA, 24 bp, Artificial Sequence
  Description of Artificial Sequence:  Hypothetical Probe Sequence
gacccgttgatgatcgcagcccta

SEQ ID NO: 3451 - DNA, 24 bp, Artificial Sequence
  Description of Artificial Sequence:  Hypothetical Probe Sequence
gacccgtttgcgaatctgtcgctt

SEQ ID NO: 3452 - DNA, 24 bp, Artificial Sequence
  Description of Artificial Sequence:  Hypothetical Probe Sequence
gacccgttcacgtgatgcttcgaa

SEQ ID NO: 3453 - DNA, 24 bp, Artificial Sequence
  Description of Artificial Sequence:  Hypothetical Probe Sequence
gacccgttcagcggtatctgtgcg

SEQ ID NO: 3454 - DNA, 24 bp, Artificial Sequence
  Description of Artificial Sequence:  Hypothetical Probe Sequence
gacccgttgtgcggacacctcagc

SEQ ID NO: 3455 - DNA, 24 bp, Artificial Sequence
  Description of Artificial Sequence:  Hypothetical Probe Sequence
gaccctgtgcaaggtatgcgagga

SEQ ID NO: 3456 - DNA, 24 bp, Artificial Sequence
  Description of Artificial Sequence:  Hypothetical Probe Sequence
gaccccatttgagcaagtgcgacc

SEQ ID NO: 3457 - DNA, 24 bp, Artificial Sequence
  Description of Artificial Sequence:  Hypothetical Probe Sequence
gaccccatggtacttgtgcgcacg

SEQ ID NO: 3458 - DNA, 24 bp, Artificial Sequence
  Description of Artificial Sequence:  Hypothetical Probe Sequence
gaccccatcacggagtgacctgcg

SEQ ID NO: 3459 - DNA, 24 bp, Artificial Sequence
  Description of Artificial Sequence:  Hypothetical Probe Sequence
gaccccatacggggtacacggacc

SEQ ID NO: 3460 - DNA, 24 bp, Artificial Sequence
  Description of Artificial Sequence:  Hypothetical Probe Sequence
gacccgaattgaaggatccccgtt

SEQ ID NO: 3461 - DNA, 24 bp, Artificial Sequence
  Description of Artificial Sequence:  Hypothetical Probe Sequence
gacccgaaggtaccatcgaaagcc

SEQ ID NO: 3462 - DNA, 24 bp, Artificial Sequence
  Description of Artificial Sequence:  Hypothetical Probe Sequence
gacccgaaatcggcttctcacgtt

SEQ ID NO: 3463 - DNA, 24 bp, Artificial Sequence
  Description of Artificial Sequence:  Hypothetical Probe Sequence
gacccgaaacgggcttaggacacg

SEQ ID NO: 3464 - DNA, 24 bp, Artificial Sequence
  Description of Artificial Sequence:  Hypothetical Probe Sequence
gaccgctttgatggtaatcgccat

SEQ ID NO: 3465 - DNA, 24 bp, Artificial Sequence
  Description of Artificial Sequence:  Hypothetical Probe Sequence
gaccgctttgtcggaccagcgtgc

SEQ ID NO: 3466 - DNA, 24 bp, Artificial Sequence
  Description of Artificial Sequence:  Hypothetical Probe Sequence
gaccgcttctgtccatgagttgcg

SEQ ID NO: 3467 - DNA, 24 bp, Artificial Sequence
  Description of Artificial Sequence:  Hypothetical Probe Sequence
gaccgcttgcttacggaaaggatg

SEQ ID NO: 3468 - DNA, 24 bp, Artificial Sequence
  Description of Artificial Sequence:  Hypothetical Probe Sequence
gaccgcttatcgaatcggtatgcg

SEQ ID NO: 3469 - DNA, 24 bp, Artificial Sequence
  Description of Artificial Sequence:  Hypothetical Probe Sequence
gaccgcttcctaaggaagccgtct

SEQ ID NO: 3470 - DNA, 24 bp, Artificial Sequence
  Description of Artificial Sequence:  Hypothetical Probe Sequence
gaccgctttgcgtcgtgtgcacct

SEQ ID NO: 3471 - DNA, 24 bp, Artificial Sequence
  Description of Artificial Sequence:  Hypothetical Probe Sequence
gaccgcttgtgcaatccgttggta

SEQ ID NO: 3472 - DNA, 24 bp, Artificial Sequence
  Description of Artificial Sequence:  Hypothetical Probe Sequence
gaccggtattgatgcgacggacgg

SEQ ID NO: 3473 - DNA, 24 bp, Artificial Sequence
  Description of Artificial Sequence:  Hypothetical Probe Sequence
gaccggtacgttggacctcatgcg

SEQ ID NO: 3474 - DNA, 24 bp, Artificial Sequence
  Description of Artificial Sequence:  Hypothetical Probe Sequence
gaccggtacgaagaccggactcgt

SEQ ID NO: 3475 - DNA, 24 bp, Artificial Sequence
  Description of Artificial Sequence:  Hypothetical Probe Sequence
gaccggtagcttcacgaatcgcaa

SEQ ID NO: 3476 - DNA, 24 bp, Artificial Sequence
  Description of Artificial Sequence:  Hypothetical Probe Sequence
gaccggtaggtagctttccccacg

SEQ ID NO: 3477 - DNA, 24 bp, Artificial Sequence
  Description of Artificial Sequence:  Hypothetical Probe Sequence
gaccggtaaggaaggaacggccta

SEQ ID NO: 3478 - DNA, 24 bp, Artificial Sequence
  Description of Artificial Sequence:  Hypothetical Probe Sequence
gaccggtatgcgtgcgtgattctg

SEQ ID NO: 3479 - DNA, 24 bp, Artificial Sequence
  Description of Artificial Sequence:  Hypothetical Probe Sequence
gaccgtcttcgtttgaagccgcaa

SEQ ID NO: 3480 - DNA, 24 bp, Artificial Sequence
  Description of Artificial Sequence:  Hypothetical Probe Sequence
gaccgtctcgaacagcatcgtcgt

SEQ ID NO: 3481 - DNA, 24 bp, Artificial Sequence
  Description of Artificial Sequence:  Hypothetical Probe Sequence
gaccgtctgctttgatggacgctt

SEQ ID NO: 3482 - DNA, 24 bp, Artificial Sequence
  Description of Artificial Sequence:  Hypothetical Probe Sequence
gaccgtctgaccgtgccttgtccc

SEQ ID NO: 3483 - DNA, 24 bp, Artificial Sequence
  Description of Artificial Sequence:  Hypothetical Probe Sequence
gaccgagtggtaaaagacggcagc

SEQ ID NO: 3484 - DNA, 24 bp, Artificial Sequence
  Description of Artificial Sequence:  Hypothetical Probe Sequence
gaccgagtgtgccgttgcaaccat

SEQ ID NO: 3485 - DNA, 24 bp, Artificial Sequence
  Description of Artificial Sequence:  Hypothetical Probe Sequence
gaccgagtggacacggtcgtccat

SEQ ID NO: 3486 - DNA, 24 bp, Artificial Sequence
  Description of Artificial Sequence:  Hypothetical Probe Sequence
gaccgagtagccgatgcagcgatg

SEQ ID NO: 3487 - DNA, 24 bp, Artificial Sequence
  Description of Artificial Sequence:  Hypothetical Probe Sequence
gaccgcaatgatacggcgaacagc

SEQ ID NO: 3488 - DNA, 24 bp, Artificial Sequence
  Description of Artificial Sequence:  Hypothetical Probe Sequence
gaccgcaaaatctgtcctgttgcg

SEQ ID NO: 3489 - DNA, 24 bp, Artificial Sequence
  Description of Artificial Sequence:  Hypothetical Probe Sequence
gaccgcaatctgtgattcccggta

SEQ ID NO: 3490 - DNA, 24 bp, Artificial Sequence
  Description of Artificial Sequence:  Hypothetical Probe Sequence
gaccgcaacttgtgatgtgcgacc

SEQ ID NO: 3491 - DNA, 24 bp, Artificial Sequence
  Description of Artificial Sequence:  Hypothetical Probe Sequence
gaccgcaagcttttgatccccttg

SEQ ID NO: 3492 - DNA, 24 bp, Artificial Sequence
  Description of Artificial Sequence:  Hypothetical Probe Sequence
gaccgcaagtctcacgcgttcacg

SEQ ID NO: 3493 - DNA, 24 bp, Artificial Sequence
  Description of Artificial Sequence:  Hypothetical Probe Sequence
gaccgcaagagttgatggacacgg

SEQ ID NO: 3494 - DNA, 24 bp, Artificial Sequence
  Description of Artificial Sequence:  Hypothetical Probe Sequence
gaccgcaaagtggatggatgcgtt

SEQ ID NO: 3495 - DNA, 24 bp, Artificial Sequence
  Description of Artificial Sequence:  Hypothetical Probe Sequence
gaccgcaatcccccattccctgat

SEQ ID NO: 3496 - DNA, 24 bp, Artificial Sequence
  Description of Artificial Sequence:  Hypothetical Probe Sequence
gaccagtgtgcggagtgaccgcaa

SEQ ID NO: 3497 - DNA, 24 bp, Artificial Sequence
  Description of Artificial Sequence:  Hypothetical Probe Sequence
gaccagtgcacgctcacacggcaa

SEQ ID NO: 3498 - DNA, 24 bp, Artificial Sequence
  Description of Artificial Sequence:  Hypothetical Probe Sequence
gaccagtgagccgaccgacccgtt

SEQ ID NO: 3499 - DNA, 24 bp, Artificial Sequence
  Description of Artificial Sequence:  Hypothetical Probe Sequence
gaccacctcacggatgccatcacg

SEQ ID NO: 3500 - DNA, 24 bp, Artificial Sequence
  Description of Artificial Sequence:  Hypothetical Probe Sequence
gaccacctacgggcttagcccgaa

SEQ ID NO: 3501 - DNA, 24 bp, Artificial Sequence
  Description of Artificial Sequence:  Hypothetical Probe Sequence
gaccatcgctcaagccctcaggac

SEQ ID NO: 3502 - DNA, 24 bp, Artificial Sequence
  Description of Artificial Sequence:  Hypothetical Probe Sequence
gaccatcgcgaatcccctgtttga

SEQ ID NO: 3503 - DNA, 24 bp, Artificial Sequence
  Description of Artificial Sequence:  Hypothetical Probe Sequence
gaccaggaccatacggccattgat

SEQ ID NO: 3504 - DNA, 24 bp, Artificial Sequence
  Description of Artificial Sequence:  Hypothetical Probe Sequence
gaccaggaatcgcgaagatggacc

SEQ ID NO: 3505 - DNA, 24 bp, Artificial Sequence
  Description of Artificial Sequence:  Hypothetical Probe Sequence
gaccaggatcccgcttgagttccc

SEQ ID NO: 3506 - DNA, 24 bp, Artificial Sequence
  Description of Artificial Sequence:  Hypothetical Probe Sequence
gaccaggagtgccttggcttgcaa

SEQ ID NO: 3507 - DNA, 24 bp, Artificial Sequence
  Description of Artificial Sequence:  Hypothetical Probe Sequence
gacccctacttgccatcacggtgc

SEQ ID NO: 3508 - DNA, 24 bp, Artificial Sequence
  Description of Artificial Sequence:  Hypothetical Probe Sequence
gacccctacgttaggaacgggacc

SEQ ID NO: 3509 - DNA, 24 bp, Artificial Sequence
  Description of Artificial Sequence:  Hypothetical Probe Sequence
gacccctacgaaggtaagcccagc

SEQ ID NO: 3510 - DNA, 24 bp, Artificial Sequence
  Description of Artificial Sequence:  Hypothetical Probe Sequence
gacccctagcaacacgacggagcc

SEQ ID NO: 3511 - DNA, 24 bp, Artificial Sequence
  Description of Artificial Sequence:  Hypothetical Probe Sequence
gacccctagtgctgtcaggatgcg

SEQ ID NO: 3512 - DNA, 24 bp, Artificial Sequence
  Description of Artificial Sequence:  Hypothetical Probe Sequence
gacccctaggacagccgcaaccat

SEQ ID NO: 3513 - DNA, 24 bp, Artificial Sequence
  Description of Artificial Sequence:  Hypothetical Probe Sequence
gaccgatgatcgtgcgcctagtgc

SEQ ID NO: 3514 - DNA, 24 bp, Artificial Sequence
  Description of Artificial Sequence:  Hypothetical Probe Sequence
gaccgatgaggaatcgggacgatg

SEQ ID NO: 3515 - DNA, 24 bp, Artificial Sequence
  Description of Artificial Sequence:  Hypothetical Probe Sequence
gaccgatgtgcgtcgtatcgtcgt

SEQ ID NO: 3516 - DNA, 24 bp, Artificial Sequence
  Description of Artificial Sequence:  Hypothetical Probe Sequence
gaccgatgcagccctacacgatcg

SEQ ID NO: 3517 - DNA, 24 bp, Artificial Sequence
  Description of Artificial Sequence:  Hypothetical Probe Sequence
gaccgatggtgccagcaggaagga

SEQ ID NO: 3518 - DNA, 24 bp, Artificial Sequence
  Description of Artificial Sequence:  Hypothetical Probe Sequence
gaccgatgagcctctgggtaacgg

SEQ ID NO: 3519 - DNA, 24 bp, Artificial Sequence
  Description of Artificial Sequence:  Hypothetical Probe Sequence
gacctcccaaagcgaagatgcgtt

SEQ ID NO: 3520 - DNA, 24 bp, Artificial Sequence
  Description of Artificial Sequence:  Hypothetical Probe Sequence
gacctcccagtggtgcgctttcgt

SEQ ID NO: 3521 - DNA, 24 bp, Artificial Sequence
  Description of Artificial Sequence:  Hypothetical Probe Sequence
gacctcccaccttacacgaatgcg

SEQ ID NO: 3522 - DNA, 24 bp, Artificial Sequence
  Description of Artificial Sequence:  Hypothetical Probe Sequence
gacctcccggactctgcgaatgtc

SEQ ID NO: 3523 - DNA, 24 bp, Artificial Sequence
  Description of Artificial Sequence:  Hypothetical Probe Sequence
gacctcccagcccgttgctttctg

SEQ ID NO: 3524 - DNA, 24 bp, Artificial Sequence
  Description of Artificial Sequence:  Hypothetical Probe Sequence
gacctgcgttgagtctacggcgaa

SEQ ID NO: 3525 - DNA, 24 bp, Artificial Sequence
  Description of Artificial Sequence:  Hypothetical Probe Sequence
gacctgcgtcgtacctgatggacc

SEQ ID NO: 3526 - DNA, 24 bp, Artificial Sequence
  Description of Artificial Sequence:  Hypothetical Probe Sequence
gacctgcggagtctgtatcgacgg

SEQ ID NO: 3527 - DNA, 24 bp, Artificial Sequence
  Description of Artificial Sequence:  Hypothetical Probe Sequence
gacctgcgatcggtctaccttgcg

SEQ ID NO: 3528 - DNA, 24 bp, Artificial Sequence
  Description of Artificial Sequence:  Hypothetical Probe Sequence
gacctgcgcctaaggaaaagagcc

SEQ ID NO: 3529 - DNA, 24 bp, Artificial Sequence
  Description of Artificial Sequence:  Hypothetical Probe Sequence
gacctgcgtgcgcgtttgtcagga

SEQ ID NO: 3530 - DNA, 24 bp, Artificial Sequence
  Description of Artificial Sequence:  Hypothetical Probe Sequence
gacctgcggtgccacgaggattga

SEQ ID NO: 3531 - DNA, 24 bp, Artificial Sequence
  Description of Artificial Sequence:  Hypothetical Probe Sequence
gacccacgttagggacgatggcaa

SEQ ID NO: 3532 - DNA, 24 bp, Artificial Sequence
  Description of Artificial Sequence:  Hypothetical Probe Sequence
gacccacgtgtcccatgacccagc

SEQ ID NO: 3533 - DNA, 24 bp, Artificial Sequence
  Description of Artificial Sequence:  Hypothetical Probe Sequence
gacccacgctgtcagcgtctccta

SEQ ID NO: 3534 - DNA, 24 bp, Artificial Sequence
  Description of Artificial Sequence:  Hypothetical Probe Sequence
gacccacgcctatcgtctcaagga

SEQ ID NO: 3535 - DNA, 24 bp, Artificial Sequence
  Description of Artificial Sequence:  Hypothetical Probe Sequence
gacccacgagccgcaagaccagtg

SEQ ID NO: 3536 - DNA, 24 bp, Artificial Sequence
  Description of Artificial Sequence:  Hypothetical Probe Sequence
gacccagcttgatacatgcgcgaa

SEQ ID NO: 3537 - DNA, 24 bp, Artificial Sequence
  Description of Artificial Sequence:  Hypothetical Probe Sequence
gacccagcataccttggcaatgcg

SEQ ID NO: 3538 - DNA, 24 bp, Artificial Sequence
  Description of Artificial Sequence:  Hypothetical Probe Sequence
gacccagctacacttggtgccgtt

SEQ ID NO: 3539 - DNA, 24 bp, Artificial Sequence
  Description of Artificial Sequence:  Hypothetical Probe Sequence
gacccagcggtagctttgtcggta

SEQ ID NO: 3540 - DNA, 24 bp, Artificial Sequence
  Description of Artificial Sequence:  Hypothetical Probe Sequence
gacccagcagtggaccaaagcgaa

SEQ ID NO: 3541 - DNA, 24 bp, Artificial Sequence
  Description of Artificial Sequence:  Hypothetical Probe Sequence
gacccagcgatgccattgtcccat

SEQ ID NO: 3542 - DNA, 24 bp, Artificial Sequence
  Description of Artificial Sequence:  Hypothetical Probe Sequence
gacccagcgtgcaggatgtcgtgc

SEQ ID NO: 3543 - DNA, 24 bp, Artificial Sequence
  Description of Artificial Sequence:  Hypothetical Probe Sequence
gacccagcagccgcaaaatcacct

SEQ ID NO: 3544 - DNA, 24 bp, Artificial Sequence
  Description of Artificial Sequence:  Hypothetical Probe Sequence
gaccgacctgatagccccatatcg

SEQ ID NO: 3545 - DNA, 24 bp, Artificial Sequence
  Description of Artificial Sequence:  Hypothetical Probe Sequence
gaccgaccaaaggtctgaccgcaa

SEQ ID NO: 3546 - DNA, 24 bp, Artificial Sequence
  Description of Artificial Sequence:  Hypothetical Probe Sequence
gaccgacctctgcgaaggactccc

SEQ ID NO: 3547 - DNA, 24 bp, Artificial Sequence
  Description of Artificial Sequence:  Hypothetical Probe Sequence
gaccgaccctgtaaagcagcgtct

SEQ ID NO: 3548 - DNA, 24 bp, Artificial Sequence
  Description of Artificial Sequence:  Hypothetical Probe Sequence
gaccgaccacctgcaacgttacgg

SEQ ID NO: 3549 - DNA, 24 bp, Artificial Sequence
  Description of Artificial Sequence:  Hypothetical Probe Sequence
gaccgaccgtgcctcatctgcacg

SEQ ID NO: 3550 - DNA, 24 bp, Artificial Sequence
  Description of Artificial Sequence:  Hypothetical Probe Sequence
gaccgtgcttaggcttacggccat

SEQ ID NO: 3551 - DNA, 24 bp, Artificial Sequence
  Description of Artificial Sequence:  Hypothetical Probe Sequence
gaccgtgcatactcgtcttgcagc

SEQ ID NO: 3552 - DNA, 24 bp, Artificial Sequence
  Description of Artificial Sequence:  Hypothetical Probe Sequence
gaccgtgccgaaggtaagtgacgg

SEQ ID NO: 3553 - DNA, 24 bp, Artificial Sequence
  Description of Artificial Sequence:  Hypothetical Probe Sequence
gaccgtgcgtctctcaaaaggctt

SEQ ID NO: 3554 - DNA, 24 bp, Artificial Sequence
  Description of Artificial Sequence:  Hypothetical Probe Sequence
gaccgtgcgcaatcgtgtctcacg

SEQ ID NO: 3555 - DNA, 24 bp, Artificial Sequence
  Description of Artificial Sequence:  Hypothetical Probe Sequence
gaccgtgcagtgtctgtgcggctt

SEQ ID NO: 3556 - DNA, 24 bp, Artificial Sequence
  Description of Artificial Sequence:  Hypothetical Probe Sequence
gaccgtgcacctctcacgaaagcc

SEQ ID NO: 3557 - DNA, 24 bp, Artificial Sequence
  Description of Artificial Sequence:  Hypothetical Probe Sequence
gaccgtgcaggaccatggacgagt

SEQ ID NO: 3558 - DNA, 24 bp, Artificial Sequence
  Description of Artificial Sequence:  Hypothetical Probe Sequence
gaccgtgctgcggtctgcaacgtt

SEQ ID NO: 3559 - DNA, 24 bp, Artificial Sequence
  Description of Artificial Sequence:  Hypothetical Probe Sequence
gaccgtgccacgctcacttgacgg

SEQ ID NO: 3560 - DNA, 24 bp, Artificial Sequence
  Description of Artificial Sequence:  Hypothetical Probe Sequence
gaccgtgccagcctcatctgcgtt

SEQ ID NO: 3561 - DNA, 24 bp, Artificial Sequence
  Description of Artificial Sequence:  Hypothetical Probe Sequence
gaccgtgcgtgcgcttgagttgtc

SEQ ID NO: 3562 - DNA, 24 bp, Artificial Sequence
  Description of Artificial Sequence:  Hypothetical Probe Sequence
gaccggaccgttcagcgatgagtg

SEQ ID NO: 3563 - DNA, 24 bp, Artificial Sequence
  Description of Artificial Sequence:  Hypothetical Probe Sequence
gaccggacctgtggaccgttgacc

SEQ ID NO: 3564 - DNA, 24 bp, Artificial Sequence
  Description of Artificial Sequence:  Hypothetical Probe Sequence
gaccggaccgaaaatctgtcacgg

SEQ ID NO: 3565 - DNA, 24 bp, Artificial Sequence
  Description of Artificial Sequence:  Hypothetical Probe Sequence
gaccggacgcaagcaagcaattga

SEQ ID NO: 3566 - DNA, 24 bp, Artificial Sequence
  Description of Artificial Sequence:  Hypothetical Probe Sequence
gaccggacatcgatcgatcgacct

SEQ ID NO: 3567 - DNA, 24 bp, Artificial Sequence
  Description of Artificial Sequence:  Hypothetical Probe Sequence
gaccggaccagcgtctcagcagcc

SEQ ID NO: 3568 - DNA, 24 bp, Artificial Sequence
  Description of Artificial Sequence:  Hypothetical Probe Sequence
gaccggacgaccctcacacggctt

SEQ ID NO: 3569 - DNA, 24 bp, Artificial Sequence
  Description of Artificial Sequence:  Hypothetical Probe Sequence
gaccggacgtgcctcaatcgctgt

SEQ ID NO: 3570 - DNA, 24 bp, Artificial Sequence
  Description of Artificial Sequence:  Hypothetical Probe Sequence
gaccggacacgggtctgcttcgtt

SEQ ID NO: 3571 - DNA, 24 bp, Artificial Sequence
  Description of Artificial Sequence:  Hypothetical Probe Sequence
gaccacggtcgtaatcgatgtccc

SEQ ID NO: 3572 - DNA, 24 bp, Artificial Sequence
  Description of Artificial Sequence:  Hypothetical Probe Sequence
gaccacggcttgatcgtgatgctt

SEQ ID NO: 3573 - DNA, 24 bp, Artificial Sequence
  Description of Artificial Sequence:  Hypothetical Probe Sequence
gaccacggcgttgtctgtgcccta

SEQ ID NO: 3574 - DNA, 24 bp, Artificial Sequence
  Description of Artificial Sequence:  Hypothetical Probe Sequence
gaccacggctgtataccacgtgcg

SEQ ID NO: 3575 - DNA, 24 bp, Artificial Sequence
  Description of Artificial Sequence:  Hypothetical Probe Sequence
gaccacggggtattagacggcttg

SEQ ID NO: 3576 - DNA, 24 bp, Artificial Sequence
  Description of Artificial Sequence:  Hypothetical Probe Sequence
gaccacgggtctaggatgtcgctt

SEQ ID NO: 3577 - DNA, 24 bp, Artificial Sequence
  Description of Artificial Sequence:  Hypothetical Probe Sequence
gaccacgggagtatacagccgtgc

SEQ ID NO: 3578 - DNA, 24 bp, Artificial Sequence
  Description of Artificial Sequence:  Hypothetical Probe Sequence
gaccacggcagctcgtttagagcc

SEQ ID NO: 3579 - DNA, 24 bp, Artificial Sequence
  Description of Artificial Sequence:  Hypothetical Probe Sequence
gaccacggagccagccaccttctg

SEQ ID NO: 3580 - DNA, 24 bp, Artificial Sequence
  Description of Artificial Sequence:  Hypothetical Probe Sequence
gaccagccaatcacggctgttgtc

SEQ ID NO: 3581 - DNA, 24 bp, Artificial Sequence
  Description of Artificial Sequence:  Hypothetical Probe Sequence
gaccagccaaagcgttgcaacttg

SEQ ID NO: 3582 - DNA, 24 bp, Artificial Sequence
  Description of Artificial Sequence:  Hypothetical Probe Sequence
gaccagcctcgtccataatcacgg

SEQ ID NO: 3583 - DNA, 24 bp, Artificial Sequence
  Description of Artificial Sequence:  Hypothetical Probe Sequence
gaccagccccatgcttcgtttgtc

SEQ ID NO: 3584 - DNA, 24 bp, Artificial Sequence
  Description of Artificial Sequence:  Hypothetical Probe Sequence
gaccagccgcttcgaactcagtgc

SEQ ID NO: 3585 - DNA, 24 bp, Artificial Sequence
  Description of Artificial Sequence:  Hypothetical Probe Sequence
gaccagccagtgagccagccccat

SEQ ID NO: 3586 - DNA, 24 bp, Artificial Sequence
  Description of Artificial Sequence:  Hypothetical Probe Sequence
gaccagccatcgtacaatcgcgtt

SEQ ID NO: 3587 - DNA, 24 bp, Artificial Sequence
  Description of Artificial Sequence:  Hypothetical Probe Sequence
gaccagcccctaaatctgcgcttg

SEQ ID NO: 3588 - DNA, 24 bp, Artificial Sequence
  Description of Artificial Sequence:  Hypothetical Probe Sequence
gaccagcctcccggacagtgccat

SEQ ID NO: 3589 - DNA, 24 bp, Artificial Sequence
  Description of Artificial Sequence:  Hypothetical Probe Sequence
gaccagcctgcgtgtccgttctca

SEQ ID NO: 3590 - DNA, 24 bp, Artificial Sequence
  Description of Artificial Sequence:  Hypothetical Probe Sequence
gaccagccgaccgatgctcacgaa

SEQ ID NO: 3591 - DNA, 24 bp, Artificial Sequence
  Description of Artificial Sequence:  Hypothetical Probe Sequence
gtgcttgagcttatcggcaatgcg

SEQ ID NO: 3592 - DNA, 24 bp, Artificial Sequence
  Description of Artificial Sequence:  Hypothetical Probe Sequence
gtgcttgagtgcgtgctgcgcgaa

SEQ ID NO: 3593 - DNA, 24 bp, Artificial Sequence
  Description of Artificial Sequence:  Hypothetical Probe Sequence
gtgctgatccatgtgccttgacgg

SEQ ID NO: 3594 - DNA, 24 bp, Artificial Sequence
  Description of Artificial Sequence:  Hypothetical Probe Sequence
gtgctgatgtgccgtttgcgggac

SEQ ID NO: 3595 - DNA, 24 bp, Artificial Sequence
  Description of Artificial Sequence:  Hypothetical Probe Sequence
gtgcaatccgaacgttggactcgt

SEQ ID NO: 3596 - DNA, 24 bp, Artificial Sequence
  Description of Artificial Sequence:  Hypothetical Probe Sequence
gtgcaatcggtatcgtcgaaatcg

SEQ ID NO: 3597 - DNA, 24 bp, Artificial Sequence
  Description of Artificial Sequence:  Hypothetical Probe Sequence
gtgcaatcgatgagccccatgatg

SEQ ID NO: 3598 - DNA, 24 bp, Artificial Sequence
  Description of Artificial Sequence:  Hypothetical Probe Sequence
gtgcaatctcccgcaaatactgcg

SEQ ID NO: 3599 - DNA, 24 bp, Artificial Sequence
  Description of Artificial Sequence:  Hypothetical Probe Sequence
gtgcaatccacggatgtctgtccc

SEQ ID NO: 3600 - DNA, 24 bp, Artificial Sequence
  Description of Artificial Sequence:  Hypothetical Probe Sequence
gtgcaatccagcagcccacgtctg

SEQ ID NO: 3601 - DNA, 24 bp, Artificial Sequence
  Description of Artificial Sequence:  Hypothetical Probe Sequence
gtgcataccacggcaaatcgggac

SEQ ID NO: 3602 - DNA, 24 bp, Artificial Sequence
  Description of Artificial Sequence:  Hypothetical Probe Sequence
gtgcatacagccacggtgcgtccc

SEQ ID NO: 3603 - DNA, 24 bp, Artificial Sequence
  Description of Artificial Sequence:  Hypothetical Probe Sequence
gtgcaaagtcgtcgaacacgcgaa

SEQ ID NO: 3604 - DNA, 24 bp, Artificial Sequence
  Description of Artificial Sequence:  Hypothetical Probe Sequence
gtgcaaagcctaatcggcaagacc

SEQ ID NO: 3605 - DNA, 24 bp, Artificial Sequence
  Description of Artificial Sequence:  Hypothetical Probe Sequence
gtgcaaagcagccagcagtgagcc

SEQ ID NO: 3606 - DNA, 24 bp, Artificial Sequence
  Description of Artificial Sequence:  Hypothetical Probe Sequence
gtgcaaaggaccatcggcttagcc

SEQ ID NO: 3607 - DNA, 24 bp, Artificial Sequence
  Description of Artificial Sequence:  Hypothetical Probe Sequence
gtgctctgggtaatcgggactgcg

SEQ ID NO: 3608 - DNA, 24 bp, Artificial Sequence
  Description of Artificial Sequence:  Hypothetical Probe Sequence
gtgctctgcctagctttgcgcacg

SEQ ID NO: 3609 - DNA, 24 bp, Artificial Sequence
  Description of Artificial Sequence:  Hypothetical Probe Sequence
gtgctctgtgcgcgttagtgcgaa

SEQ ID NO: 3610 - DNA, 24 bp, Artificial Sequence
  Description of Artificial Sequence:  Hypothetical Probe Sequence
gtgctgtccgaaacggctgtttga

SEQ ID NO: 3611 - DNA, 24 bp, Artificial Sequence
  Description of Artificial Sequence:  Hypothetical Probe Sequence
gtgctgtccacgggacacggggta

SEQ ID NO: 3612 - DNA, 24 bp, Artificial Sequence
  Description of Artificial Sequence:  Hypothetical Probe Sequence
gtgctgtcgaccgacccagcctca

SEQ ID NO: 3613 - DNA, 24 bp, Artificial Sequence
  Description of Artificial Sequence:  Hypothetical Probe Sequence
gtgctgtcacgggtcttcccggac

SEQ ID NO: 3614 - DNA, 24 bp, Artificial Sequence
  Description of Artificial Sequence:  Hypothetical Probe Sequence
gtgctcgttgatagccgcttcacg

SEQ ID NO: 3615 - DNA, 24 bp, Artificial Sequence
  Description of Artificial Sequence:  Hypothetical Probe Sequence
gtgctcgtcttgtgtcacggcgaa

SEQ ID NO: 3616 - DNA, 24 bp, Artificial Sequence
  Description of Artificial Sequence:  Hypothetical Probe Sequence
gtgctcgtaggaaatcagccgcaa

SEQ ID NO: 3617 - DNA, 24 bp, Artificial Sequence
  Description of Artificial Sequence:  Hypothetical Probe Sequence
gtgctcgttccccgttttgacacg

SEQ ID NO: 3618 - DNA, 24 bp, Artificial Sequence
  Description of Artificial Sequence:  Hypothetical Probe Sequence
gtgctcgtggacggacgcttccat

SEQ ID NO: 3619 - DNA, 24 bp, Artificial Sequence
  Description of Artificial Sequence:  Hypothetical Probe Sequence
gtgctcgtagcctctgacggggac

SEQ ID NO: 3620 - DNA, 24 bp, Artificial Sequence
  Description of Artificial Sequence:  Hypothetical Probe Sequence
gtgccttgttgatcccgtgccgtt

SEQ ID NO: 3621 - DNA, 24 bp, Artificial Sequence
  Description of Artificial Sequence:  Hypothetical Probe Sequence
gtgccttgaaaggcaacttgcgaa

SEQ ID NO: 3622 - DNA, 24 bp, Artificial Sequence
  Description of Artificial Sequence:  Hypothetical Probe Sequence
gtgccttggtctggactgcgcgtt

SEQ ID NO: 3623 - DNA, 24 bp, Artificial Sequence
  Description of Artificial Sequence:  Hypothetical Probe Sequence
gtgccttgaggagtgctcccgatg

SEQ ID NO: 3624 - DNA, 24 bp, Artificial Sequence
  Description of Artificial Sequence:  Hypothetical Probe Sequence
gtgccttgcctatcgtatcgtccc

SEQ ID NO: 3625 - DNA, 24 bp, Artificial Sequence
  Description of Artificial Sequence:  Hypothetical Probe Sequence
gtgccttggatggcttcgaacgaa

SEQ ID NO: 3626 - DNA, 24 bp, Artificial Sequence
  Description of Artificial Sequence:  Hypothetical Probe Sequence
gtgccttgcagctgtcagtgccat

SEQ ID NO: 3627 - DNA, 24 bp, Artificial Sequence
  Description of Artificial Sequence:  Hypothetical Probe Sequence
gtgccgttttgaaggagacctgcg

SEQ ID NO: 3628 - DNA, 24 bp, Artificial Sequence
  Description of Artificial Sequence:  Hypothetical Probe Sequence
gtgccgttttagatcggatgcgaa

SEQ ID NO: 3629 - DNA, 24 bp, Artificial Sequence
  Description of Artificial Sequence:  Hypothetical Probe Sequence
gtgccgtttctgtgcgatacgctt

SEQ ID NO: 3630 - DNA, 24 bp, Artificial Sequence
  Description of Artificial Sequence:  Hypothetical Probe Sequence
gtgccgttctgtaatcgtgcagcc

SEQ ID NO: 3631 - DNA, 24 bp, Artificial Sequence
  Description of Artificial Sequence:  Hypothetical Probe Sequence
gtgccgttccatttgacacgtccc

SEQ ID NO: 3632 - DNA, 24 bp, Artificial Sequence
  Description of Artificial Sequence:  Hypothetical Probe Sequence
gtgccgttggtagacccgtttcgt

SEQ ID NO: 3633 - DNA, 24 bp, Artificial Sequence
  Description of Artificial Sequence:  Hypothetical Probe Sequence
gtgccgttgagtagccgcaaccta

SEQ ID NO: 3634 - DNA, 24 bp, Artificial Sequence
  Description of Artificial Sequence:  Hypothetical Probe Sequence
gtgccgttgatgtctggctttcgt

SEQ ID NO: 3635 - DNA, 24 bp, Artificial Sequence
  Description of Artificial Sequence:  Hypothetical Probe Sequence
gtgccgtttcccttagtccccagc

SEQ ID NO: 3636 - DNA, 24 bp, Artificial Sequence
  Description of Artificial Sequence:  Hypothetical Probe Sequence
gtgccgttggacgaccaatcgacc

SEQ ID NO: 3637 - DNA, 24 bp, Artificial Sequence
  Description of Artificial Sequence:  Hypothetical Probe Sequence
gtgcctcattgacacgggtatgcg

SEQ ID NO: 3638 - DNA, 24 bp, Artificial Sequence
  Description of Artificial Sequence:  Hypothetical Probe Sequence
gtgcctcaccatagcccgtttgat

SEQ ID NO: 3639 - DNA, 24 bp, Artificial Sequence
  Description of Artificial Sequence:  Hypothetical Probe Sequence
gtgcctcaagtgggaccagccacg

SEQ ID NO: 3640 - DNA, 24 bp, Artificial Sequence
  Description of Artificial Sequence:  Hypothetical Probe Sequence
gtgcctcacctacttgacgggctt

SEQ ID NO: 3641 - DNA, 24 bp, Artificial Sequence
  Description of Artificial Sequence:  Hypothetical Probe Sequence
gtgcctcatccctgatgatgcacg

SEQ ID NO: 3642 - DNA, 24 bp, Artificial Sequence
  Description of Artificial Sequence:  Hypothetical Probe Sequence
gtgcctcaagcctgatggacgtgc

SEQ ID NO: 3643 - DNA, 24 bp, Artificial Sequence
  Description of Artificial Sequence:  Hypothetical Probe Sequence
gtgcctgttctgtgcgtcccgtgc

SEQ ID NO: 3644 - DNA, 24 bp, Artificial Sequence
  Description of Artificial Sequence:  Hypothetical Probe Sequence
gtgcctgtgatgcacggctttgcg

SEQ ID NO: 3645 - DNA, 24 bp, Artificial Sequence
  Description of Artificial Sequence:  Hypothetical Probe Sequence
gtgcccatttgacgaagtgcatcg

SEQ ID NO: 3646 - DNA, 24 bp, Artificial Sequence
  Description of Artificial Sequence:  Hypothetical Probe Sequence
gtgcccattctgatcgtcccgctt

SEQ ID NO: 3647 - DNA, 24 bp, Artificial Sequence
  Description of Artificial Sequence:  Hypothetical Probe Sequence
gtgcccattgtctgtccagcgctt

SEQ ID NO: 3648 - DNA, 24 bp, Artificial Sequence
  Description of Artificial Sequence:  Hypothetical Probe Sequence
gtgcccattcgtacgggtcttgtc

SEQ ID NO: 3649 - DNA, 24 bp, Artificial Sequence
  Description of Artificial Sequence:  Hypothetical Probe Sequence
gtgcccatctcaatacggacgcaa

SEQ ID NO: 3650 - DNA, 24 bp, Artificial Sequence
  Description of Artificial Sequence:  Hypothetical Probe Sequence
gtgcccataggagtgcgatgccat

SEQ ID NO: 3651 - DNA, 24 bp, Artificial Sequence
  Description of Artificial Sequence:  Hypothetical Probe Sequence
gtgcccatcctacacggaccggta

SEQ ID NO: 3652 - DNA, 24 bp, Artificial Sequence
  Description of Artificial Sequence:  Hypothetical Probe Sequence
gtgcccattgcggagtacggatcg

SEQ ID NO: 3653 - DNA, 24 bp, Artificial Sequence
  Description of Artificial Sequence:  Hypothetical Probe Sequence
gtgcccatcagcctgtaccttgcg

SEQ ID NO: 3654 - DNA, 24 bp, Artificial Sequence
  Description of Artificial Sequence:  Hypothetical Probe Sequence
gtgccgaattgagatggatgcacg

SEQ ID NO: 3655 - DNA, 24 bp, Artificial Sequence
  Description of Artificial Sequence:  Hypothetical Probe Sequence
gtgccgaatgataatccagcccat

SEQ ID NO: 3656 - DNA, 24 bp, Artificial Sequence
  Description of Artificial Sequence:  Hypothetical Probe Sequence
gtgccgaaaatcaatcgagttccc

SEQ ID NO: 3657 - DNA, 24 bp, Artificial Sequence
  Description of Artificial Sequence:  Hypothetical Probe Sequence
gtgccgaaaaagggtatcccatcg

SEQ ID NO: 3658 - DNA, 24 bp, Artificial Sequence
  Description of Artificial Sequence:  Hypothetical Probe Sequence
gtgccgaatgtcgatgtgattgcg

SEQ ID NO: 3659 - DNA, 24 bp, Artificial Sequence
  Description of Artificial Sequence:  Hypothetical Probe Sequence
gtgccgaacgtttgatgaccggta

SEQ ID NO: 3660 - DNA, 24 bp, Artificial Sequence
  Description of Artificial Sequence:  Hypothetical Probe Sequence
gtgccgaaccattcgtcagcgtct

SEQ ID NO: 3661 - DNA, 24 bp, Artificial Sequence
  Description of Artificial Sequence:  Hypothetical Probe Sequence
gtgccgaaagtgaatcgcaacacg

SEQ ID NO: 3662 - DNA, 24 bp, Artificial Sequence
  Description of Artificial Sequence:  Hypothetical Probe Sequence
gtgccgaacacgcgttgagtacgg

SEQ ID NO: 3663 - DNA, 24 bp, Artificial Sequence
  Description of Artificial Sequence:  Hypothetical Probe Sequence
gtgccgaaggacctgtaaagcacg

SEQ ID NO: 3664 - DNA, 24 bp, Artificial Sequence
  Description of Artificial Sequence:  Hypothetical Probe Sequence
gtgccgaaacggccatcgaacttg

SEQ ID NO: 3665 - DNA, 24 bp, Artificial Sequence
  Description of Artificial Sequence:  Hypothetical Probe Sequence
gtgcgcttttagtcgtgtgccagc

SEQ ID NO: 3666 - DNA, 24 bp, Artificial Sequence
  Description of Artificial Sequence:  Hypothetical Probe Sequence
gtgcgcttaaagagtgcacgtcgt

SEQ ID NO: 3667 - DNA, 24 bp, Artificial Sequence
  Description of Artificial Sequence:  Hypothetical Probe Sequence
gtgcgctttacaaaagcacgacgg

SEQ ID NO: 3668 - DNA, 24 bp, Artificial Sequence
  Description of Artificial Sequence:  Hypothetical Probe Sequence
gtgcgcttctcactcaggaccacg

SEQ ID NO: 3669 - DNA, 24 bp, Artificial Sequence
  Description of Artificial Sequence:  Hypothetical Probe Sequence
gtgcgcttggtagtctacggtccc

SEQ ID NO: 3670 - DNA, 24 bp, Artificial Sequence
  Description of Artificial Sequence:  Hypothetical Probe Sequence
gtgcgcttaggaccatcgttagcc

SEQ ID NO: 3671 - DNA, 24 bp, Artificial Sequence
  Description of Artificial Sequence:  Hypothetical Probe Sequence
gtgcgcttgatgcttgggtacgaa

SEQ ID NO: 3672 - DNA, 24 bp, Artificial Sequence
  Description of Artificial Sequence:  Hypothetical Probe Sequence
gtgcgctttccccgaattgagacc

SEQ ID NO: 3673 - DNA, 24 bp, Artificial Sequence
  Description of Artificial Sequence:  Hypothetical Probe Sequence
gtgcgcttgacctctgggtaacct

SEQ ID NO: 3674 - DNA, 24 bp, Artificial Sequence
  Description of Artificial Sequence:  Hypothetical Probe Sequence
gtgcgcttggactgtcgatgctca

SEQ ID NO: 3675 - DNA, 24 bp, Artificial Sequence
  Description of Artificial Sequence:  Hypothetical Probe Sequence
gtgcggtaaaaggaccggacggta

SEQ ID NO: 3676 - DNA, 24 bp, Artificial Sequence
  Description of Artificial Sequence:  Hypothetical Probe Sequence
gtgcggtacgtttctggaccgctt

SEQ ID NO: 3677 - DNA, 24 bp, Artificial Sequence
  Description of Artificial Sequence:  Hypothetical Probe Sequence
gtgcggtacgaatgcgaggaagcc

SEQ ID NO: 3678 - DNA, 24 bp, Artificial Sequence
  Description of Artificial Sequence:  Hypothetical Probe Sequence
gtgcggtagcaaaggacagcccat

SEQ ID NO: 3679 - DNA, 24 bp, Artificial Sequence
  Description of Artificial Sequence:  Hypothetical Probe Sequence
gtgcggtacctaacgggtgccagc

SEQ ID NO: 3680 - DNA, 24 bp, Artificial Sequence
  Description of Artificial Sequence:  Hypothetical Probe Sequence
gtgcggtaagccggactctggtgc

SEQ ID NO: 3681 - DNA, 24 bp, Artificial Sequence
  Description of Artificial Sequence:  Hypothetical Probe Sequence
gtgcgtctttgacctatgcgtccc

SEQ ID NO: 3682 - DNA, 24 bp, Artificial Sequence
  Description of Artificial Sequence:  Hypothetical Probe Sequence
gtgcgtcttgtcgcaacgaaacgg

SEQ ID NO: 3683 - DNA, 24 bp, Artificial Sequence
  Description of Artificial Sequence:  Hypothetical Probe Sequence
gtgcgtctggtaatcggtgcccat

SEQ ID NO: 3684 - DNA, 24 bp, Artificial Sequence
  Description of Artificial Sequence:  Hypothetical Probe Sequence
gtgcgtctatcggcttacggtccc

SEQ ID NO: 3685 - DNA, 24 bp, Artificial Sequence
  Description of Artificial Sequence:  Hypothetical Probe Sequence
gtgcgtctgatgcttggtgccacg

SEQ ID NO: 3686 - DNA, 24 bp, Artificial Sequence
  Description of Artificial Sequence:  Hypothetical Probe Sequence
gtgcgtcttcccgtctgcttacgg

SEQ ID NO: 3687 - DNA, 24 bp, Artificial Sequence
  Description of Artificial Sequence:  Hypothetical Probe Sequence
gtgcgagtaggagcaatgcgggta

SEQ ID NO: 3688 - DNA, 24 bp, Artificial Sequence
  Description of Artificial Sequence:  Hypothetical Probe Sequence
gtgcgagtgatgcagccagcacgg

SEQ ID NO: 3689 - DNA, 24 bp, Artificial Sequence
  Description of Artificial Sequence:  Hypothetical Probe Sequence
gtgcgagttcccgtctcagcgacc

SEQ ID NO: 3690 - DNA, 24 bp, Artificial Sequence
  Description of Artificial Sequence:  Hypothetical Probe Sequence
gtgcgagttgcgaatccgttatcg

SEQ ID NO: 3691 - DNA, 24 bp, Artificial Sequence
  Description of Artificial Sequence:  Hypothetical Probe Sequence
gtgcgcaattgattagagccagcc

SEQ ID NO: 3692 - DNA, 24 bp, Artificial Sequence
  Description of Artificial Sequence:  Hypothetical Probe Sequence
gtgcgcaaataccagcaaagtgcg

SEQ ID NO: 3693 - DNA, 24 bp, Artificial Sequence
  Description of Artificial Sequence:  Hypothetical Probe Sequence
gtgcgcaatacaagccctgttgcg

SEQ ID NO: 3694 - DNA, 24 bp, Artificial Sequence
  Description of Artificial Sequence:  Hypothetical Probe Sequence
gtgcgcaatgtctctgggaccacg

SEQ ID NO: 3695 - DNA, 24 bp, Artificial Sequence
  Description of Artificial Sequence:  Hypothetical Probe Sequence
gtgcgcaactcaggacatcgctgt

SEQ ID NO: 3696 - DNA, 24 bp, Artificial Sequence
  Description of Artificial Sequence:  Hypothetical Probe Sequence
gtgcgcaactgtgatggacccgaa

SEQ ID NO: 3697 - DNA, 24 bp, Artificial Sequence
  Description of Artificial Sequence:  Hypothetical Probe Sequence
gtgcgcaaggtatacagcaaacgg

SEQ ID NO: 3698 - DNA, 24 bp, Artificial Sequence
  Description of Artificial Sequence:  Hypothetical Probe Sequence
gtgcgcaaagtgatacaggatgcg

SEQ ID NO: 3699 - DNA, 24 bp, Artificial Sequence
  Description of Artificial Sequence:  Hypothetical Probe Sequence
gtgcgcaaaccttcgtgaccgagt

SEQ ID NO: 3700 - DNA, 24 bp, Artificial Sequence
  Description of Artificial Sequence:  Hypothetical Probe Sequence
gtgcgcaaatcgtacacacggacc

SEQ ID NO: 3701 - DNA, 24 bp, Artificial Sequence
  Description of Artificial Sequence:  Hypothetical Probe Sequence
gtgcgcaagatgagtgacggtccc

SEQ ID NO: 3702 - DNA, 24 bp, Artificial Sequence
  Description of Artificial Sequence:  Hypothetical Probe Sequence
gtgcgcaatgcggcttggacagtg

SEQ ID NO: 3703 - DNA, 24 bp, Artificial Sequence
  Description of Artificial Sequence:  Hypothetical Probe Sequence
gtgcgcaagtgcaggacgttttga

SEQ ID NO: 3704 - DNA, 24 bp, Artificial Sequence
  Description of Artificial Sequence:  Hypothetical Probe Sequence
gtgcagtggcttacggcctaagga

SEQ ID NO: 3705 - DNA, 24 bp, Artificial Sequence
  Description of Artificial Sequence:  Hypothetical Probe Sequence
gtgcagtggatggcaatgcgccat

SEQ ID NO: 3706 - DNA, 24 bp, Artificial Sequence
  Description of Artificial Sequence:  Hypothetical Probe Sequence
gtgcagtgtgcggctttgtctgcg

SEQ ID NO: 3707 - DNA, 24 bp, Artificial Sequence
  Description of Artificial Sequence:  Hypothetical Probe Sequence
gtgcagtgggacatcggatgtccc

SEQ ID NO: 3708 - DNA, 24 bp, Artificial Sequence
  Description of Artificial Sequence:  Hypothetical Probe Sequence
gtgcagtgacggcagcgtctcacg

SEQ ID NO: 3709 - DNA, 24 bp, Artificial Sequence
  Description of Artificial Sequence:  Hypothetical Probe Sequence
gtgcagtgagccaatcgaccgacc

SEQ ID NO: 3710 - DNA, 24 bp, Artificial Sequence
  Description of Artificial Sequence:  Hypothetical Probe Sequence
gtgcacctgatgacgggtgcgtgc

SEQ ID NO: 3711 - DNA, 24 bp, Artificial Sequence
  Description of Artificial Sequence:  Hypothetical Probe Sequence
gtgcacctcacgcacgaatccgaa

SEQ ID NO: 3712 - DNA, 24 bp, Artificial Sequence
  Description of Artificial Sequence:  Hypothetical Probe Sequence
gtgcacctacggccatttgatccc

SEQ ID NO: 3713 - DNA, 24 bp, Artificial Sequence
  Description of Artificial Sequence:  Hypothetical Probe Sequence
gtgcatcgtgatcagcacgggcaa

SEQ ID NO: 3714 - DNA, 24 bp, Artificial Sequence
  Description of Artificial Sequence:  Hypothetical Probe Sequence
gtgcatcgcttgctcaacggggac

SEQ ID NO: 3715 - DNA, 24 bp, Artificial Sequence
  Description of Artificial Sequence:  Hypothetical Probe Sequence
gtgcatcgctgtttagagcctgcg

SEQ ID NO: 3716 - DNA, 24 bp, Artificial Sequence
  Description of Artificial Sequence:  Hypothetical Probe Sequence
gtgcatcggtctgtgcgaccgatg

SEQ ID NO: 3717 - DNA, 24 bp, Artificial Sequence
  Description of Artificial Sequence:  Hypothetical Probe Sequence
gtgcatcgaccttgcgcacggagt

SEQ ID NO: 3718 - DNA, 24 bp, Artificial Sequence
  Description of Artificial Sequence:  Hypothetical Probe Sequence
gtgcatcgatcgtgatagccgacc

SEQ ID NO: 3719 - DNA, 24 bp, Artificial Sequence
  Description of Artificial Sequence:  Hypothetical Probe Sequence
gtgcatcgtccccttgtccctccc

SEQ ID NO: 3720 - DNA, 24 bp, Artificial Sequence
  Description of Artificial Sequence:  Hypothetical Probe Sequence
gtgcatcgcacgcacggcttaatc

SEQ ID NO: 3721 - DNA, 24 bp, Artificial Sequence
  Description of Artificial Sequence:  Hypothetical Probe Sequence
gtgcatcgcagccgtttcgtagga

SEQ ID NO: 3722 - DNA, 24 bp, Artificial Sequence
  Description of Artificial Sequence:  Hypothetical Probe Sequence
gtgcatcgacgggcaatgatgacc

SEQ ID NO: 3723 - DNA, 24 bp, Artificial Sequence
  Description of Artificial Sequence:  Hypothetical Probe Sequence
gtgcaggatcgttgtctcccgcaa

SEQ ID NO: 3724 - DNA, 24 bp, Artificial Sequence
  Description of Artificial Sequence:  Hypothetical Probe Sequence
gtgcaggacttgcgaaatcgagcc

SEQ ID NO: 3725 - DNA, 24 bp, Artificial Sequence
  Description of Artificial Sequence:  Hypothetical Probe Sequence
gtgcaggagcttgcttcgttacgg

SEQ ID NO: 3726 - DNA, 24 bp, Artificial Sequence
  Description of Artificial Sequence:  Hypothetical Probe Sequence
gtgcaggaaggaaatcgacccgaa

SEQ ID NO: 3727 - DNA, 24 bp, Artificial Sequence
  Description of Artificial Sequence:  Hypothetical Probe Sequence
gtgcaggacacgtgtcgcaacgtt

SEQ ID NO: 3728 - DNA, 24 bp, Artificial Sequence
  Description of Artificial Sequence:  Hypothetical Probe Sequence
gtgcaggacagccgaacgaagctt

SEQ ID NO: 3729 - DNA, 24 bp, Artificial Sequence
  Description of Artificial Sequence:  Hypothetical Probe Sequence
gtgcaggagacccgaagaccacgg

SEQ ID NO: 3730 - DNA, 24 bp, Artificial Sequence
  Description of Artificial Sequence:  Hypothetical Probe Sequence
gtgcaggagtgccgttagccacct

SEQ ID NO: 3731 - DNA, 24 bp, Artificial Sequence
  Description of Artificial Sequence:  Hypothetical Probe Sequence
gtgcaggaacggctgtcgttagcc

SEQ ID NO: 3732 - DNA, 24 bp, Artificial Sequence
  Description of Artificial Sequence:  Hypothetical Probe Sequence
gtgccctaaaaggacctcccgatg

SEQ ID NO: 3733 - DNA, 24 bp, Artificial Sequence
  Description of Artificial Sequence:  Hypothetical Probe Sequence
gtgccctatgtccgaaatcgcacg

SEQ ID NO: 3734 - DNA, 24 bp, Artificial Sequence
  Description of Artificial Sequence:  Hypothetical Probe Sequence
gtgccctacgttggtagctttgcg

SEQ ID NO: 3735 - DNA, 24 bp, Artificial Sequence
  Description of Artificial Sequence:  Hypothetical Probe Sequence
gtgccctaccattctgcacgcgaa

SEQ ID NO: 3736 - DNA, 24 bp, Artificial Sequence
  Description of Artificial Sequence:  Hypothetical Probe Sequence
gtgccctagacctgtcgcaaacgg

SEQ ID NO: 3737 - DNA, 24 bp, Artificial Sequence
  Description of Artificial Sequence:  Hypothetical Probe Sequence
gtgccctaagcctcgtctgttccc

SEQ ID NO: 3738 - DNA, 24 bp, Artificial Sequence
  Description of Artificial Sequence:  Hypothetical Probe Sequence
gtgcgatgtgatatcgcgaaatcg

SEQ ID NO: 3739 - DNA, 24 bp, Artificial Sequence
  Description of Artificial Sequence:  Hypothetical Probe Sequence
gtgcgatgtctgtgcgagccgacc

SEQ ID NO: 3740 - DNA, 24 bp, Artificial Sequence
  Description of Artificial Sequence:  Hypothetical Probe Sequence
gtgcgatgcttggcaattaggcaa

SEQ ID NO: 3741 - DNA, 24 bp, Artificial Sequence
  Description of Artificial Sequence:  Hypothetical Probe Sequence
gtgcgatgatcgctgtgtgcgacc

SEQ ID NO: 3742 - DNA, 24 bp, Artificial Sequence
  Description of Artificial Sequence:  Hypothetical Probe Sequence
gtgcgatgtcccggacgcaaaatc

SEQ ID NO: 3743 - DNA, 24 bp, Artificial Sequence
  Description of Artificial Sequence:  Hypothetical Probe Sequence
gtgctcccttagcttggtgctgcg

SEQ ID NO: 3744 - DNA, 24 bp, Artificial Sequence
  Description of Artificial Sequence:  Hypothetical Probe Sequence
gtgctccccttggagttgattgcg

SEQ ID NO: 3745 - DNA, 24 bp, Artificial Sequence
  Description of Artificial Sequence:  Hypothetical Probe Sequence
gtgctccccgttctgtctgttgcg

SEQ ID NO: 3746 - DNA, 24 bp, Artificial Sequence
  Description of Artificial Sequence:  Hypothetical Probe Sequence
gtgctcccgagttacagtgccacg

SEQ ID NO: 3747 - DNA, 24 bp, Artificial Sequence
  Description of Artificial Sequence:  Hypothetical Probe Sequence
gtgctcccacctgacccctatccc

SEQ ID NO: 3748 - DNA, 24 bp, Artificial Sequence
  Description of Artificial Sequence:  Hypothetical Probe Sequence
gtgctcccatcgatcgcgttagga

SEQ ID NO: 3749 - DNA, 24 bp, Artificial Sequence
  Description of Artificial Sequence:  Hypothetical Probe Sequence
gtgctcccgtgcagtgtcccggta

SEQ ID NO: 3750 - DNA, 24 bp, Artificial Sequence
  Description of Artificial Sequence:  Hypothetical Probe Sequence
gtgctcccggacttgagtgcgagt

SEQ ID NO: 3751 - DNA, 24 bp, Artificial Sequence
  Description of Artificial Sequence:  Hypothetical Probe Sequence
gtgctcccagccgtcttctgcacg

SEQ ID NO: 3752 - DNA, 24 bp, Artificial Sequence
  Description of Artificial Sequence:  Hypothetical Probe Sequence
gtgctgcgtctgtctgcacgagga

SEQ ID NO: 3753 - DNA, 24 bp, Artificial Sequence
  Description of Artificial Sequence:  Hypothetical Probe Sequence
gtgctgcgctgtgcaaaatcccta

SEQ ID NO: 3754 - DNA, 24 bp, Artificial Sequence
  Description of Artificial Sequence:  Hypothetical Probe Sequence
gtgctgcggagtaaagagccccta

SEQ ID NO: 3755 - DNA, 24 bp, Artificial Sequence
  Description of Artificial Sequence:  Hypothetical Probe Sequence
gtgctgcgtccctacacagctccc

SEQ ID NO: 3756 - DNA, 24 bp, Artificial Sequence
  Description of Artificial Sequence:  Hypothetical Probe Sequence
gtgctgcgcacggcttgtctgtgc

SEQ ID NO: 3757 - DNA, 24 bp, Artificial Sequence
  Description of Artificial Sequence:  Hypothetical Probe Sequence
gtgctgcgcagcaaagcacgtgtc

SEQ ID NO: 3758 - DNA, 24 bp, Artificial Sequence
  Description of Artificial Sequence:  Hypothetical Probe Sequence
gtgctgcggacctctgagtgtgcg

SEQ ID NO: 3759 - DNA, 24 bp, Artificial Sequence
  Description of Artificial Sequence:  Hypothetical Probe Sequence
gtgctgcgagccgcaagatgcttg

SEQ ID NO: 3760 - DNA, 24 bp, Artificial Sequence
  Description of Artificial Sequence:  Hypothetical Probe Sequence
gtgccacgttaggtgcgtgcccat

SEQ ID NO: 3761 - DNA, 24 bp, Artificial Sequence
  Description of Artificial Sequence:  Hypothetical Probe Sequence
gtgccacgtctgagtggaccccat

SEQ ID NO: 3762 - DNA, 24 bp, Artificial Sequence
  Description of Artificial Sequence:  Hypothetical Probe Sequence
gtgccacgggtaacctaggatccc

SEQ ID NO: 3763 - DNA, 24 bp, Artificial Sequence
  Description of Artificial Sequence:  Hypothetical Probe Sequence
gtgccacggagtacgggagtgacc

SEQ ID NO: 3764 - DNA, 24 bp, Artificial Sequence
  Description of Artificial Sequence:  Hypothetical Probe Sequence
gtgccacgagtgtgtcatcgggac

SEQ ID NO: 3765 - DNA, 24 bp, Artificial Sequence
  Description of Artificial Sequence:  Hypothetical Probe Sequence
gtgccacgagccaatcctcacacg

SEQ ID NO: 3766 - DNA, 24 bp, Artificial Sequence
  Description of Artificial Sequence:  Hypothetical Probe Sequence
gtgccagctgatagccaaaggctt

SEQ ID NO: 3767 - DNA, 24 bp, Artificial Sequence
  Description of Artificial Sequence:  Hypothetical Probe Sequencetes sp.
gtgccagcaatcaaagggtaacgg

SEQ ID NO: 3768 - DNA, 24 bp, Artificial Sequence
  Description of Artificial Sequence:  Hypothetical Probe Sequence
gtgccagcataccagcgatgcgtt

SEQ ID NO: 3769 - DNA, 24 bp, Artificial Sequence
  Description of Artificial Sequence:  Hypothetical Probe Sequence
gtgccagcaaaggtctgtgcagga

SEQ ID NO: 3770 - DNA, 24 bp, Artificial Sequence
  Description of Artificial Sequence:  Hypothetical Probe Sequence
gtgccagccgaattagtgcgatcg

SEQ ID NO: 3771 - DNA, 24 bp, Artificial Sequence
  Description of Artificial Sequence:  Hypothetical Probe Sequence
gtgccagcgtcttgtcgtgcttga

SEQ ID NO: 3772 - DNA, 24 bp, Artificial Sequence
  Description of Artificial Sequence:  Hypothetical Probe Sequence
gtgccagcgagtttaggtgcagcc

SEQ ID NO: 3773 - DNA, 24 bp, Artificial Sequence
  Description of Artificial Sequence:  Hypothetical Probe Sequence
gtgccagccctaaatcggacccta

SEQ ID NO: 3774 - DNA, 24 bp, Artificial Sequence
  Description of Artificial Sequence:  Hypothetical Probe Sequence
gtgccagctcccctcacttgccat

SEQ ID NO: 3775 - DNA, 24 bp, Artificial Sequence
  Description of Artificial Sequence:  Hypothetical Probe Sequence
gtgccagcgtgcagtggcaacttg

SEQ ID NO: 3776 - DNA, 24 bp, Artificial Sequence
  Description of Artificial Sequence:  Hypothetical Probe Sequence
gtgccagcacggaaagatcggatg

SEQ ID NO: 3777 - DNA, 24 bp, Artificial Sequence
  Description of Artificial Sequence:  Hypothetical Probe Sequence
gtgcgaccttaggtgcggtatgcg

SEQ ID NO: 3778 - DNA, 24 bp, Artificial Sequence
  Description of Artificial Sequence:  Hypothetical Probe Sequence
gtgcgaccatacagccggaccgaa

SEQ ID NO: 3779 - DNA, 24 bp, Artificial Sequence
  Description of Artificial Sequence:  Hypothetical Probe Sequence
gtgcgaccctgtttagcagcgagt

SEQ ID NO: 3780 - DNA, 24 bp, Artificial Sequence
  Description of Artificial Sequence:  Hypothetical Probe Sequence
gtgcgacccgaaagcctgtcacct

SEQ ID NO: 3781 - DNA, 24 bp, Artificial Sequence
  Description of Artificial Sequence:  Hypothetical Probe Sequence
gtgcgaccgcttataccagcagcc

SEQ ID NO: 3782 - DNA, 24 bp, Artificial Sequence
  Description of Artificial Sequence:  Hypothetical Probe Sequence
gtgcgaccggtaggacggtagctt

SEQ ID NO: 3783 - DNA, 24 bp, Artificial Sequence
  Description of Artificial Sequence:  Hypothetical Probe Sequence
gtgcgaccagtggatgcacgctca

SEQ ID NO: 3784 - DNA, 24 bp, Artificial Sequence
  Description of Artificial Sequence:  Hypothetical Probe Sequence
gtgcgaccaggaagccacctgagt

SEQ ID NO: 3785 - DNA, 24 bp, Artificial Sequence
  Description of Artificial Sequence:  Hypothetical Probe Sequence
gtgcgacccagcgagtagcccttg

SEQ ID NO: 3786 - DNA, 24 bp, Artificial Sequence
  Description of Artificial Sequence:  Hypothetical Probe Sequence
gtgcgaccacggctcaatcgtcgt

SEQ ID NO: 3787 - DNA, 24 bp, Artificial Sequence
  Description of Artificial Sequence:  Hypothetical Probe Sequence
gtgcgtgcttgacgaaggacagcc

SEQ ID NO: 3788 - DNA, 24 bp, Artificial Sequence
  Description of Artificial Sequence:  Hypothetical Probe Sequence
gtgcgtgctgattcccaaagagga

SEQ ID NO: 3789 - DNA, 24 bp, Artificial Sequence
  Description of Artificial Sequence:  Hypothetical Probe Sequence
gtgcgtgctacatgcgaggacgtt

SEQ ID NO: 3790 - DNA, 24 bp, Artificial Sequence
  Description of Artificial Sequence:  Hypothetical Probe Sequence
gtgcgtgcctgtacctgaccacct

SEQ ID NO: 3791 - DNA, 24 bp, Artificial Sequence
  Description of Artificial Sequence:  Hypothetical Probe Sequence
gtgcgtgcgtctccatgcaactca

SEQ ID NO: 3792 - DNA, 24 bp, Artificial Sequence
  Description of Artificial Sequence:  Hypothetical Probe Sequence
gtgcgtgcgagtctgtgtgcctca

SEQ ID NO: 3793 - DNA, 24 bp, Artificial Sequence
  Description of Artificial Sequence:  Hypothetical Probe Sequence
gtgcgtgcatcgccatagcctgtc

SEQ ID NO: 3794 - DNA, 24 bp, Artificial Sequence
  Description of Artificial Sequence:  Hypothetical Probe Sequence
gtgcgtgccacggcttcacgtctg

SEQ ID NO: 3795 - DNA, 24 bp, Artificial Sequence
  Description of Artificial Sequence:  Hypothetical Probe Sequence
gtgcggacatacgcaaagccgacc

SEQ ID NO: 3796 - DNA, 24 bp, Artificial Sequence
  Description of Artificial Sequence:  Hypothetical Probe Sequence
gtgcggacgtctcgttggtaagcc

SEQ ID NO: 3797 - DNA, 24 bp, Artificial Sequence
  Description of Artificial Sequence:  Hypothetical Probe Sequence
gtgcggactccccagcgtctacct

SEQ ID NO: 3798 - DNA, 24 bp, Artificial Sequence
  Description of Artificial Sequence:  Hypothetical Probe Sequence
gtgcggactgcgagtgtgtcgcaa

SEQ ID NO: 3799 - DNA, 24 bp, Artificial Sequence
  Description of Artificial Sequence:  Hypothetical Probe Sequence
gtgcggacgacctcgtttgaccat

SEQ ID NO: 3800 - DNA, 24 bp, Artificial Sequence
  Description of Artificial Sequence:  Hypothetical Probe Sequence
gtgcacggaatcgctttgcgggac

SEQ ID NO: 3801 - DNA, 24 bp, Artificial Sequence
  Description of Artificial Sequence:  Hypothetical Probe Sequence
gtgcacggtctgtccccacgccat

SEQ ID NO: 3802 - DNA, 24 bp, Artificial Sequence
  Description of Artificial Sequence:  Hypothetical Probe Sequence
gtgcacggctcaaccttctgcagc

SEQ ID NO: 3803 - DNA, 24 bp, Artificial Sequence
  Description of Artificial Sequence:  Hypothetical Probe Sequence
gtgcacggccatcttgacctgctt

SEQ ID NO: 3804 - DNA, 24 bp, Artificial Sequence
  Description of Artificial Sequence:  Hypothetical Probe Sequence
gtgcacgggtcttgcgatcgtctg

SEQ ID NO: 3805 - DNA, 24 bp, Artificial Sequence
  Description of Artificial Sequence:  Hypothetical Probe Sequence
gtgcacgggagtccatcgaaatcg

SEQ ID NO: 3806 - DNA, 24 bp, Artificial Sequence
  Description of Artificial Sequence:  Hypothetical Probe Sequence
gtgcacggagtggaccagccggac

SEQ ID NO: 3807 - DNA, 24 bp, Artificial Sequence
  Description of Artificial Sequence:  Hypothetical Probe Sequence
gtgcacggatcggatgagccccta

SEQ ID NO: 3808 - DNA, 24 bp, Artificial Sequence
  Description of Artificial Sequence:  Hypothetical Probe Sequence
gtgcacggaggatccctgtctcgt

SEQ ID NO: 3809 - DNA, 24 bp, Artificial Sequence
  Description of Artificial Sequence:  Hypothetical Probe Sequence
gtgcacgggtgcgagtgtgcgatg

SEQ ID NO: 3810 - DNA, 24 bp, Artificial Sequence
  Description of Artificial Sequence:  Hypothetical Probe Sequence
gtgcacggggacccattctgtgat

SEQ ID NO: 3811 - DNA, 24 bp, Artificial Sequence
  Description of Artificial Sequence:  Hypothetical Probe Sequence
gtgcacggacggagtggtgcaaag

SEQ ID NO: 3812 - DNA, 24 bp, Artificial Sequence
  Description of Artificial Sequence:  Hypothetical Probe Sequence
gtgcagccaaagcagccgtttgtc

SEQ ID NO: 3813 - DNA, 24 bp, Artificial Sequence
  Description of Artificial Sequence:  Hypothetical Probe Sequence
gtgcagcctcgttacaacgggatg

SEQ ID NO: 3814 - DNA, 24 bp, Artificial Sequence
  Description of Artificial Sequence:  Hypothetical Probe Sequence
gtgcagccatcgaatcgcaatgat

SEQ ID NO: 3815 - DNA, 24 bp, Artificial Sequence
  Description of Artificial Sequence:  Hypothetical Probe Sequence
gtgcagcctcccgaccacctcgtt

SEQ ID NO: 3816 - DNA, 24 bp, Artificial Sequence
  Description of Artificial Sequence:  Hypothetical Probe Sequence
gtgcagcctgcgccatcttgagga

SEQ ID NO: 3817 - DNA, 24 bp, Artificial Sequence
  Description of Artificial Sequence:  Hypothetical Probe Sequence
gtgcagccgaccccatgtgcagtg

SEQ ID NO: 3818 - DNA, 24 bp, Artificial Sequence
  Description of Artificial Sequence:  Hypothetical Probe Sequence
gtgcagccgtgcagtgcgaatctg

SEQ ID NO: 3819 - DNA, 24 bp, Artificial Sequence
  Description of Artificial Sequence:  Hypothetical Probe Sequence
gtgcagccacgggatgctgtgtgc

SEQ ID NO: 3820 - DNA, 24 bp, Artificial Sequence
  Description of Artificial Sequence:  Hypothetical Probe Sequence
ggacttgaagccaatcccattgcg

SEQ ID NO: 3821 - DNA, 24 bp, Artificial Sequence
  Description of Artificial Sequence:  Hypothetical Probe Sequence
ggacttagcagccacgcacgtgcg

SEQ ID NO: 3822 - DNA, 24 bp, Artificial Sequence
  Description of Artificial Sequence:  Hypothetical Probe Sequence
ggacaatccttgacggccatcagc

SEQ ID NO: 3823 - DNA, 24 bp, Artificial Sequence
  Description of Artificial Sequence:  Hypothetical Probe Sequence
ggacaatctgcgtacaagcccgtt

SEQ ID NO: 3824 - DNA, 24 bp, Artificial Sequence
  Description of Artificial Sequence:  Hypothetical Probe Sequence
ggacaaaggatgacgggcaatgcg

SEQ ID NO: 3825 - DNA, 24 bp, Artificial Sequence
  Description of Artificial Sequence:  Hypothetical Probe Sequence
ggacaaagcacgagccttgacgaa

SEQ ID NO: 3826 - DNA, 24 bp, Artificial Sequence
  Description of Artificial Sequence:  Hypothetical Probe Sequence
ggactctgcgtttcgttcgtgtgc

SEQ ID NO: 3827 - DNA, 24 bp, Artificial Sequence
  Description of Artificial Sequence:  Hypothetical Probe Sequence
ggactctgcctaacgggctttgcg

SEQ ID NO: 3828 - DNA, 24 bp, Artificial Sequence
  Description of Artificial Sequence:  Hypothetical Probe Sequence
ggactctgcacggcaaacctgctt

SEQ ID NO: 3829 - DNA, 24 bp, Artificial Sequence
  Description of Artificial Sequence:  Hypothetical Probe Sequence
ggactcgtcgttatcgcagcagga

SEQ ID NO: 3830 - DNA, 24 bp, Artificial Sequence
  Description of Artificial Sequence:  Hypothetical Probe Sequence
ggactcgtccatgatgggactgcg

SEQ ID NO: 3831 - DNA, 24 bp, Artificial Sequence
  Description of Artificial Sequence:  Hypothetical Probe Sequence
ggactcgtacggcttggtcttgcg

SEQ ID NO: 3832 - DNA, 24 bp, Artificial Sequence
  Description of Artificial Sequence:  Hypothetical Probe Sequence
ggaccttgcttgtgcgttagcacg

SEQ ID NO: 3833 - DNA, 24 bp, Artificial Sequence
  Description of Artificial Sequence:  Hypothetical Probe Sequence
ggaccttgcgttacggcctattga

SEQ ID NO: 3834 - DNA, 24 bp, Artificial Sequence
  Description of Artificial Sequence:  Hypothetical Probe Sequence
ggaccttgctcaaaagcagcagcc

SEQ ID NO: 3835 - DNA, 24 bp, Artificial Sequence
  Description of Artificial Sequence:  Hypothetical Probe Sequence
ggaccttggagtcacgagccatcg

SEQ ID NO: 3836 - DNA, 24 bp, Artificial Sequence
  Description of Artificial Sequence:  Hypothetical Probe Sequence
ggaccttggcaaggacgcaagagt

SEQ ID NO: 3837 - DNA, 24 bp, Artificial Sequence
  Description of Artificial Sequence:  Hypothetical Probe Sequence
ggaccttgcagcgcttgcaaagtg

SEQ ID NO: 3838 - DNA, 24 bp, Artificial Sequence
  Description of Artificial Sequence:  Hypothetical Probe Sequence
ggaccttggtgccgaatcgtggac

SEQ ID NO: 3839 - DNA, 24 bp, Artificial Sequence
  Description of Artificial Sequence:  Hypothetical Probe Sequence
ggaccttgggacgcaacgaagacc

SEQ ID NO: 3840 - DNA, 24 bp, Artificial Sequence
  Description of Artificial Sequence:  Hypothetical Probe Sequence
ggaccgttcgttatacacgggcaa

SEQ ID NO: 3841 - DNA, 24 bp, Artificial Sequence
  Description of Artificial Sequence:  Hypothetical Probe Sequence
ggaccgttacctgagttgcgggac

SEQ ID NO: 3842 - DNA, 24 bp, Artificial Sequence
  Description of Artificial Sequence:  Hypothetical Probe Sequence
ggaccgtttgcggagtatcgttga

SEQ ID NO: 3843 - DNA, 24 bp, Artificial Sequence
  Description of Artificial Sequence:  Hypothetical Probe Sequence
ggacctgtttgatgcggagtagcc

SEQ ID NO: 3844 - DNA, 24 bp, Artificial Sequence
  Description of Artificial Sequence:  Hypothetical Probe Sequence
ggacctgtccatccattcccagga

SEQ ID NO: 3845 - DNA, 24 bp, Artificial Sequence
  Description of Artificial Sequence:  Hypothetical Probe Sequence
ggacccattgatcagcgaccccat

SEQ ID NO: 3846 - DNA, 24 bp, Artificial Sequence
  Description of Artificial Sequence:  Hypothetical Probe Sequence
ggacccataaagctgttcccgtgc

SEQ ID NO: 3847 - DNA, 24 bp, Artificial Sequence
  Description of Artificial Sequence:  Hypothetical Probe Sequence
ggacccatcttgcttgtcccatcg

SEQ ID NO: 3848 - DNA, 24 bp, Artificial Sequence
  Description of Artificial Sequence:  Hypothetical Probe Sequence
ggacccatggtatgcggtgcatac

SEQ ID NO: 3849 - DNA, 24 bp, Artificial Sequence
  Description of Artificial Sequence:  Hypothetical Probe Sequence
ggacccatcacgcttgcgaacttg

SEQ ID NO: 3850 - DNA, 24 bp, Artificial Sequence
  Description of Artificial Sequence:  Hypothetical Probe Sequence
ggacccatgtgcatacgcaaggac

SEQ ID NO: 3851 - DNA, 24 bp, Artificial Sequence
  Description of Artificial Sequence:  Hypothetical Probe Sequence
ggaccgaattgacttgcacgcacg

SEQ ID NO: 3852 - DNA, 24 bp, Artificial Sequence
  Description of Artificial Sequence:  Hypothetical Probe Sequence
ggaccgaaatacacgggtgcccta

SEQ ID NO: 3853 - DNA, 24 bp, Artificial Sequence
  Description of Artificial Sequence:  Hypothetical Probe Sequence
ggaccgaaaaagtctgcttggcaa

SEQ ID NO: 3854 - DNA, 24 bp, Artificial Sequence
  Description of Artificial Sequence:  Hypothetical Probe Sequence
ggaccgaacttgacggtccctcgt

SEQ ID NO: 3855 - DNA, 24 bp, Artificial Sequence
  Description of Artificial Sequence:  Hypothetical Probe Sequence
ggaccgaagctttcgtaggacacg

SEQ ID NO: 3856 - DNA, 24 bp, Artificial Sequence
  Description of Artificial Sequence:  Hypothetical Probe Sequence
ggaccgaaacctgcttgcttgacc

SEQ ID NO: 3857 - DNA, 24 bp, Artificial Sequence
  Description of Artificial Sequence:  Hypothetical Probe Sequence
ggaccgaaaggaataccagccacg

SEQ ID NO: 3858 - DNA, 24 bp, Artificial Sequence
  Description of Artificial Sequence:  Hypothetical Probe Sequence
ggaccgaagacccagcgcaattag

SEQ ID NO: 3859 - DNA, 24 bp, Artificial Sequence
  Description of Artificial Sequence:  Hypothetical Probe Sequence
ggacgcttttagggaccgaacgaa

SEQ ID NO: 3860 - DNA, 24 bp, Artificial Sequence
  Description of Artificial Sequence:  Hypothetical Probe Sequence
ggacgcttaaaggtgcgtgctccc

SEQ ID NO: 3861 - DNA, 24 bp, Artificial Sequence
  Description of Artificial Sequence:  Hypothetical Probe Sequence
ggacgctttgtcaccttccctgcg

SEQ ID NO: 3862 - DNA, 24 bp, Artificial Sequence
  Description of Artificial Sequence:  Hypothetical Probe Sequence
ggacgcttggtaaatcgctttcgt

SEQ ID NO: 3863 - DNA, 24 bp, Artificial Sequence
  Description of Artificial Sequence:  Hypothetical Probe Sequence
ggacgcttacctgcaacgaaccat

SEQ ID NO: 3864 - DNA, 24 bp, Artificial Sequence
  Description of Artificial Sequence:  Hypothetical Probe Sequence
ggacgcttcctatgtcatcggcaa

SEQ ID NO: 3865 - DNA, 24 bp, Artificial Sequence
  Description of Artificial Sequence:  Hypothetical Probe Sequence
ggacgctttgcgttgaatcggacc

SEQ ID NO: 3866 - DNA, 24 bp, Artificial Sequence
  Description of Artificial Sequence:  Hypothetical Probe Sequence
ggacggtacgtttcgttgcggctt

SEQ ID NO: 3867 - DNA, 24 bp, Artificial Sequence
  Description of Artificial Sequence:  Hypothetical Probe Sequence
ggacggtaccattgtcgcaaggac

SEQ ID NO: 3868 - DNA, 24 bp, Artificial Sequence
  Description of Artificial Sequence:  Hypothetical Probe Sequence
ggacggtagtgcagtgcagcgacc

SEQ ID NO: 3869 - DNA, 24 bp, Artificial Sequence
  Description of Artificial Sequence:  Hypothetical Probe Sequence
ggacggtaggacgcaatcccacct

SEQ ID NO: 3870 - DNA, 24 bp, Artificial Sequence
  Description of Artificial Sequence:  Hypothetical Probe Sequence
ggacggtaagccgtgcacctgtgc

SEQ ID NO: 3871 - DNA, 24 bp, Artificial Sequence
  Description of Artificial Sequence:  Hypothetical Probe Sequence
ggacgtctttgatccccacgcgaa

SEQ ID NO: 3872 - DNA, 24 bp, Artificial Sequence
  Description of Artificial Sequence:  Hypothetical Probe Sequence
ggacgtcttcgtgcaagcaaagga

SEQ ID NO: 3873 - DNA, 24 bp, Artificial Sequence
  Description of Artificial Sequence:  Hypothetical Probe Sequence
ggacgtctccatggaccagcgacc

SEQ ID NO: 3874 - DNA, 24 bp, Artificial Sequence
  Description of Artificial Sequence:  Hypothetical Probe Sequence
ggacgtctgcaagacctctgtgcg

SEQ ID NO: 3875 - DNA, 24 bp, Artificial Sequence
  Description of Artificial Sequence:  Hypothetical Probe Sequence
ggacgtctcacgcacgaaagcagc

SEQ ID NO: 3876 - DNA, 24 bp, Artificial Sequence
  Description of Artificial Sequence:  Hypothetical Probe Sequence
ggacgagtatcgggaccctatgcg

SEQ ID NO: 3877 - DNA, 24 bp, Artificial Sequence
  Description of Artificial Sequence:  Hypothetical Probe Sequence
ggacgagtcagcgtgcgtgcagga

SEQ ID NO: 3878 - DNA, 24 bp, Artificial Sequence
  Description of Artificial Sequence:  Hypothetical Probe Sequence
ggacgagtacggttgaatcggctt

SEQ ID NO: 3879 - DNA, 24 bp, Artificial Sequence
  Description of Artificial Sequence:  Hypothetical Probe Sequence
ggacgcaattgaacggagtgcagc

SEQ ID NO: 3880 - DNA, 24 bp, Artificial Sequence
  Description of Artificial Sequence:  Hypothetical Probe Sequence
ggacgcaaatacgtgcccatggac

SEQ ID NO: 3881 - DNA, 24 bp, Artificial Sequence
  Description of Artificial Sequence:  Hypothetical Probe Sequence
ggacgcaatgtcccatggtaggac

SEQ ID NO: 3882 - DNA, 24 bp, Artificial Sequence
  Description of Artificial Sequence:  Hypothetical Probe Sequence
ggacgcaatcgttctggtgcaaag

SEQ ID NO: 3883 - DNA, 24 bp, Artificial Sequence
  Description of Artificial Sequence:  Hypothetical Probe Sequence
ggacgcaacctaatactgcgtgcg

SEQ ID NO: 3884 - DNA, 24 bp, Artificial Sequence
  Description of Artificial Sequence:  Hypothetical Probe Sequence
ggacgcaatgcgttgaaggatcgt

SEQ ID NO: 3885 - DNA, 24 bp, Artificial Sequence
  Description of Artificial Sequence:  Hypothetical Probe Sequence
ggacgcaagtgcagtggtcttccc

SEQ ID NO: 3886 - DNA, 24 bp, Artificial Sequence
  Description of Artificial Sequence:  Hypothetical Probe Sequence
ggacgcaaggactcccggtaaaag

SEQ ID NO: 3887 - DNA, 24 bp, Artificial Sequence
  Description of Artificial Sequence:  Hypothetical Probe Sequence
ggacgcaaacggtgatcagccttg

SEQ ID NO: 3888 - DNA, 24 bp, Artificial Sequence
  Description of Artificial Sequence:  Hypothetical Probe Sequence
ggacagtgtgcgacggacctgtgc

SEQ ID NO: 3889 - DNA, 24 bp, Artificial Sequence
  Description of Artificial Sequence:  Hypothetical Probe Sequence
ggacacctcacgggactgattgcg

SEQ ID NO: 3890 - DNA, 24 bp, Artificial Sequence
  Description of Artificial Sequence:  Hypothetical Probe Sequence
ggacacctgaccgtgcacggccta

SEQ ID NO: 3891 - DNA, 24 bp, Artificial Sequence
  Description of Artificial Sequence:  Hypothetical Probe Sequence
ggacacctagccttagcgtttgcg

SEQ ID NO: 3892 - DNA, 24 bp, Artificial Sequence
  Description of Artificial Sequence:  Hypothetical Probe Sequence
ggacatcgaaagacgggtgccacg

SEQ ID NO: 3893 - DNA, 24 bp, Artificial Sequence
  Description of Artificial Sequence:  Hypothetical Probe Sequence
ggacatcggcttcttgcttgacgg

SEQ ID NO: 3894 - DNA, 24 bp, Artificial Sequence
  Description of Artificial Sequence:  Hypothetical Probe Sequence
ggacatcgcacggtctagccatcg

SEQ ID NO: 3895 - DNA, 24 bp, Artificial Sequence
  Description of Artificial Sequence:  Hypothetical Probe Sequence
ggacatcgacggggacctgtcgtt

SEQ ID NO: 3896 - DNA, 24 bp, Artificial Sequence
  Description of Artificial Sequence:  Hypothetical Probe Sequence
ggacaggacgaaatcgtcccggac

SEQ ID NO: 3897 - DNA, 24 bp, Artificial Sequence
  Description of Artificial Sequence:  Hypothetical Probe Sequence
ggacaggaatcgacggcctaccat

SEQ ID NO: 3898 - DNA, 24 bp, Artificial Sequence
  Description of Artificial Sequence:  Hypothetical Probe Sequence
ggacaggaaggattgaggacgtgc

SEQ ID NO: 3899 - DNA, 24 bp, Artificial Sequence
  Description of Artificial Sequence:  Hypothetical Probe Sequence
ggaccctacgaaaggatcgttgcg

SEQ ID NO: 3900 - DNA, 24 bp, Artificial Sequence
  Description of Artificial Sequence:  Hypothetical Probe Sequence
ggaccctagcttgcaagtgcgtct

SEQ ID NO: 3901 - DNA, 24 bp, Artificial Sequence
  Description of Artificial Sequence:  Hypothetical Probe Sequence
ggaccctagcaacagcgatgcgaa

SEQ ID NO: 3902 - DNA, 24 bp, Artificial Sequence
  Description of Artificial Sequence:  Hypothetical Probe Sequence
ggaccctacctagaccagccacgg

SEQ ID NO: 3903 - DNA, 24 bp, Artificial Sequence
  Description of Artificial Sequence:  Hypothetical Probe Sequence
ggacgatgctcactgttgcggacc

SEQ ID NO: 3904 - DNA, 24 bp, Artificial Sequence
  Description of Artificial Sequence:  Hypothetical Probe Sequence
ggacgatgggtaacggggtaccat

SEQ ID NO: 3905 - DNA, 24 bp, Artificial Sequence
  Description of Artificial Sequence:  Hypothetical Probe Sequence
ggacgatggtctagcccgaaagtg

SEQ ID NO: 3906 - DNA, 24 bp, Artificial Sequence
  Description of Artificial Sequence:  Hypothetical Probe Sequence
ggacgatgatcgcgaaagccgtct

SEQ ID NO: 3907 - DNA, 24 bp, Artificial Sequence
  Description of Artificial Sequence:  Hypothetical Probe Sequence
ggactccctgtccgttgcttgcaa

SEQ ID NO: 3908 - DNA, 24 bp, Artificial Sequence
  Description of Artificial Sequence:  Hypothetical Probe Sequence
ggactcccctgttacagacctgcg

SEQ ID NO: 3909 - DNA, 24 bp, Artificial Sequence
  Description of Artificial Sequence:  Hypothetical Probe Sequence
ggactcccccatttagcacggatg

SEQ ID NO: 3910 - DNA, 24 bp, Artificial Sequence
  Description of Artificial Sequence:  Hypothetical Probe Sequence
ggactcccacctagcccagctgtc

SEQ ID NO: 3911 - DNA, 24 bp, Artificial Sequence
  Description of Artificial Sequence:  Hypothetical Probe Sequence
ggactcccatcgcgaaaggaggac

SEQ ID NO: 3912 - DNA, 24 bp, Artificial Sequence
  Description of Artificial Sequence:  Hypothetical Probe Sequence
ggactccccacgcttgcgttagga

SEQ ID NO: 3913 - DNA, 24 bp, Artificial Sequence
  Description of Artificial Sequence:  Hypothetical Probe Sequence
ggactcccggacgcttcacgtgat

SEQ ID NO: 3914 - DNA, 24 bp, Artificial Sequence
  Description of Artificial Sequence:  Hypothetical Probe Sequence
ggactgcgttagccatcacgacgg

SEQ ID NO: 3915 - DNA, 24 bp, Artificial Sequence
  Description of Artificial Sequence:  Hypothetical Probe Sequence
ggactgcgtcgtcgttcagcagtg

SEQ ID NO: 3916 - DNA, 24 bp, Artificial Sequence
  Description of Artificial Sequence:  Hypothetical Probe Sequence
ggactgcgcttgacctcacgacct

SEQ ID NO: 3917 - DNA, 24 bp, Artificial Sequence
  Description of Artificial Sequence:  Hypothetical Probe Sequence
ggactgcgctcatcgtcgttttga

SEQ ID NO: 3918 - DNA, 24 bp, Artificial Sequence
  Description of Artificial Sequence:  Hypothetical Probe Sequence
ggactgcggcttaggagcttcacg

SEQ ID NO: 3919 - DNA, 24 bp, Artificial Sequence
  Description of Artificial Sequence:  Hypothetical Probe Sequence
ggactgcgacctttgagcaacgaa

SEQ ID NO: 3920 - DNA, 24 bp, Artificial Sequence
  Description of Artificial Sequence:  Hypothetical Probe Sequence
ggactgcgatcgacctccatggac

SEQ ID NO: 3921 - DNA, 24 bp, Artificial Sequence
  Description of Artificial Sequence:  Hypothetical Probe Sequence
ggactgcggatggagtatcgccat

SEQ ID NO: 3922 - DNA, 24 bp, Artificial Sequence
  Description of Artificial Sequence:  Hypothetical Probe Sequence
ggactgcgcacgataccagcagga

SEQ ID NO: 3923 - DNA, 24 bp, Artificial Sequence
  Description of Artificial Sequence:  Hypothetical Probe Sequence
ggactgcgggacccatccatggta

SEQ ID NO: 3924 - DNA, 24 bp, Artificial Sequence
  Description of Artificial Sequence:  Hypothetical Probe Sequence
ggaccacgtgatgacctccccgaa

SEQ ID NO: 3925 - DNA, 24 bp, Artificial Sequence
  Description of Artificial Sequence:  Hypothetical Probe Sequence
ggaccacgctcattgatcccctgt

SEQ ID NO: 3926 - DNA, 24 bp, Artificial Sequence
  Description of Artificial Sequence:  Hypothetical Probe Sequence
ggaccacggctttctgcacgagtg

SEQ ID NO: 3927 - DNA, 24 bp, Artificial Sequence
  Description of Artificial Sequence:  Hypothetical Probe Sequence
ggaccacggagtatcgctcacacg

SEQ ID NO: 3928 - DNA, 24 bp, Artificial Sequence
  Description of Artificial Sequence:  Hypothetical Probe Sequence
ggaccacgcacgctcagtgcccta

SEQ ID NO: 3929 - DNA, 24 bp, Artificial Sequence
  Description of Artificial Sequence:  Hypothetical Probe Sequence
ggaccacgacggtctgtgcgtgtc

SEQ ID NO: 3930 - DNA, 24 bp, Artificial Sequence
  Description of Artificial Sequence:  Hypothetical Probe Sequence
ggaccacgagcccgaacgtttgtc

SEQ ID NO: 3931 - DNA, 24 bp, Artificial Sequence
  Description of Artificial Sequence:  Hypothetical Probe Sequence
ggaccagcttgatcgtcgaaacgg

SEQ ID NO: 3932 - DNA, 24 bp, Artificial Sequence
  Description of Artificial Sequence:  Hypothetical Probe Sequence
ggaccagctgtccagcaggacgaa

SEQ ID NO: 3933 - DNA, 24 bp, Artificial Sequence
  Description of Artificial Sequence:  Hypothetical Probe Sequence
ggaccagccttgtgcgacggatac

SEQ ID NO: 3934 - DNA, 24 bp, Artificial Sequence
  Description of Artificial Sequence:  Hypothetical Probe Sequence
ggaccagcctgtggactgtccacg

SEQ ID NO: 3935 - DNA, 24 bp, Artificial Sequence
  Description of Artificial Sequence:  Hypothetical Probe Sequence
ggaccagcggtatgatgaccagcc

SEQ ID NO: 3936 - DNA, 24 bp, Artificial Sequence
  Description of Artificial Sequence:  Hypothetical Probe Sequence
ggaccagcagtgacctgtgcgctt

SEQ ID NO: 3937 - DNA, 24 bp, Artificial Sequence
  Description of Artificial Sequence:  Hypothetical Probe Sequence
ggaccagctgcggaccctcaggac

SEQ ID NO: 3938 - DNA, 24 bp, Artificial Sequence
  Description of Artificial Sequence:  Hypothetical Probe Sequence
ggacgaccttgagtgcgcaagcaa

SEQ ID NO: 3939 - DNA, 24 bp, Artificial Sequence
  Description of Artificial Sequence:  Hypothetical Probe Sequence
ggacgaccctgtagtgcgttcgaa

SEQ ID NO: 3940 - DNA, 24 bp, Artificial Sequence
  Description of Artificial Sequence:  Hypothetical Probe Sequence
ggacgaccggtagtgcagccaatc

SEQ ID NO: 3941 - DNA, 24 bp, Artificial Sequence
  Description of Artificial Sequence:  Hypothetical Probe Sequence
ggacgaccgtctgtgcacctcgaa

SEQ ID NO: 3942 - DNA, 24 bp, Artificial Sequence
  Description of Artificial Sequence:  Hypothetical Probe Sequence
ggacgaccgagtcttgggacgagt

SEQ ID NO: 3943 - DNA, 24 bp, Artificial Sequence
  Description of Artificial Sequence:  Hypothetical Probe Sequence
ggacgaccagtgaaaggtgcagcc

SEQ ID NO: 3944 - DNA, 24 bp, Artificial Sequence
  Description of Artificial Sequence:  Hypothetical Probe Sequence
ggacgaccgaccccatctcatccc

SEQ ID NO: 3945 - DNA, 24 bp, Artificial Sequence
  Description of Artificial Sequence:  Hypothetical Probe Sequence
ggacgtgctgattgattcccagga

SEQ ID NO: 3946 - DNA, 24 bp, Artificial Sequence
  Description of Artificial Sequence:  Hypothetical Probe Sequence
ggacgtgcaatcggaccgtttcgt

SEQ ID NO: 3947 - DNA, 24 bp, Artificial Sequence
  Description of Artificial Sequence:  Hypothetical Probe Sequence
ggacgtgctctgtcgtccatacgg

SEQ ID NO: 3948 - DNA, 24 bp, Artificial Sequence
  Description of Artificial Sequence:  Hypothetical Probe Sequence
ggacgtgctgtccagcacggagtg

SEQ ID NO: 3949 - DNA, 24 bp, Artificial Sequence
  Description of Artificial Sequence:  Hypothetical Probe Sequence
ggacgtgctcgtcgaagcaaacct

SEQ ID NO: 3950 - DNA, 24 bp, Artificial Sequence
  Description of Artificial Sequence:  Hypothetical Probe Sequence
ggacgtgccgttgcttcgaatgtc

SEQ ID NO: 3951 - DNA, 24 bp, Artificial Sequence
  Description of Artificial Sequence:  Hypothetical Probe Sequence
ggacgtgccgaaatactcccgtgc

SEQ ID NO: 3952 - DNA, 24 bp, Artificial Sequence
  Description of Artificial Sequence:  Hypothetical Probe Sequence
ggacgtgcggtatgtcggacagga

SEQ ID NO: 3953 - DNA, 24 bp, Artificial Sequence
  Description of Artificial Sequence:  Hypothetical Probe Sequence
ggacgtgcagtggtgctgcgacct

SEQ ID NO: 3954 - DNA, 24 bp, Artificial Sequence
  Description of Artificial Sequence:  Hypothetical Probe Sequence
ggacgtgccctacctatcgttccc

SEQ ID NO: 3955 - DNA, 24 bp, Artificial Sequence
  Description of Artificial Sequence:  Hypothetical Probe Sequence
ggacgtgctgcgtgtccttgcttg

SEQ ID NO: 3956 - DNA, 24 bp, Artificial Sequence
  Description of Artificial Sequence:  Hypothetical Probe Sequence
ggacgtgccacgggacagtgcttg

SEQ ID NO: 3957 - DNA, 24 bp, Artificial Sequence
  Description of Artificial Sequence:  Hypothetical Probe Sequence
ggacgtgcacggtgattgtcgacc

SEQ ID NO: 3958 - DNA, 24 bp, Artificial Sequence
  Description of Artificial Sequence:  Hypothetical Probe Sequence
ggacggactcgtctgtcacgggac

SEQ ID NO: 3959 - DNA, 24 bp, Artificial Sequence
  Description of Artificial Sequence:  Hypothetical Probe Sequence
ggacggaccgttttaggaccgacc

SEQ ID NO: 3960 - DNA, 24 bp, Artificial Sequence
  Description of Artificial Sequence:  Hypothetical Probe Sequence
ggacggacctgttacatccccacg

SEQ ID NO: 3961 - DNA, 24 bp, Artificial Sequence
  Description of Artificial Sequence:  Hypothetical Probe Sequence
ggacggaccgaagatgcagcctgt

SEQ ID NO: 3962 - DNA, 24 bp, Artificial Sequence
  Description of Artificial Sequence:  Hypothetical Probe Sequence
ggacggacgagttacatgcgacgg

SEQ ID NO: 3963 - DNA, 24 bp, Artificial Sequence
  Description of Artificial Sequence:  Hypothetical Probe Sequence
ggacggacacctgcaacttggcaa

SEQ ID NO: 3964 - DNA, 24 bp, Artificial Sequence
  Description of Artificial Sequence:  Hypothetical Probe Sequence
ggacggacgatgttagacggagcc

SEQ ID NO: 3965 - DNA, 24 bp, Artificial Sequence
  Description of Artificial Sequence:  Hypothetical Probe Sequence
ggacggactcccagtgacggtcgt

SEQ ID NO: 3966 - DNA, 24 bp, Artificial Sequence
  Description of Artificial Sequence:  Hypothetical Probe Sequence
ggacggactgcgaggatctgccat

SEQ ID NO: 3967 - DNA, 24 bp, Artificial Sequence
  Description of Artificial Sequence:  Hypothetical Probe Sequence
ggacggaccagcccatgcttaaag

SEQ ID NO: 3968 - DNA, 24 bp, Artificial Sequence
  Description of Artificial Sequence:  Hypothetical Probe Sequence
ggacacggttaggacctgcgagcc

SEQ ID NO: 3969 - DNA, 24 bp, Artificial Sequence
  Description of Artificial Sequence:  Hypothetical Probe Sequence
ggacacggtctgagcctcgtgtgc

SEQ ID NO: 3970 - DNA, 24 bp, Artificial Sequence
  Description of Artificial Sequence:  Hypothetical Probe Sequence
ggacacggcgttaatctgcgagtg

SEQ ID NO: 3971 - DNA, 24 bp, Artificial Sequence
  Description of Artificial Sequence:  Hypothetical Probe Sequence
ggacacggctgttacagctttccc

SEQ ID NO: 3972 - DNA, 24 bp, Artificial Sequence
  Description of Artificial Sequence:  Hypothetical Probe Sequence
ggacacgggagtcgaaggacatcg

SEQ ID NO: 3973 - DNA, 24 bp, Artificial Sequence
  Description of Artificial Sequence:  Hypothetical Probe Sequence
ggacacggagtgcgttcctaagcc

SEQ ID NO: 3974 - DNA, 24 bp, Artificial Sequence
  Description of Artificial Sequence:  Hypothetical Probe Sequence
ggacagcccgttcttgaatccagc

SEQ ID NO: 3975 - DNA, 24 bp, Artificial Sequence
  Description of Artificial Sequence:  Hypothetical Probe Sequence
ggacagccctgtaaagagccgacc

SEQ ID NO: 3976 - DNA, 24 bp, Artificial Sequence
  Description of Artificial Sequence:  Hypothetical Probe Sequence
ggacagcctgcggcaactcagtgc

SEQ ID NO: 3977 - DNA, 24 bp, Artificial Sequence
  Description of Artificial Sequence:  Hypothetical Probe Sequence
ggacagcccacgcacgtgatgcaa

SEQ ID NO: 3978 - DNA, 24 bp, Artificial Sequence
  Description of Artificial Sequence:  Hypothetical Probe Sequence
ggacagccgacccgttctgtcacg

SEQ ID NO: 3979 - DNA, 24 bp, Artificial Sequence
  Description of Artificial Sequence:  Hypothetical Probe Sequence
ggacagccggaccctactcaacgg

SEQ ID NO: 3980 - DNA, 24 bp, Artificial Sequence
  Description of Artificial Sequence:  Hypothetical Probe Sequence
acggttgaccattgattgcggctt

SEQ ID NO: 3981 - DNA, 24 bp, Artificial Sequence
  Description of Artificial Sequence:  Hypothetical Probe Sequence
acggttgacagccacgatcgctca

SEQ ID NO: 3982 - DNA, 24 bp, Artificial Sequence
  Description of Artificial Sequence:  Hypothetical Probe Sequence
acggttgagaccggacgatgacgg

SEQ ID NO: 3983 - DNA, 24 bp, Artificial Sequence
  Description of Artificial Sequence:  Hypothetical Probe Sequence
acggttgagtgctgcgttgatccc

SEQ ID NO: 3984 - DNA, 24 bp, Artificial Sequence
  Description of Artificial Sequence:  Hypothetical Probe Sequence
acggtgatcgaagcaaatcgcagc

SEQ ID NO: 3985 - DNA, 24 bp, Artificial Sequence
  Description of Artificial Sequence:  Hypothetical Probe Sequence
acggtgatgcaaaccttccctcgt

SEQ ID NO: 3986 - DNA, 24 bp, Artificial Sequence
  Description of Artificial Sequence:  Hypothetical Probe Sequence
acggtgatggactccctgcggtct

SEQ ID NO: 3987 - DNA, 24 bp, Artificial Sequence
  Description of Artificial Sequence:  Hypothetical Probe Sequence
acggttaggcaacacggatggacc

SEQ ID NO: 3988 - DNA, 24 bp, Artificial Sequence
  Description of Artificial Sequence:  Hypothetical Probe Sequence
acggttagtcccaaagggactccc

SEQ ID NO: 3989 - DNA, 24 bp, Artificial Sequence
  Description of Artificial Sequence:  Hypothetical Probe Sequence
acggttagcacgcagcttgaagcc

SEQ ID NO: 3990 - DNA, 24 bp, Artificial Sequence
  Description of Artificial Sequence:  Hypothetical Probe Sequence
acggaatcccattcgtagccgacc

SEQ ID NO: 3991 - DNA, 24 bp, Artificial Sequence
  Description of Artificial Sequence:  Hypothetical Probe Sequence
acggaatccgaaacctggacccta

SEQ ID NO: 3992 - DNA, 24 bp, Artificial Sequence
  Description of Artificial Sequence:  Hypothetical Probe Sequence
acggaatcatcgagcccagcagtg

SEQ ID NO: 3993 - DNA, 24 bp, Artificial Sequence
  Description of Artificial Sequence:  Hypothetical Probe Sequence
acggaatccctacacgagccacgg

SEQ ID NO: 3994 - DNA, 24 bp, Artificial Sequence
  Description of Artificial Sequence:  Hypothetical Probe Sequence
acggaatcgatgtctggacctccc

SEQ ID NO: 3995 - DNA, 24 bp, Artificial Sequence
  Description of Artificial Sequence:  Hypothetical Probe Sequence
acggaatctcccggtagcaacgaa

SEQ ID NO: 3996 - DNA, 24 bp, Artificial Sequence
  Description of Artificial Sequence:  Hypothetical Probe Sequence
acggaatcggactgatacggccat

SEQ ID NO: 3997 - DNA, 24 bp, Artificial Sequence
  Description of Artificial Sequence:  Hypothetical Probe Sequence
acggataccgaacgttcgaacgaa

SEQ ID NO: 3998 - DNA, 24 bp, Artificial Sequence
  Description of Artificial Sequence:  Hypothetical Probe Sequence
acggatacgcttgacccgttatcg

SEQ ID NO: 3999 - DNA, 24 bp, Artificial Sequence
  Description of Artificial Sequence:  Hypothetical Probe Sequence
acggatacggacttgacacgcgaa

SEQ ID NO: 4000 - DNA, 24 bp, Artificial Sequence
  Description of Artificial Sequence:  Hypothetical Probe Sequence
acggaaagctcagcaacagcgtct

SEQ ID NO: 4001 - DNA, 24 bp, Artificial Sequence
  Description of Artificial Sequence:  Hypothetical Probe Sequence
acggaaagctgtatcgcttggacc

SEQ ID NO: 4002 - DNA, 24 bp, Artificial Sequence
  Description of Artificial Sequence:  Hypothetical Probe Sequence
acggaaagcgaattagacggggac

SEQ ID NO: 4003 - DNA, 24 bp, Artificial Sequence
  Description of Artificial Sequence:  Hypothetical Probe Sequence
acggaaaggagtatcgtcccccat

SEQ ID NO: 4004 - DNA, 24 bp, Artificial Sequence
  Description of Artificial Sequence:  Hypothetical Probe Sequence
acggaaagaggacacgtccccagc

SEQ ID NO: 4005 - DNA, 24 bp, Artificial Sequence
  Description of Artificial Sequence:  Hypothetical Probe Sequence
acggaaagcagctcgtgtgctgat

SEQ ID NO: 4006 - DNA, 24 bp, Artificial Sequence
  Description of Artificial Sequence:  Hypothetical Probe Sequence
acggaaaggtgcgaccccatatcg

SEQ ID NO: 4007 - DNA, 24 bp, Artificial Sequence
  Description of Artificial Sequence:  Hypothetical Probe Sequence
acggaaagagccggtagcaaacgg

SEQ ID NO: 4008 - DNA, 24 bp, Artificial Sequence
  Description of Artificial Sequence:  Hypothetical Probe Sequence
acggtacagcttgatggctttgcg

SEQ ID NO: 4009 - DNA, 24 bp, Artificial Sequence
  Description of Artificial Sequence:  Hypothetical Probe Sequence
acggtacatgcgtccctgatacgg

SEQ ID NO: 4010 - DNA, 24 bp, Artificial Sequence
  Description of Artificial Sequence:  Hypothetical Probe Sequence
acggtctgaaagcacgcacgcgaa

SEQ ID NO: 4011 - DNA, 24 bp, Artificial Sequence
  Description of Artificial Sequence:  Hypothetical Probe Sequence
acggtctgcgttgaccagtgtccc

SEQ ID NO: 4012 - DNA, 24 bp, Artificial Sequence
  Description of Artificial Sequence:  Hypothetical Probe Sequence
acggtctgctcacgttcagcagga

SEQ ID NO: 4013 - DNA, 24 bp, Artificial Sequence
  Description of Artificial Sequence:  Hypothetical Probe Sequence
acggtctgctgtcgaaatcggatg

SEQ ID NO: 4014 - DNA, 24 bp, Artificial Sequence
  Description of Artificial Sequence:  Hypothetical Probe Sequence
acggtctgccatgtgccacgtgtc

SEQ ID NO: 4015 - DNA, 24 bp, Artificial Sequence
  Description of Artificial Sequence:  Hypothetical Probe Sequence
acggtctgggtattgaatcgtgcg

SEQ ID NO: 4016 - DNA, 24 bp, Artificial Sequence
  Description of Artificial Sequence:  Hypothetical Probe Sequence
acggtctgaggaacctagccgcaa

SEQ ID NO: 4017 - DNA, 24 bp, Artificial Sequence
  Description of Artificial Sequence:  Hypothetical Probe Sequence
acggtctgggacccatacgggtct

SEQ ID NO: 4018 - DNA, 24 bp, Artificial Sequence
  Description of Artificial Sequence:  Hypothetical Probe Sequence
acggtgtcctcaggacgtgcctgt

SEQ ID NO: 4019 - DNA, 24 bp, Artificial Sequence
  Description of Artificial Sequence:  Hypothetical Probe Sequence
acggtgtcccatatcgaatcgctt

SEQ ID NO: 4020 - DNA, 24 bp, Artificial Sequence
  Description of Artificial Sequence:  Hypothetical Probe Sequence
acggtgtcggtaagtggtcttgcg

SEQ ID NO: 4021 - DNA, 24 bp, Artificial Sequence
  Description of Artificial Sequence:  Hypothetical Probe Sequence
acggtgtccacgacctgaccgatg

SEQ ID NO: 4022 - DNA, 24 bp, Artificial Sequence
  Description of Artificial Sequence:  Hypothetical Probe Sequence
acggtcgttgatttgaacggcacg

SEQ ID NO: 4023 - DNA, 24 bp, Artificial Sequence
  Description of Artificial Sequence:  Hypothetical Probe Sequence
acggtcgtcgttttagacggcagc

SEQ ID NO: 4024 - DNA, 24 bp, Artificial Sequence
  Description of Artificial Sequence:  Hypothetical Probe Sequence
acggtcgtctcattagcagctgcg

SEQ ID NO: 4025 - DNA, 24 bp, Artificial Sequence
  Description of Artificial Sequence:  Hypothetical Probe Sequence
acggtcgtgcttaggacgttcacg

SEQ ID NO: 4026 - DNA, 24 bp, Artificial Sequence
  Description of Artificial Sequence:  Hypothetical Probe Sequence
acggtcgtaccttcgttgcgaaag

SEQ ID NO: 4027 - DNA, 24 bp, Artificial Sequence
  Description of Artificial Sequence:  Hypothetical Probe Sequence
acggtcgtgatgaaagggactgcg

SEQ ID NO: 4028 - DNA, 24 bp, Artificial Sequence
  Description of Artificial Sequence:  Hypothetical Probe Sequence
acggtcgttgcgcttgtcgttcgt

SEQ ID NO: 4029 - DNA, 24 bp, Artificial Sequence
  Description of Artificial Sequence:  Hypothetical Probe Sequence
acggtcgtgtgcccatgatgctca

SEQ ID NO: 4030 - DNA, 24 bp, Artificial Sequence
  Description of Artificial Sequence:  Hypothetical Probe Sequence
acggtcgtacggatactgcggacc

SEQ ID NO: 4031 - DNA, 24 bp, Artificial Sequence
  Description of Artificial Sequence:  Hypothetical Probe Sequence
acggcttgtctgaggagtgcacgg

SEQ ID NO: 4032 - DNA, 24 bp, Artificial Sequence
  Description of Artificial Sequence:  Hypothetical Probe Sequence
acggcttgtcgtgcttaatcagcc

SEQ ID NO: 4033 - DNA, 24 bp, Artificial Sequence
  Description of Artificial Sequence:  Hypothetical Probe Sequence
acggcttgggtactcacacggtgc

SEQ ID NO: 4034 - DNA, 24 bp, Artificial Sequence
  Description of Artificial Sequence:  Hypothetical Probe Sequence
acggcttggagtcgttcagcctca

SEQ ID NO: 4035 - DNA, 24 bp, Artificial Sequence
  Description of Artificial Sequence:  Hypothetical Probe Sequence
acggcttgagtgtccctctggcaa

SEQ ID NO: 4036 - DNA, 24 bp, Artificial Sequence
  Description of Artificial Sequence:  Hypothetical Probe Sequence
acggcttgacctgaccccatccat

SEQ ID NO: 4037 - DNA, 24 bp, Artificial Sequence
  Description of Artificial Sequence:  Hypothetical Probe Sequence
acggcttgaggaggactcccgtct

SEQ ID NO: 4038 - DNA, 24 bp, Artificial Sequence
  Description of Artificial Sequence:  Hypothetical Probe Sequence
acggcttgcagccagctgattcgt

SEQ ID NO: 4039 - DNA, 24 bp, Artificial Sequence
  Description of Artificial Sequence:  Hypothetical Probe Sequence
acggcttggtgcccattgatgtgc

SEQ ID NO: 4040 - DNA, 24 bp, Artificial Sequence
  Description of Artificial Sequence:  Hypothetical Probe Sequence
acggcttgggaccacgacctggta

SEQ ID NO: 4041 - DNA, 24 bp, Artificial Sequence
  Description of Artificial Sequence:  Hypothetical Probe Sequence
acggcttgacggataccgtttcgt

SEQ ID NO: 4042 - DNA, 24 bp, Artificial Sequence
  Description of Artificial Sequence:  Hypothetical Probe Sequence
acggcgtttgatgatgatcggacc

SEQ ID NO: 4043 - DNA, 24 bp, Artificial Sequence
  Description of Artificial Sequence:  Hypothetical Probe Sequence
acggcgtttacagaccctgtggac

SEQ ID NO: 4044 - DNA, 24 bp, Artificial Sequence
  Description of Artificial Sequence:  Hypothetical Probe Sequence
acggcgtttctggtctcagcccat

SEQ ID NO: 4045 - DNA, 24 bp, Artificial Sequence
  Description of Artificial Sequence:  Hypothetical Probe Sequence
acggcgtttgtcttgaaggacagc

SEQ ID NO: 4046 - DNA, 24 bp, Artificial Sequence
  Description of Artificial Sequence:  Hypothetical Probe Sequence
acggcgttctcattgaaaagcgaa

SEQ ID NO: 4047 - DNA, 24 bp, Artificial Sequence
  Description of Artificial Sequence:  Hypothetical Probe Sequence
acggcgttctgtacctcttgtgcg

SEQ ID NO: 4048 - DNA, 24 bp, Artificial Sequence
  Description of Artificial Sequence:  Hypothetical Probe Sequence
acggcgttgcttgcttaggagtgc

SEQ ID NO: 4049 - DNA, 24 bp, Artificial Sequence
  Description of Artificial Sequence:  Hypothetical Probe Sequence
acggcgttggtatcgtaggacgtt

SEQ ID NO: 4050 - DNA, 24 bp, Artificial Sequence
  Description of Artificial Sequence:  Hypothetical Probe Sequence
acggcgttacctagtgacggctgt

SEQ ID NO: 4051 - DNA, 24 bp, Artificial Sequence
  Description of Artificial Sequence:  Hypothetical Probe Sequence
acggcgttaggaatcggtctcgtt

SEQ ID NO: 4052 - DNA, 24 bp, Artificial Sequence
  Description of Artificial Sequence:  Hypothetical Probe Sequence
acggcgttcctaaatcgtgcttga

SEQ ID NO: 4053 - DNA, 24 bp, Artificial Sequence
  Description of Artificial Sequence:  Hypothetical Probe Sequence
acggcgtttgcgttgagatgagcc

SEQ ID NO: 4054 - DNA, 24 bp, Artificial Sequence
  Description of Artificial Sequence:  Hypothetical Probe Sequence
acggcgttcacggtcttcgttcgt

SEQ ID NO: 4055 - DNA, 24 bp, Artificial Sequence
  Description of Artificial Sequence:  Hypothetical Probe Sequence
acggcgttcagctgcgtgatctca

SEQ ID NO: 4056 - DNA, 24 bp, Artificial Sequence
  Description of Artificial Sequence:  Hypothetical Probe Sequence
acggcgttggacacctgctttgtc

SEQ ID NO: 4057 - DNA, 24 bp, Artificial Sequence
  Description of Artificial Sequence:  Hypothetical Probe Sequence
acggcgttacggtacaatcgtgcg

SEQ ID NO: 4058 - DNA, 24 bp, Artificial Sequence
  Description of Artificial Sequence:  Hypothetical Probe Sequence
acggctcatgatcacgacggcttg

SEQ ID NO: 4059 - DNA, 24 bp, Artificial Sequence
  Description of Artificial Sequence:  Hypothetical Probe Sequence
acggctcattaggcaacgttcgaa

SEQ ID NO: 4060 - DNA, 24 bp, Artificial Sequence
  Description of Artificial Sequence:  Hypothetical Probe Sequence
acggctcaaaaggtgcgcaaaatc

SEQ ID NO: 4061 - DNA, 24 bp, Artificial Sequence
  Description of Artificial Sequence:  Hypothetical Probe Sequence
acggctcatcgtatcgagtgacgg

SEQ ID NO: 4062 - DNA, 24 bp, Artificial Sequence
  Description of Artificial Sequence:  Hypothetical Probe Sequence
acggctcacgttctgtccatgctt

SEQ ID NO: 4063 - DNA, 24 bp, Artificial Sequence
  Description of Artificial Sequence:  Hypothetical Probe Sequence
acggctcagcttgcaatgcgaatc

SEQ ID NO: 4064 - DNA, 24 bp, Artificial Sequence
  Description of Artificial Sequence:  Hypothetical Probe Sequence
acggctcaggtaatacggacgtgc

SEQ ID NO: 4065 - DNA, 24 bp, Artificial Sequence
  Description of Artificial Sequence:  Hypothetical Probe Sequence
acggctcagcaaaggactgtacgg

SEQ ID NO: 4066 - DNA, 24 bp, Artificial Sequence
  Description of Artificial Sequence:  Hypothetical Probe Sequence
acggctcacctacctaagccgtgc

SEQ ID NO: 4067 - DNA, 24 bp, Artificial Sequence
  Description of Artificial Sequence:  Hypothetical Probe Sequence
acggctcatgcggatgagtgtgcg

SEQ ID NO: 4068 - DNA, 24 bp, Artificial Sequence
  Description of Artificial Sequence:  Hypothetical Probe Sequence
acggctcagacccttggtgcttga

SEQ ID NO: 4069 - DNA, 24 bp, Artificial Sequence
  Description of Artificial Sequence:  Hypothetical Probe Sequence
acggctgtaatctctgtcccgtgc

SEQ ID NO: 4070 - DNA, 24 bp, Artificial Sequence
  Description of Artificial Sequence:  Hypothetical Probe Sequence
acggctgttctgggacgaccgatg

SEQ ID NO: 4071 - DNA, 24 bp, Artificial Sequence
  Description of Artificial Sequence:  Hypothetical Probe Sequence
acggctgtcgaaagtggaccggta

SEQ ID NO: 4072 - DNA, 24 bp, Artificial Sequence
  Description of Artificial Sequence:  Hypothetical Probe Sequence
acggctgtgcttctgtgcaaagga

SEQ ID NO: 4073 - DNA, 24 bp, Artificial Sequence
  Description of Artificial Sequence:  Hypothetical Probe Sequence
acggctgtgtcttgcggagtcagc

SEQ ID NO: 4074 - DNA, 24 bp, Artificial Sequence
  Description of Artificial Sequence:  Hypothetical Probe Sequence
acggctgtgagtagtgagcccagc

SEQ ID NO: 4075 - DNA, 24 bp, Artificial Sequence
  Description of Artificial Sequence:  Hypothetical Probe Sequence
acggctgtaccttgtcagccgcaa

SEQ ID NO: 4076 - DNA, 24 bp, Artificial Sequence
  Description of Artificial Sequence:  Hypothetical Probe Sequence
acggctgtacggtgattcgtgcaa

SEQ ID NO: 4077 - DNA, 24 bp, Artificial Sequence
  Description of Artificial Sequence:  Hypothetical Probe Sequence
acggccattgtccgtttctgctgt

SEQ ID NO: 4078 - DNA, 24 bp, Artificial Sequence
  Description of Artificial Sequence:  Hypothetical Probe Sequence
acggccattcgtgtgccctaggta

SEQ ID NO: 4079 - DNA, 24 bp, Artificial Sequence
  Description of Artificial Sequence:  Hypothetical Probe Sequence
acggccatctcaacctcttgccat

SEQ ID NO: 4080 - DNA, 24 bp, Artificial Sequence
  Description of Artificial Sequence:  Hypothetical Probe Sequence
acggccatagtgccatagccagga

SEQ ID NO: 4081 - DNA, 24 bp, Artificial Sequence
  Description of Artificial Sequence:  Hypothetical Probe Sequence
acggccatcctagctttgtctccc

SEQ ID NO: 4082 - DNA, 24 bp, Artificial Sequence
  Description of Artificial Sequence:  Hypothetical Probe Sequence
acggccattcccccatctgtcacg

SEQ ID NO: 4083 - DNA, 24 bp, Artificial Sequence
  Description of Artificial Sequence:  Hypothetical Probe Sequence
acggccattgcgcgttgagtcgtt

SEQ ID NO: 4084 - DNA, 24 bp, Artificial Sequence
  Description of Artificial Sequence:  Hypothetical Probe Sequence
acggccatgaccctgtccatacgg

SEQ ID NO: 4085 - DNA, 24 bp, Artificial Sequence
  Description of Artificial Sequence:  Hypothetical Probe Sequence
acggccatagcccctaaaaggcaa

SEQ ID NO: 4086 - DNA, 24 bp, Artificial Sequence
  Description of Artificial Sequence:  Hypothetical Probe Sequence
acggcgaattgaagtgatcggctt

SEQ ID NO: 4087 - DNA, 24 bp, Artificial Sequence
  Description of Artificial Sequence:  Hypothetical Probe Sequence
acggcgaatgataggacagcgatg

SEQ ID NO: 4088 - DNA, 24 bp, Artificial Sequence
  Description of Artificial Sequence:  Hypothetical Probe Sequence
acggcgaattaggatgcttgacgg

SEQ ID NO: 4089 - DNA, 24 bp, Artificial Sequence
  Description of Artificial Sequence:  Hypothetical Probe Sequence
acggcgaaaatctacaatcggtgc

SEQ ID NO: 4090 - DNA, 24 bp, Artificial Sequence
  Description of Artificial Sequence:  Hypothetical Probe Sequence
acggcgaatctgtctgggtatcgt

SEQ ID NO: 4091 - DNA, 24 bp, Artificial Sequence
  Description of Artificial Sequence:  Hypothetical Probe Sequence
acggcgaatcgttgatcgtttccc

SEQ ID NO: 4092 - DNA, 24 bp, Artificial Sequence
  Description of Artificial Sequence:  Hypothetical Probe Sequence
acggcgaacttggagtgtgcatcg

SEQ ID NO: 4093 - DNA, 24 bp, Artificial Sequence
  Description of Artificial Sequence:  Hypothetical Probe Sequence
acggcgaacgtttcgtctgtcgaa

SEQ ID NO: 4094 - DNA, 24 bp, Artificial Sequence
  Description of Artificial Sequence:  Hypothetical Probe Sequence
acggcgaactcattgaccatcgtt

SEQ ID NO: 4095 - DNA, 24 bp, Artificial Sequence
  Description of Artificial Sequence:  Hypothetical Probe Sequence
acggcgaaggtatctgagtgcgtt

SEQ ID NO: 4096 - DNA, 24 bp, Artificial Sequence
  Description of Artificial Sequence:  Hypothetical Probe Sequence
acggcgaagagtgatggatgtgcg

SEQ ID NO: 4097 - DNA, 24 bp, Artificial Sequence
  Description of Artificial Sequence:  Hypothetical Probe Sequence
acggcgaaatcgaggatgtctgcg

SEQ ID NO: 4098 - DNA, 24 bp, Artificial Sequence
  Description of Artificial Sequence:  Hypothetical Probe Sequence
acggcgaatcccacctgcttggta

SEQ ID NO: 4099 - DNA, 24 bp, Artificial Sequence
  Description of Artificial Sequence:  Hypothetical Probe Sequence
acggcgaacacgcttggagttcgt

SEQ ID NO: 4100 - DNA, 24 bp, Artificial Sequence
  Description of Artificial Sequence:  Hypothetical Probe Sequence
acggcgaagtgcacggtcgtccta

SEQ ID NO: 4101 - DNA, 24 bp, Artificial Sequence
  Description of Artificial Sequence:  Hypothetical Probe Sequence
acggcgaaggacctcacacgctgt

SEQ ID NO: 4102 - DNA, 24 bp, Artificial Sequence
  Description of Artificial Sequence:  Hypothetical Probe Sequence
acggcgaaagccaatccgaacttg

SEQ ID NO: 4103 - DNA, 24 bp, Artificial Sequence
  Description of Artificial Sequence:  Hypothetical Probe Sequence
acgggcttttgacctaatcgcttg

SEQ ID NO: 4104 - DNA, 24 bp, Artificial Sequence
  Description of Artificial Sequence:  Hypothetical Probe Sequence
acgggctttgattacatgcgatcg

SEQ ID NO: 4105 - DNA, 24 bp, Artificial Sequence
  Description of Artificial Sequence:  Hypothetical Probe Sequence
acgggcttttaggtgccgttctca

SEQ ID NO: 4106 - DNA, 24 bp, Artificial Sequence
  Description of Artificial Sequence:  Hypothetical Probe Sequence
acgggcttaaagcctatccccagc

SEQ ID NO: 4107 - DNA, 24 bp, Artificial Sequence
  Description of Artificial Sequence:  Hypothetical Probe Sequence
acgggctttacatcgtcagcagga

SEQ ID NO: 4108 - DNA, 24 bp, Artificial Sequence
  Description of Artificial Sequence:  Hypothetical Probe Sequence
acgggcttcgttctcacgtttccc

SEQ ID NO: 4109 - DNA, 24 bp, Artificial Sequence
  Description of Artificial Sequence:  Hypothetical Probe Sequence
acgggcttctcatcgtcctaagcc

SEQ ID NO: 4110 - DNA, 24 bp, Artificial Sequence
  Description of Artificial Sequence:  Hypothetical Probe Sequence
acgggcttctgtaggagcttcgaa

SEQ ID NO: 4111 - DNA, 24 bp, Artificial Sequence
  Description of Artificial Sequence:  Hypothetical Probe Sequence
acgggcttggtaaaagctgtcgaa

SEQ ID NO: 4112 - DNA, 24 bp, Artificial Sequence
  Description of Artificial Sequence:  Hypothetical Probe Sequence
acgggcttgagtggtagtgccgtt

SEQ ID NO: 4113 - DNA, 24 bp, Artificial Sequence
  Description of Artificial Sequence:  Hypothetical Probe Sequence
acgggctttcccgcttccatccta

SEQ ID NO: 4114 - DNA, 24 bp, Artificial Sequence
  Description of Artificial Sequence:  Hypothetical Probe Sequence
acgggcttgaccttgattagtgcg

SEQ ID NO: 4115 - DNA, 24 bp, Artificial Sequence
  Description of Artificial Sequence:  Hypothetical Probe Sequence
acggggtatgatcacggatgccta

SEQ ID NO: 4116 - DNA, 24 bp, Artificial Sequence
  Description of Artificial Sequence:  Hypothetical Probe Sequence
acggggtatacaagccgtgcttga

SEQ ID NO: 4117 - DNA, 24 bp, Artificial Sequence
  Description of Artificial Sequence:  Hypothetical Probe Sequence
acggggtatctgacggagtgtccc

SEQ ID NO: 4118 - DNA, 24 bp, Artificial Sequence
  Description of Artificial Sequence:  Hypothetical Probe Sequence
acggggtacgttcacgaatctcgt

SEQ ID NO: 4119 - DNA, 24 bp, Artificial Sequence
  Description of Artificial Sequence:  Hypothetical Probe Sequence
acggggtactgtgagttccccacg

SEQ ID NO: 4120 - DNA, 24 bp, Artificial Sequence
  Description of Artificial Sequence:  Hypothetical Probe Sequence
acggggtagcttggtacagccgaa

SEQ ID NO: 4121 - DNA, 24 bp, Artificial Sequence
  Description of Artificial Sequence:  Hypothetical Probe Sequence
acggggtagcaaaatccgaagacc

SEQ ID NO: 4122 - DNA, 24 bp, Artificial Sequence
  Description of Artificial Sequence:  Hypothetical Probe Sequence
acggggtaaggagtctcacgagcc

SEQ ID NO: 4123 - DNA, 24 bp, Artificial Sequence
  Description of Artificial Sequence:  Hypothetical Probe Sequence
acggggtacctatccctcgtccat

SEQ ID NO: 4124 - DNA, 24 bp, Artificial Sequence
  Description of Artificial Sequence:  Hypothetical Probe Sequence
acggggtatgcgcgttaggagacc

SEQ ID NO: 4125 - DNA, 24 bp, Artificial Sequence
  Description of Artificial Sequence:  Hypothetical Probe Sequence
acggggtagtgcatacgagttgcg

SEQ ID NO: 4126 - DNA, 24 bp, Artificial Sequence
  Description of Artificial Sequence:  Hypothetical Probe Sequence
acggggtaggactctgcttgagcc

SEQ ID NO: 4127 - DNA, 24 bp, Artificial Sequence
  Description of Artificial Sequence:  Hypothetical Probe Sequence
acggggtaacggcctaaatccacg

SEQ ID NO: 4128 - DNA, 24 bp, Artificial Sequence
  Description of Artificial Sequence:  Hypothetical Probe Sequence
acggggtaagcccgaactgtacgg

SEQ ID NO: 4129 - DNA, 24 bp, Artificial Sequence
  Description of Artificial Sequence:  Hypothetical Probe Sequence
acgggtctaaagcgaatccccttg

SEQ ID NO: 4130 - DNA, 24 bp, Artificial Sequence
  Description of Artificial Sequence:  Hypothetical Probe Sequence
acgggtctcgttgcaagatggtgc

SEQ ID NO: 4131 - DNA, 24 bp, Artificial Sequence
  Description of Artificial Sequence:  Hypothetical Probe Sequence
acgggtctctcaagccacctcgtt

SEQ ID NO: 4132 - DNA, 24 bp, Artificial Sequence
  Description of Artificial Sequence:  Hypothetical Probe Sequence
acgggtctcgaaggacgtctggac

SEQ ID NO: 4133 - DNA, 24 bp, Artificial Sequence
  Description of Artificial Sequence:  Hypothetical Probe Sequence
acgggtctatcgacgggcttcgaa

SEQ ID NO: 4134 - DNA, 24 bp, Artificial Sequence
  Description of Artificial Sequence:  Hypothetical Probe Sequence
acgggtctgacccttgggactcgt

SEQ ID NO: 4135 - DNA, 24 bp, Artificial Sequence
  Description of Artificial Sequence:  Hypothetical Probe Sequence
acgggtctgtgcaaaggatgtccc

SEQ ID NO: 4136 - DNA, 24 bp, Artificial Sequence
  Description of Artificial Sequence:  Hypothetical Probe Sequence
acgggtctacgggacctcgtggac

SEQ ID NO: 4137 - DNA, 24 bp, Artificial Sequence
  Description of Artificial Sequence:  Hypothetical Probe Sequence
acgggagttgatctgttcccccat

SEQ ID NO: 4138 - DNA, 24 bp, Artificial Sequence
  Description of Artificial Sequence:  Hypothetical Probe Sequence
acgggagtcttgcagcaccttccc

SEQ ID NO: 4139 - DNA, 24 bp, Artificial Sequence
  Description of Artificial Sequence:  Hypothetical Probe Sequence
acgggagtctcaagccaaagccat

SEQ ID NO: 4140 - DNA, 24 bp, Artificial Sequence
  Description of Artificial Sequence:  Hypothetical Probe Sequence
acgggagtggtaagtggtgcgcaa

SEQ ID NO: 4141 - DNA, 24 bp, Artificial Sequence
  Description of Artificial Sequence:  Hypothetical Probe Sequence
acgggagtgatggtgctctggcaa

SEQ ID NO: 4142 - DNA, 24 bp, Artificial Sequence
  Description of Artificial Sequence:  Hypothetical Probe Sequence
acgggagttcccctgtcacgatcg

SEQ ID NO: 4143 - DNA, 24 bp, Artificial Sequence
  Description of Artificial Sequence:  Hypothetical Probe Sequence
acgggagtcagctgatgaccgacc

SEQ ID NO: 4144 - DNA, 24 bp, Artificial Sequence
  Description of Artificial Sequence:  Hypothetical Probe Sequence
acgggcaaaatcagtgccatccat

SEQ ID NO: 4145 - DNA, 24 bp, Artificial Sequence
  Description of Artificial Sequence:  Hypothetical Probe Sequence
acgggcaaatacagtgatcggcaa

SEQ ID NO: 4146 - DNA, 24 bp, Artificial Sequence
  Description of Artificial Sequence:  Hypothetical Probe Sequence
acgggcaatacacttgagccggta

SEQ ID NO: 4147 - DNA, 24 bp, Artificial Sequence
  Description of Artificial Sequence:  Hypothetical Probe Sequence
acgggcaacgttttagcctaagcc

SEQ ID NO: 4148 - DNA, 24 bp, Artificial Sequence
  Description of Artificial Sequence:  Hypothetical Probe Sequence
acgggcaagcttcgaacagctctg

SEQ ID NO: 4149 - DNA, 24 bp, Artificial Sequence
  Description of Artificial Sequence:  Hypothetical Probe Sequence
acgggcaagagtctcagaccccat

SEQ ID NO: 4150 - DNA, 24 bp, Artificial Sequence
  Description of Artificial Sequence:  Hypothetical Probe Sequence
acgggcaagcaaatcgcgttgtct

SEQ ID NO: 4151 - DNA, 24 bp, Artificial Sequence
  Description of Artificial Sequence:  Hypothetical Probe Sequence
acgggcaacctacacgcctaggta

SEQ ID NO: 4152 - DNA, 24 bp, Artificial Sequence
  Description of Artificial Sequence:  Hypothetical Probe Sequence
acgggcaaacggccatgtctcgaa

SEQ ID NO: 4153 - DNA, 24 bp, Artificial Sequence
  Description of Artificial Sequence:  Hypothetical Probe Sequence
acgggcaaagcctctgcctagtgc

SEQ ID NO: 4154 - DNA, 24 bp, Artificial Sequence
  Description of Artificial Sequence:  Hypothetical Probe Sequence
acggagtgcgaattgatcgttccc

SEQ ID NO: 4155 - DNA, 24 bp, Artificial Sequence
  Description of Artificial Sequence:  Hypothetical Probe Sequence
acggagtgggtacgaagtgcgacc

SEQ ID NO: 4156 - DNA, 24 bp, Artificial Sequence
  Description of Artificial Sequence:  Hypothetical Probe Sequence
acggagtggagttgtctccccagc

SEQ ID NO: 4157 - DNA, 24 bp, Artificial Sequence
  Description of Artificial Sequence:  Hypothetical Probe Sequence
acggagtggcaacagccttgacct

SEQ ID NO: 4158 - DNA, 24 bp, Artificial Sequence
  Description of Artificial Sequence:  Hypothetical Probe Sequence
acggagtgatcgtcgtctcaacgg

SEQ ID NO: 4159 - DNA, 24 bp, Artificial Sequence
  Description of Artificial Sequence:  Hypothetical Probe Sequence
acggagtgcctacgtttgtccgtt

SEQ ID NO: 4160 - DNA, 24 bp, Artificial Sequence
  Description of Artificial Sequence:  Hypothetical Probe Sequence
acggagtgtgcgtcgtgcaaggta

SEQ ID NO: 4161 - DNA, 24 bp, Artificial Sequence
  Description of Artificial Sequence:  Hypothetical Probe Sequence
acggagtgggacgcttgcaacagc

SEQ ID NO: 4162 - DNA, 24 bp, Artificial Sequence
  Description of Artificial Sequence:  Hypothetical Probe Sequence
acggaccttgatgatgtcccacgg

SEQ ID NO: 4163 - DNA, 24 bp, Artificial Sequence
  Description of Artificial Sequence:  Hypothetical Probe Sequence
acggaccttgtccgttgacccgtt

SEQ ID NO: 4164 - DNA, 24 bp, Artificial Sequence
  Description of Artificial Sequence:  Hypothetical Probe Sequence
acggacctcttgcacgcctaagga

SEQ ID NO: 4165 - DNA, 24 bp, Artificial Sequence
  Description of Artificial Sequence:  Hypothetical Probe Sequence
acggacctgcttaaagccatcacg

SEQ ID NO: 4166 - DNA, 24 bp, Artificial Sequence
  Description of Artificial Sequence:  Hypothetical Probe Sequence
acggacctgtctgaccccatcgaa

SEQ ID NO: 4167 - DNA, 24 bp, Artificial Sequence
  Description of Artificial Sequence:  Hypothetical Probe Sequence
acggaccttcccgagtttgaacgg

SEQ ID NO: 4168 - DNA, 24 bp, Artificial Sequence
  Description of Artificial Sequence:  Hypothetical Probe Sequence
acggacctgaccaaagacgggctt

SEQ ID NO: 4169 - DNA, 24 bp, Artificial Sequence
  Description of Artificial Sequence:  Hypothetical Probe Sequence
acggacctagccgctttctgtccc

SEQ ID NO: 4170 - DNA, 24 bp, Artificial Sequence
  Description of Artificial Sequence:  Hypothetical Probe Sequence
acggatcgaaagtcccaaagacgg

SEQ ID NO: 4171 - DNA, 24 bp, Artificial Sequence
  Description of Artificial Sequence:  Hypothetical Probe Sequence
acggatcgtgtccgaacacgagcc

SEQ ID NO: 4172 - DNA, 24 bp, Artificial Sequence
  Description of Artificial Sequence:  Hypothetical Probe Sequence
acggatcgctcacgaatccctctg

SEQ ID NO: 4173 - DNA, 24 bp, Artificial Sequence
  Description of Artificial Sequence:  Hypothetical Probe Sequence
acggatcgctgtctgtgatgcgaa

SEQ ID NO: 4174 - DNA, 24 bp, Artificial Sequence
  Description of Artificial Sequence:  Hypothetical Probe Sequence
acggatcggagtcgaacgaacacg

SEQ ID NO: 4175 - DNA, 24 bp, Artificial Sequence
  Description of Artificial Sequence:  Hypothetical Probe Sequence
acggatcggcaacttggaccctca

SEQ ID NO: 4176 - DNA, 24 bp, Artificial Sequence
  Description of Artificial Sequence:  Hypothetical Probe Sequence
acggatcgagtgtctgccatcacg

SEQ ID NO: 4177 - DNA, 24 bp, Artificial Sequence
  Description of Artificial Sequence:  Hypothetical Probe Sequence
acggatcgacctcttgacggggta

SEQ ID NO: 4178 - DNA, 24 bp, Artificial Sequence
  Description of Artificial Sequence:  Hypothetical Probe Sequence
acggatcgcagctccctgatgctt

SEQ ID NO: 4179 - DNA, 24 bp, Artificial Sequence
  Description of Artificial Sequence:  Hypothetical Probe Sequence
acggatcgggacggacttagccat

SEQ ID NO: 4180 - DNA, 24 bp, Artificial Sequence
  Description of Artificial Sequence:  Hypothetical Probe Sequence
acggatcgacggctcagagttgcg

SEQ ID NO: 4181 - DNA, 24 bp, Artificial Sequence
  Description of Artificial Sequence:  Hypothetical Probe Sequence
acggatcgagcccctaaggagtgc

SEQ ID NO: 4182 - DNA, 24 bp, Artificial Sequence
  Description of Artificial Sequence:  Hypothetical Probe Sequence
acggaggatctggcaaacctatcg

SEQ ID NO: 4183 - DNA, 24 bp, Artificial Sequence
  Description of Artificial Sequence:  Hypothetical Probe Sequence
acggaggaccataatcgatgacgg

SEQ ID NO: 4184 - DNA, 24 bp, Artificial Sequence
  Description of Artificial Sequence:  Hypothetical Probe Sequence
acggaggagcttgtgccgttacct

SEQ ID NO: 4185 - DNA, 24 bp, Artificial Sequence
  Description of Artificial Sequence:  Hypothetical Probe Sequence
acggaggaggtatcgtgtgctgcg

SEQ ID NO: 4186 - DNA, 24 bp, Artificial Sequence
  Description of Artificial Sequence:  Hypothetical Probe Sequence
acggaggagtctagcccacgtgcg

SEQ ID NO: 4187 - DNA, 24 bp, Artificial Sequence
  Description of Artificial Sequence:  Hypothetical Probe Sequence
acggaggagcaaagccaatcctgt

SEQ ID NO: 4188 - DNA, 24 bp, Artificial Sequence
  Description of Artificial Sequence:  Hypothetical Probe Sequence
acggaggatgcgcctaacctcacg

SEQ ID NO: 4189 - DNA, 24 bp, Artificial Sequence
  Description of Artificial Sequence:  Hypothetical Probe Sequence
acggcctatctggagtcagccgtt

SEQ ID NO: 4190 - DNA, 24 bp, Artificial Sequence
  Description of Artificial Sequence:  Hypothetical Probe Sequence
acggcctactgtggacacggcttg

SEQ ID NO: 4191 - DNA, 24 bp, Artificial Sequence
  Description of Artificial Sequence:  Hypothetical Probe Sequence
acggcctagagttcgtggaccagc

SEQ ID NO: 4192 - DNA, 24 bp, Artificial Sequence
  Description of Artificial Sequence:  Hypothetical Probe Sequence
acggcctacctatccctgtcacgg

SEQ ID NO: 4193 - DNA, 24 bp, Artificial Sequence
  Description of Artificial Sequence:  Hypothetical Probe Sequence
acgggatgaatcccataggaacgg

SEQ ID NO: 4194 - DNA, 24 bp, Artificial Sequence
  Description of Artificial Sequence:  Hypothetical Probe Sequence
acgggatgccatcgaattagtccc

SEQ ID NO: 4195 - DNA, 24 bp, Artificial Sequence
  Description of Artificial Sequence:  Hypothetical Probe Sequence
acgggatgatcggagtcgtttgcg

SEQ ID NO: 4196 - DNA, 24 bp, Artificial Sequence
  Description of Artificial Sequence:  Hypothetical Probe Sequence
acgggatgcctaagtgcttgtccc

SEQ ID NO: 4197 - DNA, 24 bp, Artificial Sequence
  Description of Artificial Sequence:  Hypothetical Probe Sequence
acgggatgggaccacgatactccc

SEQ ID NO: 4198 - DNA, 24 bp, Artificial Sequence
  Description of Artificial Sequence:  Hypothetical Probe Sequence
acgggatgagccgtgcacggatac

SEQ ID NO: 4199 - DNA, 24 bp, Artificial Sequence
  Description of Artificial Sequence:  Hypothetical Probe Sequence
acggtcccttgacgttgcaaaaag

SEQ ID NO: 4200 - DNA, 24 bp, Artificial Sequence
  Description of Artificial Sequence:  Hypothetical Probe Sequence
acggtcccctcaaatcacggatcg

SEQ ID NO: 4201 - DNA, 24 bp, Artificial Sequence
  Description of Artificial Sequence:  Hypothetical Probe Sequence
acggtcccccatacctgaccggta

SEQ ID NO: 4202 - DNA, 24 bp, Artificial Sequence
  Description of Artificial Sequence:  Hypothetical Probe Sequence
acggtcccagtgtgtctgcgacct

SEQ ID NO: 4203 - DNA, 24 bp, Artificial Sequence
  Description of Artificial Sequence:  Hypothetical Probe Sequence
acggtcccatcggcttgtctcagc

SEQ ID NO: 4204 - DNA, 24 bp, Artificial Sequence
  Description of Artificial Sequence:  Hypothetical Probe Sequence
acggtccccctatcgtgatgctgt

SEQ ID NO: 4205 - DNA, 24 bp, Artificial Sequence
  Description of Artificial Sequence:  Hypothetical Probe Sequence
acggtcccgatgtgatttagcacg

SEQ ID NO: 4206 - DNA, 24 bp, Artificial Sequence
  Description of Artificial Sequence:  Hypothetical Probe Sequence
acggtgcgttgaatacagccgacc

SEQ ID NO: 4207 - DNA, 24 bp, Artificial Sequence
  Description of Artificial Sequence:  Hypothetical Probe Sequence
acggtgcgtgataggatctggctt

SEQ ID NO: 4208 - DNA, 24 bp, Artificial Sequence
  Description of Artificial Sequence:  Hypothetical Probe Sequence
acggtgcgttagggacgaccacct

SEQ ID NO: 4209 - DNA, 24 bp, Artificial Sequence
  Description of Artificial Sequence:  Hypothetical Probe Sequence
acggtgcgatacaatcatcgcgtt

SEQ ID NO: 4210 - DNA, 24 bp, Artificial Sequence
  Description of Artificial Sequence:  Hypothetical Probe Sequence
acggtgcgtacacgttggacccta

SEQ ID NO: 4211 - DNA, 24 bp, Artificial Sequence
  Description of Artificial Sequence:  Hypothetical Probe Sequence
acggtgcgcttgcctaaggacacg

SEQ ID NO: 4212 - DNA, 24 bp, Artificial Sequence
  Description of Artificial Sequence:  Hypothetical Probe Sequence
acggtgcgccatatacgaccagga

SEQ ID NO: 4213 - DNA, 24 bp, Artificial Sequence
  Description of Artificial Sequence:  Hypothetical Probe Sequence
acggtgcgagtgctgtcagccagc

SEQ ID NO: 4214 - DNA, 24 bp, Artificial Sequence
  Description of Artificial Sequence:  Hypothetical Probe Sequence
acggtgcgaggactcagatgcagc

SEQ ID NO: 4215 - DNA, 24 bp, Artificial Sequence
  Description of Artificial Sequence:  Hypothetical Probe Sequence
acggtgcgtgcgcacgaatcctgt

SEQ ID NO: 4216 - DNA, 24 bp, Artificial Sequence
  Description of Artificial Sequence:  Hypothetical Probe Sequence
acggtgcgcacggtgcctgtccta

SEQ ID NO: 4217 - DNA, 24 bp, Artificial Sequence
  Description of Artificial Sequence:  Hypothetical Probe Sequence
acggtgcgcagcacctccatgctt

SEQ ID NO: 4218 - DNA, 24 bp, Artificial Sequence
  Description of Artificial Sequence:  Hypothetical Probe Sequence
acggtgcggtgcgagtgcttcgtt

SEQ ID NO: 4219 - DNA, 24 bp, Artificial Sequence
  Description of Artificial Sequence:  Hypothetical Probe Sequence
acggtgcgggaccagcacctcttg

SEQ ID NO: 4220 - DNA, 24 bp, Artificial Sequence
  Description of Artificial Sequence:  Hypothetical Probe Sequence
acggtgcgagcccttggagtgctt

SEQ ID NO: 4221 - DNA, 24 bp, Artificial Sequence
  Description of Artificial Sequence:  Hypothetical Probe Sequence
acggcacgttgaggactgattccc

SEQ ID NO: 4222 - DNA, 24 bp, Artificial Sequence
  Description of Artificial Sequence:  Hypothetical Probe Sequence
acggcacgtgatacggtgatcgtt

SEQ ID NO: 4223 - DNA, 24 bp, Artificial Sequence
  Description of Artificial Sequence:  Hypothetical Probe Sequence
acggcacgttagagtgatcgcgaa

SEQ ID NO: 4224 - DNA, 24 bp, Artificial Sequence
  Description of Artificial Sequence:  Hypothetical Probe Sequence
acggcacgaatccagctctgacgg

SEQ ID NO: 4225 - DNA, 24 bp, Artificial Sequence
  Description of Artificial Sequence:  Hypothetical Probe Sequence
acggcacgtacatgattgcgccta

SEQ ID NO: 4226 - DNA, 24 bp, Artificial Sequence
  Description of Artificial Sequence:  Hypothetical Probe Sequence
acggcacgtctgctcaatcgatcg

SEQ ID NO: 4227 - DNA, 24 bp, Artificial Sequence
  Description of Artificial Sequence:  Hypothetical Probe Sequence
acggcacgtcgtgcttcgaatctg

SEQ ID NO: 4228 - DNA, 24 bp, Artificial Sequence
  Description of Artificial Sequence:  Hypothetical Probe Sequence
acggcacggagtctcacagcggac

SEQ ID NO: 4229 - DNA, 24 bp, Artificial Sequence
  Description of Artificial Sequence:  Hypothetical Probe Sequence
acggcacgacctcgaatctgagga

SEQ ID NO: 4230 - DNA, 24 bp, Artificial Sequence
  Description of Artificial Sequence:  Hypothetical Probe Sequence
acggcacgcagctgatggacggta

SEQ ID NO: 4231 - DNA, 24 bp, Artificial Sequence
  Description of Artificial Sequence:  Hypothetical Probe Sequence
acggcacgggacggacggtatctg

SEQ ID NO: 4232 - DNA, 24 bp, Artificial Sequence
  Description of Artificial Sequence:  Hypothetical Probe Sequence
acggcacgacggtcgtgagtcgaa

SEQ ID NO: 4233 - DNA, 24 bp, Artificial Sequence
  Description of Artificial Sequence:  Hypothetical Probe Sequence
acggcagcttagaaagccattcgt

SEQ ID NO: 4234 - DNA, 24 bp, Artificial Sequence
  Description of Artificial Sequence:  Hypothetical Probe Sequence
acggcagctgtccgaaataccacg

SEQ ID NO: 4235 - DNA, 24 bp, Artificial Sequence
  Description of Artificial Sequence:  Hypothetical Probe Sequence
acggcagccttgctcagatggctt

SEQ ID NO: 4236 - DNA, 24 bp, Artificial Sequence
  Description of Artificial Sequence:  Hypothetical Probe Sequence
acggcagcctgtttagacggcgaa

SEQ ID NO: 4237 - DNA, 24 bp, Artificial Sequence
  Description of Artificial Sequence:  Hypothetical Probe Sequence
acggcagcccataatccacgtctg

SEQ ID NO: 4238 - DNA, 24 bp, Artificial Sequence
  Description of Artificial Sequence:  Hypothetical Probe Sequence
acggcagccgaactgttcgtgtgc

SEQ ID NO: 4239 - DNA, 24 bp, Artificial Sequence
  Description of Artificial Sequence:  Hypothetical Probe Sequence
acggcagcgcttgagtgagttgcg

SEQ ID NO: 4240 - DNA, 24 bp, Artificial Sequence
  Description of Artificial Sequence:  Hypothetical Probe Sequence
acggcagcggtacacgttagcgaa

SEQ ID NO: 4241 - DNA, 24 bp, Artificial Sequence
  Description of Artificial Sequence:  Hypothetical Probe Sequence
acggcagcaggagtctacggctgt

SEQ ID NO: 4242 - DNA, 24 bp, Artificial Sequence
  Description of Artificial Sequence:  Hypothetical Probe Sequence
acggcagccacgaggagcaattga

SEQ ID NO: 4243 - DNA, 24 bp, Artificial Sequence
  Description of Artificial Sequence:  Hypothetical Probe Sequence
acggcagccagcctgtcgaacagc

SEQ ID NO: 4244 - DNA, 24 bp, Artificial Sequence
  Description of Artificial Sequence:  Hypothetical Probe Sequence
acggcagcgtgccctatcccaatc

SEQ ID NO: 4245 - DNA, 24 bp, Artificial Sequence
  Description of Artificial Sequence:  Hypothetical Probe Sequence
acggcagcacggtcgtgaccagtg

SEQ ID NO: 4246 - DNA, 24 bp, Artificial Sequence
  Description of Artificial Sequence:  Hypothetical Probe Sequence
acgggaccttgattgacgttcagc

SEQ ID NO: 4247 - DNA, 24 bp, Artificial Sequence
  Description of Artificial Sequence:  Hypothetical Probe Sequence
acgggaccaatcacctgaccatcg

SEQ ID NO: 4248 - DNA, 24 bp, Artificial Sequence
  Description of Artificial Sequence:  Hypothetical Probe Sequence
acgggaccaaagaatcgatggacc

SEQ ID NO: 4249 - DNA, 24 bp, Artificial Sequence
  Description of Artificial Sequence:  Hypothetical Probe Sequence
acgggacctacacagcgcaactgt

SEQ ID NO: 4250 - DNA, 24 bp, Artificial Sequence
  Description of Artificial Sequence:  Hypothetical Probe Sequence
acgggacccgttgtcttcgtagcc

SEQ ID NO: 4251 - DNA, 24 bp, Artificial Sequence
  Description of Artificial Sequence:  Hypothetical Probe Sequence
acgggaccctcagtgcgatgacct

SEQ ID NO: 4252 - DNA, 24 bp, Artificial Sequence
  Description of Artificial Sequence:  Hypothetical Probe Sequence
acgggaccccatacctcgaacgaa

SEQ ID NO: 4253 - DNA, 24 bp, Artificial Sequence
  Description of Artificial Sequence:  Hypothetical Probe Sequence
acgggacccgaactcatgtcgctt

SEQ ID NO: 4254 - DNA, 24 bp, Artificial Sequence
  Description of Artificial Sequence:  Hypothetical Probe Sequence
acgggaccgcttaatccctagcaa

SEQ ID NO: 4255 - DNA, 24 bp, Artificial Sequence
  Description of Artificial Sequence:  Hypothetical Probe Sequence
acgggaccatcgtcccacctaatc

SEQ ID NO: 4256 - DNA, 24 bp, Artificial Sequence
  Description of Artificial Sequence:  Hypothetical Probe Sequence
acgggaccgatggatgcagctgtc

SEQ ID NO: 4257 - DNA, 24 bp, Artificial Sequence
  Description of Artificial Sequence:  Hypothetical Probe Sequence
acgggacctcccatcgggtattga

SEQ ID NO: 4258 - DNA, 24 bp, Artificial Sequence
  Description of Artificial Sequence:  Hypothetical Probe Sequence
acgggacccagccgaacctaatcg

SEQ ID NO: 4259 - DNA, 24 bp, Artificial Sequence
  Description of Artificial Sequence:  Hypothetical Probe Sequence
acgggaccgtgcggacttaggtgc

SEQ ID NO: 4260 - DNA, 24 bp, Artificial Sequence
  Description of Artificial Sequence:  Hypothetical Probe Sequence
acgggtgcttgagtctagcccagc

SEQ ID NO: 4261 - DNA, 24 bp, Artificial Sequence
  Description of Artificial Sequence:  Hypothetical Probe Sequence
acgggtgctgatttgaatcgagcc

SEQ ID NO: 4262 - DNA, 24 bp, Artificial Sequence
  Description of Artificial Sequence:  Hypothetical Probe Sequence
acgggtgcttagtctggctttccc

SEQ ID NO: 4263 - DNA, 24 bp, Artificial Sequence
  Description of Artificial Sequence:  Hypothetical Probe Sequence
acgggtgcaatcgcttcttgagcc

SEQ ID NO: 4264 - DNA, 24 bp, Artificial Sequence
  Description of Artificial Sequence:  Hypothetical Probe Sequence
acgggtgcatacacctgacccgtt

SEQ ID NO: 4265 - DNA, 24 bp, Artificial Sequence
  Description of Artificial Sequence:  Hypothetical Probe Sequence
acgggtgctgtcggactctgcagc

SEQ ID NO: 4266 - DNA, 24 bp, Artificial Sequence
  Description of Artificial Sequence:  Hypothetical Probe Sequence
acgggtgcctcactgttgtcacgg

SEQ ID NO: 4267 - DNA, 24 bp, Artificial Sequence
  Description of Artificial Sequence:  Hypothetical Probe Sequence
acgggtgccgaagacccctaaatc

SEQ ID NO: 4268 - DNA, 24 bp, Artificial Sequence
  Description of Artificial Sequence:  Hypothetical Probe Sequence
acgggtgcgcttgcttttgaggac

SEQ ID NO: 4269 - DNA, 24 bp, Artificial Sequence
  Description of Artificial Sequence:  Hypothetical Probe Sequence
acgggtgcgtctcctaacggacct

SEQ ID NO: 4270 - DNA, 24 bp, Artificial Sequence
  Description of Artificial Sequence:  Hypothetical Probe Sequence
acgggtgcgcaacagctgatccat

SEQ ID NO: 4271 - DNA, 24 bp, Artificial Sequence
  Description of Artificial Sequence:  Hypothetical Probe Sequence
acgggtgcagtggaccacggtaca

SEQ ID NO: 4272 - DNA, 24 bp, Artificial Sequence
  Description of Artificial Sequence:  Hypothetical Probe Sequence
acgggtgcacctgcaactcatctg

SEQ ID NO: 4273 - DNA, 24 bp, Artificial Sequence
  Description of Artificial Sequence:  Hypothetical Probe Sequence
acgggtgctgcgaggaataccacg

SEQ ID NO: 4274 - DNA, 24 bp, Artificial Sequence
  Description of Artificial Sequence:  Hypothetical Probe Sequence
acgggtgcgaccatcgggtactca

SEQ ID NO: 4275 - DNA, 24 bp, Artificial Sequence
  Description of Artificial Sequence:  Hypothetical Probe Sequence
acgggtgcggaccacgggtatgtc

SEQ ID NO: 4276 - DNA, 24 bp, Artificial Sequence
  Description of Artificial Sequence:  Hypothetical Probe Sequence
acggggacttgaaaagttgatgcg

SEQ ID NO: 4277 - DNA, 24 bp, Artificial Sequence
  Description of Artificial Sequence:  Hypothetical Probe Sequence
acggggacttagtgcggcaaccta

SEQ ID NO: 4278 - DNA, 24 bp, Artificial Sequence
  Description of Artificial Sequence:  Hypothetical Probe Sequence
acggggactacaacggggacctca

SEQ ID NO: 4279 - DNA, 24 bp, Artificial Sequence
  Description of Artificial Sequence:  Hypothetical Probe Sequence
acggggaccttgacggttgatcgt

SEQ ID NO: 4280 - DNA, 24 bp, Artificial Sequence
  Description of Artificial Sequence:  Hypothetical Probe Sequence
acggggaccgttatcgcgaagagt

SEQ ID NO: 4281 - DNA, 24 bp, Artificial Sequence
  Description of Artificial Sequence:  Hypothetical Probe Sequence
acggggacggtaaggaaatcgctt

SEQ ID NO: 4282 - DNA, 24 bp, Artificial Sequence
  Description of Artificial Sequence:  Hypothetical Probe Sequence
acggggacgcaaagtgccatagga

SEQ ID NO: 4283 - DNA, 24 bp, Artificial Sequence
  Description of Artificial Sequence:  Hypothetical Probe Sequence
acggggacacctgagttcccagtg

SEQ ID NO: 4284 - DNA, 24 bp, Artificial Sequence
  Description of Artificial Sequence:  Hypothetical Probe Sequence
acggggacatcgtcccatcgatac

SEQ ID NO: 4285 - DNA, 24 bp, Artificial Sequence
  Description of Artificial Sequence:  Hypothetical Probe Sequence
acggggactcccgatgctcaatcg

SEQ ID NO: 4286 - DNA, 24 bp, Artificial Sequence
  Description of Artificial Sequence:  Hypothetical Probe Sequence
acggggactgcgctgtgcttggac

SEQ ID NO: 4287 - DNA, 24 bp, Artificial Sequence
  Description of Artificial Sequence:  Hypothetical Probe Sequence
acggggacgtgcgcaacctaacct

SEQ ID NO: 4288 - DNA, 24 bp, Artificial Sequence
  Description of Artificial Sequence:  Hypothetical Probe Sequence
acggacggttgaggtacacgagga

SEQ ID NO: 4289 - DNA, 24 bp, Artificial Sequence
  Description of Artificial Sequence:  Hypothetical Probe Sequence
acggacggtacacgaacagcctca

SEQ ID NO: 4290 - DNA, 24 bp, Artificial Sequence
  Description of Artificial Sequence:  Hypothetical Probe Sequence
acggacggtctgaatcaccttgcg

SEQ ID NO: 4291 - DNA, 24 bp, Artificial Sequence
  Description of Artificial Sequence:  Hypothetical Probe Sequence
acggacggtcgtggtagaccgctt

SEQ ID NO: 4292 - DNA, 24 bp, Artificial Sequence
  Description of Artificial Sequence:  Hypothetical Probe Sequence
acggacggctcagtcttcccggta

SEQ ID NO: 4293 - DNA, 24 bp, Artificial Sequence
  Description of Artificial Sequence:  Hypothetical Probe Sequence
acggacgggagttcgtaatctgcg

SEQ ID NO: 4294 - DNA, 24 bp, Artificial Sequence
  Description of Artificial Sequence:  Hypothetical Probe Sequence
acggacgggcaatcgtcagctgat

SEQ ID NO: 4295 - DNA, 24 bp, Artificial Sequence
  Description of Artificial Sequence:  Hypothetical Probe Sequence
acggacggacctggtagtgctcgt

SEQ ID NO: 4296 - DNA, 24 bp, Artificial Sequence
  Description of Artificial Sequence:  Hypothetical Probe Sequence
acggacgggatgtcccaaagaatc

SEQ ID NO: 4297 - DNA, 24 bp, Artificial Sequence
  Description of Artificial Sequence:  Hypothetical Probe Sequence
acggacggtccctctgggtacagc

SEQ ID NO: 4298 - DNA, 24 bp, Artificial Sequence
  Description of Artificial Sequence:  Hypothetical Probe Sequence
acggacggcagcttgacgaatcgt

SEQ ID NO: 4299 - DNA, 24 bp, Artificial Sequence
  Description of Artificial Sequence:  Hypothetical Probe Sequence
acggacgggtgcctgtcgaacacg

SEQ ID NO: 4300 - DNA, 24 bp, Artificial Sequence
  Description of Artificial Sequence:  Hypothetical Probe Sequence
acggacggagccgcttgtctagcc

SEQ ID NO: 4301 - DNA, 24 bp, Artificial Sequence
  Description of Artificial Sequence:  Hypothetical Probe Sequence
acggagccttagcttggaccggta

SEQ ID NO: 4302 - DNA, 24 bp, Artificial Sequence
  Description of Artificial Sequence:  Hypothetical Probe Sequence
acggagccaatcgtctatcggcaa

SEQ ID NO: 4303 - DNA, 24 bp, Artificial Sequence
  Description of Artificial Sequence:  Hypothetical Probe Sequence
acggagcctgtccgaagcaactgt

SEQ ID NO: 4304 - DNA, 24 bp, Artificial Sequence
  Description of Artificial Sequence:  Hypothetical Probe Sequence
acggagcctcgtggtatgattccc

SEQ ID NO: 4305 - DNA, 24 bp, Artificial Sequence
  Description of Artificial Sequence:  Hypothetical Probe Sequence
acggagccctgttcccaatcaatc

SEQ ID NO: 4306 - DNA, 24 bp, Artificial Sequence
  Description of Artificial Sequence:  Hypothetical Probe Sequence
acggagcccgaagatgggtaagcc

SEQ ID NO: 4307 - DNA, 24 bp, Artificial Sequence
  Description of Artificial Sequence:  Hypothetical Probe Sequence
acggagccagtgggactgtcggac

SEQ ID NO: 4308 - DNA, 24 bp, Artificial Sequence
  Description of Artificial Sequence:  Hypothetical Probe Sequence
acggagcccctatacatcccccat

SEQ ID NO: 4309 - DNA, 24 bp, Artificial Sequence
  Description of Artificial Sequence:  Hypothetical Probe Sequence
acggagccgatgaatcaggaatcg

SEQ ID NO: 4310 - DNA, 24 bp, Artificial Sequence
  Description of Artificial Sequence:  Hypothetical Probe Sequence
acggagcctcccgcaaggtagtgc

SEQ ID NO: 4311 - DNA, 24 bp, Artificial Sequence
  Description of Artificial Sequence:  Hypothetical Probe Sequence
acggagcccagcgatgttgaacgg

SEQ ID NO: 4312 - DNA, 24 bp, Artificial Sequence
  Description of Artificial Sequence:  Hypothetical Probe Sequence
acggagccgacccctatgtccacg

SEQ ID NO: 4313 - DNA, 24 bp, Artificial Sequence
  Description of Artificial Sequence:  Hypothetical Probe Sequence
acggagccggacgatgctgtcacg

SEQ ID NO: 4314 - DNA, 24 bp, Artificial Sequence
  Description of Artificial Sequence:  Hypothetical Probe Sequence
acggagccacggttgacgttccat

SEQ ID NO: 4315 - DNA, 24 bp, Artificial Sequence
  Description of Artificial Sequence:  Hypothetical Probe Sequence
agccttgaaaagtgcgcgaaagtg

SEQ ID NO: 4316 - DNA, 24 bp, Artificial Sequence
  Description of Artificial Sequence:  Hypothetical Probe Sequence
agccttgatcgtgcttgcaaagcc

SEQ ID NO: 4317 - DNA, 24 bp, Artificial Sequence
  Description of Artificial Sequence:  Hypothetical Probe Sequence
agccttgacgttctcaagcccacg

SEQ ID NO: 4318 - DNA, 24 bp, Artificial Sequence
  Description of Artificial Sequence:  Hypothetical Probe Sequence
agccttgagcttgtgcacgggacc

SEQ ID NO: 4319 - DNA, 24 bp, Artificial Sequence
  Description of Artificial Sequence:  Hypothetical Probe Sequence
agccttgagcaatgtcgatgcgaa

SEQ ID NO: 4320 - DNA, 24 bp, Artificial Sequence
  Description of Artificial Sequence:  Hypothetical Probe Sequence
agccttgaaggaacctggaccgaa

SEQ ID NO: 4321 - DNA, 24 bp, Artificial Sequence
  Description of Artificial Sequence:  Hypothetical Probe Sequence
agccttgagatgtgcgacggcgtt

SEQ ID NO: 4322 - DNA, 24 bp, Artificial Sequence
  Description of Artificial Sequence:  Hypothetical Probe Sequence
agccttgaggacgcaacttgtgcg

SEQ ID NO: 4323 - DNA, 24 bp, Artificial Sequence
  Description of Artificial Sequence:  Hypothetical Probe Sequence
agcctgatgcttacggtgtctgcg

SEQ ID NO: 4324 - DNA, 24 bp, Artificial Sequence
  Description of Artificial Sequence:  Hypothetical Probe Sequence
agccttaggcttcagcgatggatg

SEQ ID NO: 4325 - DNA, 24 bp, Artificial Sequence
  Description of Artificial Sequence:  Hypothetical Probe Sequence
agccttagcagcatcgcttggagt

SEQ ID NO: 4326 - DNA, 24 bp, Artificial Sequence
  Description of Artificial Sequence:  Hypothetical Probe Sequence
agccaatccgtttgtcgtgcgagt

SEQ ID NO: 4327 - DNA, 24 bp, Artificial Sequence
  Description of Artificial Sequence:  Hypothetical Probe Sequence
agccaatcgcaagagtacgggtgc

SEQ ID NO: 4328 - DNA, 24 bp, Artificial Sequence
  Description of Artificial Sequence:  Hypothetical Probe Sequence
agccaatcagtgagccacggtccc

SEQ ID NO: 4329 - DNA, 24 bp, Artificial Sequence
  Description of Artificial Sequence:  Hypothetical Probe Sequence
agccaatcaggatgcggcttttag

SEQ ID NO: 4330 - DNA, 24 bp, Artificial Sequence
  Description of Artificial Sequence:  Hypothetical Probe Sequence
agccaatccctatgtctccccacg

SEQ ID NO: 4331 - DNA, 24 bp, Artificial Sequence
  Description of Artificial Sequence:  Hypothetical Probe Sequence
agccaatcgatgaaagtgcggtct

SEQ ID NO: 4332 - DNA, 24 bp, Artificial Sequence
  Description of Artificial Sequence:  Hypothetical Probe Sequence
agccaatcggactacacacgtccc

SEQ ID NO: 4333 - DNA, 24 bp, Artificial Sequence
  Description of Artificial Sequence:  Hypothetical Probe Sequence
agccaatcagccctgtacggctca

SEQ ID NO: 4334 - DNA, 24 bp, Artificial Sequence
  Description of Artificial Sequence:  Hypothetical Probe Sequence
agccataccgttacggtgtccagc

SEQ ID NO: 4335 - DNA, 24 bp, Artificial Sequence
  Description of Artificial Sequence:  Hypothetical Probe Sequence
agccatacgcttctcaatcggctt

SEQ ID NO: 4336 - DNA, 24 bp, Artificial Sequence
  Description of Artificial Sequence:  Hypothetical Probe Sequence
agccatacacctggacccattccc

SEQ ID NO: 4337 - DNA, 24 bp, Artificial Sequence
  Description of Artificial Sequence:  Hypothetical Probe Sequence
agccatacaggatcccgtgcgatg

SEQ ID NO: 4338 - DNA, 24 bp, Artificial Sequence
  Description of Artificial Sequence:  Hypothetical Probe Sequence
agccataccagcgaccggacacct

SEQ ID NO: 4339 - DNA, 24 bp, Artificial Sequence
  Description of Artificial Sequence:  Hypothetical Probe Sequence
agccatacgtgcctcatgcgccta

SEQ ID NO: 4340 - DNA, 24 bp, Artificial Sequence
  Description of Artificial Sequence:  Hypothetical Probe Sequence
agccaaagtgattcccgacctccc

SEQ ID NO: 4341 - DNA, 24 bp, Artificial Sequence
  Description of Artificial Sequence:  Hypothetical Probe Sequence
agccaaagtctggcaagctttgcg

SEQ ID NO: 4342 - DNA, 24 bp, Artificial Sequence
  Description of Artificial Sequence:  Hypothetical Probe Sequence
agccaaaggcaaggacagtgagcc

SEQ ID NO: 4343 - DNA, 24 bp, Artificial Sequence
  Description of Artificial Sequence:  Hypothetical Probe Sequence
agccaaagagtggtgcgtgcacgg

SEQ ID NO: 4344 - DNA, 24 bp, Artificial Sequence
  Description of Artificial Sequence:  Hypothetical Probe Sequence
agccaaagaggactcacgaaacgg

SEQ ID NO: 4345 - DNA, 24 bp, Artificial Sequence
  Description of Artificial Sequence:  Hypothetical Probe Sequence
agccaaagcctatgattcccatcg

SEQ ID NO: 4346 - DNA, 24 bp, Artificial Sequence
  Description of Artificial Sequence:  Hypothetical Probe Sequence
agccaaaggaccttgacacgagcc

SEQ ID NO: 4347 - DNA, 24 bp, Artificial Sequence
  Description of Artificial Sequence:  Hypothetical Probe Sequence
agcctacatgcgatactgcgccat

SEQ ID NO: 4348 - DNA, 24 bp, Artificial Sequence
  Description of Artificial Sequence:  Hypothetical Probe Sequence
agcctctgcttgttgacacgcacg

SEQ ID NO: 4349 - DNA, 24 bp, Artificial Sequence
  Description of Artificial Sequence:  Hypothetical Probe Sequence
agcctctgctcagaccggacgctt

SEQ ID NO: 4350 - DNA, 24 bp, Artificial Sequence
  Description of Artificial Sequence:  Hypothetical Probe Sequence
agcctctgctgtatcgcgaaggac

SEQ ID NO: 4351 - DNA, 24 bp, Artificial Sequence
  Description of Artificial Sequence:  Hypothetical Probe Sequence
agcctctggagtcacgcgaaccat

SEQ ID NO: 4352 - DNA, 24 bp, Artificial Sequence
  Description of Artificial Sequence:  Hypothetical Probe Sequence
agcctctggatgaaaggatggcaa

SEQ ID NO: 4353 - DNA, 24 bp, Artificial Sequence
  Description of Artificial Sequence:  Hypothetical Probe Sequence
agcctctgggacatcgagccaaag

SEQ ID NO: 4354 - DNA, 24 bp, Artificial Sequence
  Description of Artificial Sequence:  Hypothetical Probe Sequence
agcctgtctgcgcgaatacatccc

SEQ ID NO: 4355 - DNA, 24 bp, Artificial Sequence
  Description of Artificial Sequence:  Hypothetical Probe Sequence
agcctgtccagcaaagcagcacct

SEQ ID NO: 4356 - DNA, 24 bp, Artificial Sequence
  Description of Artificial Sequence:  Hypothetical Probe Sequence
agcctcgtttgatgtcgcttagcc

SEQ ID NO: 4357 - DNA, 24 bp, Artificial Sequence
  Description of Artificial Sequence:  Hypothetical Probe Sequence
agcctcgttgtctacatgcggacc

SEQ ID NO: 4358 - DNA, 24 bp, Artificial Sequence
  Description of Artificial Sequence:  Hypothetical Probe Sequence
agcctcgtgagtggacagcccttg

SEQ ID NO: 4359 - DNA, 24 bp, Artificial Sequence
  Description of Artificial Sequence:  Hypothetical Probe Sequence
agcctcgtgcaacgaagcaaggta

SEQ ID NO: 4360 - DNA, 24 bp, Artificial Sequence
  Description of Artificial Sequence:  Hypothetical Probe Sequence
agcctcgtacctcgaaagccgagt

SEQ ID NO: 4361 - DNA, 24 bp, Artificial Sequence
  Description of Artificial Sequence:  Hypothetical Probe Sequence
agcctcgttcccgacccttgagga

SEQ ID NO: 4362 - DNA, 24 bp, Artificial Sequence
  Description of Artificial Sequence:  Hypothetical Probe Sequence
agcctcgttgcgatactcgttccc

SEQ ID NO: 4363 - DNA, 24 bp, Artificial Sequence
  Description of Artificial Sequence:  Hypothetical Probe Sequence
agcccttgttgagcttgcaagctt

SEQ ID NO: 4364 - DNA, 24 bp, Artificial Sequence
  Description of Artificial Sequence:  Hypothetical Probe Sequence
agcccttgctcaaggattgaagcc

SEQ ID NO: 4365 - DNA, 24 bp, Artificial Sequence
  Description of Artificial Sequence:  Hypothetical Probe Sequence
agcccttgctgtacctacggccta

SEQ ID NO: 4366 - DNA, 24 bp, Artificial Sequence
  Description of Artificial Sequence:  Hypothetical Probe Sequence
agcccttggtctatcgcttgggac

SEQ ID NO: 4367 - DNA, 24 bp, Artificial Sequence
  Description of Artificial Sequence:  Hypothetical Probe Sequence
agcccttggcaaagcctgtcccta

SEQ ID NO: 4368 - DNA, 24 bp, Artificial Sequence
  Description of Artificial Sequence:  Hypothetical Probe Sequence
agcccttgagtgatcgcgttcgaa

SEQ ID NO: 4369 - DNA, 24 bp, Artificial Sequence
  Description of Artificial Sequence:  Hypothetical Probe Sequence
agcccttgcctagtctagccccat

SEQ ID NO: 4370 - DNA, 24 bp, Artificial Sequence
  Description of Artificial Sequence:  Hypothetical Probe Sequence
agcccttggaccgagttcccgatg

SEQ ID NO: 4371 - DNA, 24 bp, Artificial Sequence
  Description of Artificial Sequence:  Hypothetical Probe Sequence
agcccttgggactgtccttgctgt

SEQ ID NO: 4372 - DNA, 24 bp, Artificial Sequence
  Description of Artificial Sequence:  Hypothetical Probe Sequence
agcccttgagccaaaggatgagcc

SEQ ID NO: 4373 - DNA, 24 bp, Artificial Sequence
  Description of Artificial Sequence:  Hypothetical Probe Sequence
agcccgttaatcgtgcggtaatcg

SEQ ID NO: 4374 - DNA, 24 bp, Artificial Sequence
  Description of Artificial Sequence:  Hypothetical Probe Sequence
agcccgtttacaaatccgttcacg

SEQ ID NO: 4375 - DNA, 24 bp, Artificial Sequence
  Description of Artificial Sequence:  Hypothetical Probe Sequence
agcccgttggtacgaatacaacgg

SEQ ID NO: 4376 - DNA, 24 bp, Artificial Sequence
  Description of Artificial Sequence:  Hypothetical Probe Sequence
agcccgttgagtaaagcgttcgtt

SEQ ID NO: 4377 - DNA, 24 bp, Artificial Sequence
  Description of Artificial Sequence:  Hypothetical Probe Sequence
agcccgttagtgaaagacggagcc

SEQ ID NO: 4378 - DNA, 24 bp, Artificial Sequence
  Description of Artificial Sequence:  Hypothetical Probe Sequence
agcccgttatcgtgattgcgtgat

SEQ ID NO: 4379 - DNA, 24 bp, Artificial Sequence
  Description of Artificial Sequence:  Hypothetical Probe Sequence
agcccgtttcccgatgccatgatg

SEQ ID NO: 4380 - DNA, 24 bp, Artificial Sequence
  Description of Artificial Sequence:  Hypothetical Probe Sequence
agcccgtttgcgcgttctcacacg

SEQ ID NO: 4381 - DNA, 24 bp, Artificial Sequence
  Description of Artificial Sequence:  Hypothetical Probe Sequence
agcccgttgaccatactgcgacct

SEQ ID NO: 4382 - DNA, 24 bp, Artificial Sequence
  Description of Artificial Sequence:  Hypothetical Probe Sequence
agcccgttgtgctacaatcggacc

SEQ ID NO: 4383 - DNA, 24 bp, Artificial Sequence
  Description of Artificial Sequence:  Hypothetical Probe Sequence
agccctcattgatgtctgcggctt

SEQ ID NO: 4384 - DNA, 24 bp, Artificial Sequence
  Description of Artificial Sequence:  Hypothetical Probe Sequence
agccctcatgatccattgcgttga

SEQ ID NO: 4385 - DNA, 24 bp, Artificial Sequence
  Description of Artificial Sequence:  Hypothetical Probe Sequence
agccctcaaaaggcaagcaaacgg

SEQ ID NO: 4386 - DNA, 24 bp, Artificial Sequence
  Description of Artificial Sequence:  Hypothetical Probe Sequence
agccctcacttggagttgcgagcc

SEQ ID NO: 4387 - DNA, 24 bp, Artificial Sequence
  Description of Artificial Sequence:  Hypothetical Probe Sequence
agccctcaccatggacgcttctgt

SEQ ID NO: 4388 - DNA, 24 bp, Artificial Sequence
  Description of Artificial Sequence:  Hypothetical Probe Sequence
agccctgttgatatcggaccccat

SEQ ID NO: 4389 - DNA, 24 bp, Artificial Sequence
  Description of Artificial Sequence:  Hypothetical Probe Sequence
agccctgttgtcatacgtgcacgg

SEQ ID NO: 4390 - DNA, 24 bp, Artificial Sequence
  Description of Artificial Sequence:  Hypothetical Probe Sequence
agccctgtccatgcaagtgcctca

SEQ ID NO: 4391 - DNA, 24 bp, Artificial Sequence
  Description of Artificial Sequence:  Hypothetical Probe Sequence
agccctgtgctttcgtcacgggta

SEQ ID NO: 4392 - DNA, 24 bp, Artificial Sequence
  Description of Artificial Sequence:  Hypothetical Probe Sequence
agccctgtggtagcaaagccgatg

SEQ ID NO: 4393 - DNA, 24 bp, Artificial Sequence
  Description of Artificial Sequence:  Hypothetical Probe Sequence
agccctgtacctcagcgcaacgtt

SEQ ID NO: 4394 - DNA, 24 bp, Artificial Sequence
  Description of Artificial Sequence:  Hypothetical Probe Sequence
agccctgtatcgcctaacgggagt

SEQ ID NO: 4395 - DNA, 24 bp, Artificial Sequence
  Description of Artificial Sequence:  Hypothetical Probe Sequence
agccctgtcacggtgccgttccta

SEQ ID NO: 4396 - DNA, 24 bp, Artificial Sequence
  Description of Artificial Sequence:  Hypothetical Probe Sequence
agccctgtagcccttgggtaacgg

SEQ ID NO: 4397 - DNA, 24 bp, Artificial Sequence
  Description of Artificial Sequence:  Hypothetical Probe Sequence
agccccatttgattagcgttcacg

SEQ ID NO: 4398 - DNA, 24 bp, Artificial Sequence
  Description of Artificial Sequence:  Hypothetical Probe Sequence
agccccataatccgaagtgcgctt

SEQ ID NO: 4399 - DNA, 24 bp, Artificial Sequence
  Description of Artificial Sequence:  Hypothetical Probe Sequence
agccccataaagtcccgatgacct

SEQ ID NO: 4400 - DNA, 24 bp, Artificial Sequence
  Description of Artificial Sequence:  Hypothetical Probe Sequence
agccccattacatcgtgaccgatg

SEQ ID NO: 4401 - DNA, 24 bp, Artificial Sequence
  Description of Artificial Sequence:  Hypothetical Probe Sequence
agccccattgtcgtctacgggctt

SEQ ID NO: 4402 - DNA, 24 bp, Artificial Sequence
  Description of Artificial Sequence:  Hypothetical Probe Sequence
agccccattcgtctcagatgcacg

SEQ ID NO: 4403 - DNA, 24 bp, Artificial Sequence
  Description of Artificial Sequence:  Hypothetical Probe Sequence
agccccatctcagatgggacctgt

SEQ ID NO: 4404 - DNA, 24 bp, Artificial Sequence
  Description of Artificial Sequence:  Hypothetical Probe Sequence3> Abramites sp.
agccccatcgaacacggtctatcg

SEQ ID NO: 4405 - DNA, 24 bp, Artificial Sequence
  Description of Artificial Sequence:  Hypothetical Probe Sequence
agccccatcagcccataaagcacg

SEQ ID NO: 4406 - DNA, 24 bp, Artificial Sequence
  Description of Artificial Sequence:  Hypothetical Probe Sequence
agccccatacggcctacgaagcaa

SEQ ID NO: 4407 - DNA, 24 bp, Artificial Sequence
  Description of Artificial Sequence:  Hypothetical Probe Sequence
agcccgaattgaacctcgttcagc

SEQ ID NO: 4408 - DNA, 24 bp, Artificial Sequence
  Description of Artificial Sequence:  Hypothetical Probe Sequence
agcccgaaataccgaacttgggac

SEQ ID NO: 4409 - DNA, 24 bp, Artificial Sequence
  Description of Artificial Sequence:  Hypothetical Probe Sequence
agcccgaaaaagatacgtcttgcg

SEQ ID NO: 4410 - DNA, 24 bp, Artificial Sequence
  Description of Artificial Sequence:  Hypothetical Probe Sequence
agcccgaatacacttgggaccagc

SEQ ID NO: 4411 - DNA, 24 bp, Artificial Sequence
  Description of Artificial Sequence:  Hypothetical Probe Sequence
agcccgaatcgtgtgcatcgaatc

SEQ ID NO: 4412 - DNA, 24 bp, Artificial Sequence
  Description of Artificial Sequence:  Hypothetical Probe Sequence
agcccgaacttgggtatgcggtct

SEQ ID NO: 4413 - DNA, 24 bp, Artificial Sequence
  Description of Artificial Sequence:  Hypothetical Probe Sequence
agcccgaactcagtctacggcacg

SEQ ID NO: 4414 - DNA, 24 bp, Artificial Sequence
  Description of Artificial Sequence:  Hypothetical Probe Sequence
agcccgaacgaactgttctgcagc

SEQ ID NO: 4415 - DNA, 24 bp, Artificial Sequence
  Description of Artificial Sequence:  Hypothetical Probe Sequence
agcccgaagcttacggagtggatg

SEQ ID NO: 4416 - DNA, 24 bp, Artificial Sequence
  Description of Artificial Sequence:  Hypothetical Probe Sequence
agcccgaagagtgtctgcaaacgg

SEQ ID NO: 4417 - DNA, 24 bp, Artificial Sequence
  Description of Artificial Sequence:  Hypothetical Probe Sequence
agcccgaaatcgctgtagccctca

SEQ ID NO: 4418 - DNA, 24 bp, Artificial Sequence
  Description of Artificial Sequence:  Hypothetical Probe Sequence
agcccgaaaggatctgacggatcg

SEQ ID NO: 4419 - DNA, 24 bp, Artificial Sequence
  Description of Artificial Sequence:  Hypothetical Probe Sequence
agcccgaatgcgcgttaccttcgt

SEQ ID NO: 4420 - DNA, 24 bp, Artificial Sequence
  Description of Artificial Sequence:  Hypothetical Probe Sequence
agcccgaacacgtcccaaagttga

SEQ ID NO: 4421 - DNA, 24 bp, Artificial Sequence
  Description of Artificial Sequence:  Hypothetical Probe Sequence
agcccgaaggacggtatgtccgaa

SEQ ID NO: 4422 - DNA, 24 bp, Artificial Sequence
  Description of Artificial Sequence:  Hypothetical Probe Sequence
agcccgaaacggggactctgggac

SEQ ID NO: 4423 - DNA, 24 bp, Artificial Sequence
  Description of Artificial Sequence:  Hypothetical Probe Sequence
agccgctttgataggaagtgacgg

SEQ ID NO: 4424 - DNA, 24 bp, Artificial Sequence
  Description of Artificial Sequence:  Hypothetical Probe Sequence
agccgcttttagggtacgaaacgg

SEQ ID NO: 4425 - DNA, 24 bp, Artificial Sequence
  Description of Artificial Sequence:  Hypothetical Probe Sequence
agccgcttatactgtcagcccgtt

SEQ ID NO: 4426 - DNA, 24 bp, Artificial Sequence
  Description of Artificial Sequence:  Hypothetical Probe Sequence
agccgctttgtcgcttggtacgtt

SEQ ID NO: 4427 - DNA, 24 bp, Artificial Sequence
  Description of Artificial Sequence:  Hypothetical Probe Sequence
agccgcttcttgtgatgcaacgaa

SEQ ID NO: 4428 - DNA, 24 bp, Artificial Sequence
  Description of Artificial Sequence:  Hypothetical Probe Sequence
agccgcttctgttcgtgatgacgg

SEQ ID NO: 4429 - DNA, 24 bp, Artificial Sequence
  Description of Artificial Sequence:  Hypothetical Probe Sequence
agccgcttccatttgagaccgacc

SEQ ID NO: 4430 - DNA, 24 bp, Artificial Sequence
  Description of Artificial Sequence:  Hypothetical Probe Sequence
agccgcttggtaggacgtctgtgc

SEQ ID NO: 4431 - DNA, 24 bp, Artificial Sequence
  Description of Artificial Sequence:  Hypothetical Probe Sequence
agccgctttgcgctcaacggttga

SEQ ID NO: 4432 - DNA, 24 bp, Artificial Sequence
  Description of Artificial Sequence:  Hypothetical Probe Sequence
agccgcttcagcgagtacgggatg

SEQ ID NO: 4433 - DNA, 24 bp, Artificial Sequence
  Description of Artificial Sequence:  Hypothetical Probe Sequence
agccgcttgtgccacgtcccatac

SEQ ID NO: 4434 - DNA, 24 bp, Artificial Sequence
  Description of Artificial Sequence:  Hypothetical Probe Sequence
agccggtattgatcccctcaagga

SEQ ID NO: 4435 - DNA, 24 bp, Artificial Sequence
  Description of Artificial Sequence:  Hypothetical Probe Sequence
agccggtaaatcacctgtgccgtt

SEQ ID NO: 4436 - DNA, 24 bp, Artificial Sequence
  Description of Artificial Sequence:  Hypothetical Probe Sequence
agccggtaaaaggtcttgcgctgt

SEQ ID NO: 4437 - DNA, 24 bp, Artificial Sequence
  Description of Artificial Sequence:  Hypothetical Probe Sequence
agccggtatctgccatcttggctt

SEQ ID NO: 4438 - DNA, 24 bp, Artificial Sequence
  Description of Artificial Sequence:  Hypothetical Probe Sequence
agccggtatcgtttgacgttcgaa

SEQ ID NO: 4439 - DNA, 24 bp, Artificial Sequence
  Description of Artificial Sequence:  Hypothetical Probe Sequence
agccggtactgttcccagccgcaa

SEQ ID NO: 4440 - DNA, 24 bp, Artificial Sequence
  Description of Artificial Sequence:  Hypothetical Probe Sequence
agccggtaggtaccataggatgcg

SEQ ID NO: 4441 - DNA, 24 bp, Artificial Sequence
  Description of Artificial Sequence:  Hypothetical Probe Sequence
agccggtagagtcagcatcgggac

SEQ ID NO: 4442 - DNA, 24 bp, Artificial Sequence
  Description of Artificial Sequence:  Hypothetical Probe Sequence
agccggtatccccttgtcgtacgg

SEQ ID NO: 4443 - DNA, 24 bp, Artificial Sequence
  Description of Artificial Sequence:  Hypothetical Probe Sequence
agccgtctaatcggacccattgcg

SEQ ID NO: 4444 - DNA, 24 bp, Artificial Sequence
  Description of Artificial Sequence:  Hypothetical Probe Sequence
agccgtcttacaatcgatcgccat

SEQ ID NO: 4445 - DNA, 24 bp, Artificial Sequence
  Description of Artificial Sequence:  Hypothetical Probe Sequence
agccgtctaccttcgtagccctca

SEQ ID NO: 4446 - DNA, 24 bp, Artificial Sequence
  Description of Artificial Sequence:  Hypothetical Probe Sequence
agccgtctgatgtcgtgctttcgt

SEQ ID NO: 4447 - DNA, 24 bp, Artificial Sequence
  Description of Artificial Sequence:  Hypothetical Probe Sequence
agccgtctcacgatcgtgtcggac

SEQ ID NO: 4448 - DNA, 24 bp, Artificial Sequence
  Description of Artificial Sequence:  Hypothetical Probe Sequence
agccgtctcagcacggcttgttga

SEQ ID NO: 4449 - DNA, 24 bp, Artificial Sequence
  Description of Artificial Sequence:  Hypothetical Probe Sequence
agccgtctgaccgagtgaccggac

SEQ ID NO: 4450 - DNA, 24 bp, Artificial Sequence
  Description of Artificial Sequence:  Hypothetical Probe Sequence
agccgtctagccaatcgcttgctt

SEQ ID NO: 4451 - DNA, 24 bp, Artificial Sequence
  Description of Artificial Sequence:  Hypothetical Probe Sequence
agccgagttgtccacgccatggac

SEQ ID NO: 4452 - DNA, 24 bp, Artificial Sequence
  Description of Artificial Sequence:  Hypothetical Probe Sequence
agccgagttcgtgagtagcctccc

SEQ ID NO: 4453 - DNA, 24 bp, Artificial Sequence
  Description of Artificial Sequence:  Hypothetical Probe Sequence
agccgagtgtcttacatgcgcacg

SEQ ID NO: 4454 - DNA, 24 bp, Artificial Sequence
  Description of Artificial Sequence:  Hypothetical Probe Sequence
agccgagtatcgcagcctgtgcaa

SEQ ID NO: 4455 - DNA, 24 bp, Artificial Sequence
  Description of Artificial Sequence:  Hypothetical Probe Sequence
agccgagtcctattgatccccgtt

SEQ ID NO: 4456 - DNA, 24 bp, Artificial Sequence
  Description of Artificial Sequence:  Hypothetical Probe Sequence
agccgagtgatgtcccgagtcgtt

SEQ ID NO: 4457 - DNA, 24 bp, Artificial Sequence
  Description of Artificial Sequence:  Hypothetical Probe Sequence
agccgagttgcgttgactgtggac

SEQ ID NO: 4458 - DNA, 24 bp, Artificial Sequence
  Description of Artificial Sequence:  Hypothetical Probe Sequence
agccgagtagcccagcctcacagc

SEQ ID NO: 4459 - DNA, 24 bp, Artificial Sequence
  Description of Artificial Sequence:  Hypothetical Probe Sequence
agccgcaattgaaggagcaacagc

SEQ ID NO: 4460 - DNA, 24 bp, Artificial Sequence
  Description of Artificial Sequence:  Hypothetical Probe Sequence
agccgcaatgatagcctgatcacg

SEQ ID NO: 4461 - DNA, 24 bp, Artificial Sequence
  Description of Artificial Sequence:  Hypothetical Probe Sequence
agccgcaattagcgaatgcgatac

SEQ ID NO: 4462 - DNA, 24 bp, Artificial Sequence
  Description of Artificial Sequence:  Hypothetical Probe Sequence
agccgcaatacaagtgtccctccc

SEQ ID NO: 4463 - DNA, 24 bp, Artificial Sequence
  Description of Artificial Sequence:  Hypothetical Probe Sequence
agccgcaatctgggtaggaccgtt

SEQ ID NO: 4464 - DNA, 24 bp, Artificial Sequence
  Description of Artificial Sequence:  Hypothetical Probe Sequence
agccgcaacgtttgcgtgatatcg

SEQ ID NO: 4465 - DNA, 24 bp, Artificial Sequence
  Description of Artificial Sequence:  Hypothetical Probe Sequence
agccgcaactcaaggaagcctctg

SEQ ID NO: 4466 - DNA, 24 bp, Artificial Sequence
  Description of Artificial Sequence:  Hypothetical Probe Sequence
agccgcaacgaaggtaatcgtcgt

SEQ ID NO: 4467 - DNA, 24 bp, Artificial Sequence
  Description of Artificial Sequence:  Hypothetical Probe Sequence
agccgcaagcttgagtcacgctca

SEQ ID NO: 4468 - DNA, 24 bp, Artificial Sequence
  Description of Artificial Sequence:  Hypothetical Probe Sequence
agccgcaagcaatccccttgaatc

SEQ ID NO: 4469 - DNA, 24 bp, Artificial Sequence
  Description of Artificial Sequence:  Hypothetical Probe Sequence
agccgcaaatcggcaaacctctgt

SEQ ID NO: 4470 - DNA, 24 bp, Artificial Sequence
  Description of Artificial Sequence:  Hypothetical Probe Sequence
agccgcaaaggagcaacgttgagt

SEQ ID NO: 4471 - DNA, 24 bp, Artificial Sequence
  Description of Artificial Sequence:  Hypothetical Probe Sequence
agccgcaatcccggtaagtgcagc

SEQ ID NO: 4472 - DNA, 24 bp, Artificial Sequence
  Description of Artificial Sequence:  Hypothetical Probe Sequence
agccgcaatgcgatcgctcattga

SEQ ID NO: 4473 - DNA, 24 bp, Artificial Sequence
  Description of Artificial Sequence:  Hypothetical Probe Sequence
agccgcaacacgctgtgtgctccc

SEQ ID NO: 4474 - DNA, 24 bp, Artificial Sequence
  Description of Artificial Sequence:  Hypothetical Probe Sequence
agccgcaagtgcatacacgggacc

SEQ ID NO: 4475 - DNA, 24 bp, Artificial Sequence
  Description of Artificial Sequence:  Hypothetical Probe Sequence
agccgcaaacggcctagcttggac

SEQ ID NO: 4476 - DNA, 24 bp, Artificial Sequence
  Description of Artificial Sequence:  Hypothetical Probe Sequence
agccgcaaagccctgtcttgacgg

SEQ ID NO: 4477 - DNA, 24 bp, Artificial Sequence
  Description of Artificial Sequence:  Hypothetical Probe Sequence
agccagtgtcgtatcgcacgagga

SEQ ID NO: 4478 - DNA, 24 bp, Artificial Sequence
  Description of Artificial Sequence:  Hypothetical Probe Sequence
agccagtgcttgagtgggacgacc

SEQ ID NO: 4479 - DNA, 24 bp, Artificial Sequence
  Description of Artificial Sequence:  Hypothetical Probe Sequence
agccagtgctgtgatgacggagcc

SEQ ID NO: 4480 - DNA, 24 bp, Artificial Sequence
  Description of Artificial Sequence:  Hypothetical Probe Sequence
agccagtgggtacagcagccagcc

SEQ ID NO: 4481 - DNA, 24 bp, Artificial Sequence
  Description of Artificial Sequence:  Hypothetical Probe Sequence
agccagtgacctgctttcccgtct

SEQ ID NO: 4482 - DNA, 24 bp, Artificial Sequence
  Description of Artificial Sequence:  Hypothetical Probe Sequence
agccagtgatcggagtacggcagc

SEQ ID NO: 4483 - DNA, 24 bp, Artificial Sequence
  Description of Artificial Sequence:  Hypothetical Probe Sequence
agccagtgtgcgataccacgctca

SEQ ID NO: 4484 - DNA, 24 bp, Artificial Sequence
  Description of Artificial Sequence:  Hypothetical Probe Sequence
agccagtggaccaggagcaacacg

SEQ ID NO: 4485 - DNA, 24 bp, Artificial Sequence
  Description of Artificial Sequence:  Hypothetical Probe Sequence
agccaccttgtcaggacacggcaa

SEQ ID NO: 4486 - DNA, 24 bp, Artificial Sequence
  Description of Artificial Sequence:  Hypothetical Probe Sequence
agccaccttcgtaaagccatcgaa

SEQ ID NO: 4487 - DNA, 24 bp, Artificial Sequence
  Description of Artificial Sequence:  Hypothetical Probe Sequence
agccacctcgaatgtccttgcgaa

SEQ ID NO: 4488 - DNA, 24 bp, Artificial Sequence
  Description of Artificial Sequence:  Hypothetical Probe Sequence
agccacctatcgacctgatggcaa

SEQ ID NO: 4489 - DNA, 24 bp, Artificial Sequence
  Description of Artificial Sequence:  Hypothetical Probe Sequence
agccacctaggaagtgctcatgcg

SEQ ID NO: 4490 - DNA, 24 bp, Artificial Sequence
  Description of Artificial Sequence:  Hypothetical Probe Sequence
agccacctcacgaatctcccagga

SEQ ID NO: 4491 - DNA, 24 bp, Artificial Sequence
  Description of Artificial Sequence:  Hypothetical Probe Sequence
agccatcgcgaattgaggacccta

SEQ ID NO: 4492 - DNA, 24 bp, Artificial Sequence
  Description of Artificial Sequence:  Hypothetical Probe Sequence
agccatcggcaaaatccagcaatc

SEQ ID NO: 4493 - DNA, 24 bp, Artificial Sequence
  Description of Artificial Sequence:  Hypothetical Probe Sequence
agccatcgcctaatacccattccc

SEQ ID NO: 4494 - DNA, 24 bp, Artificial Sequence
  Description of Artificial Sequence:  Hypothetical Probe Sequence
agccaggaatacggtatccctgcg

SEQ ID NO: 4495 - DNA, 24 bp, Artificial Sequence
  Description of Artificial Sequence:  Hypothetical Probe Sequence
agccaggaaaagttgacacgtgcg

SEQ ID NO: 4496 - DNA, 24 bp, Artificial Sequence
  Description of Artificial Sequence:  Hypothetical Probe Sequence
agccaggatacatgcgctcacacg

SEQ ID NO: 4497 - DNA, 24 bp, Artificial Sequence
  Description of Artificial Sequence:  Hypothetical Probe Sequence
agccaggatctgcacgctgtgctt

SEQ ID NO: 4498 - DNA, 24 bp, Artificial Sequence
  Description of Artificial Sequence:  Hypothetical Probe Sequence
agccaggacgtttgtctcccggta

SEQ ID NO: 4499 - DNA, 24 bp, Artificial Sequence
  Description of Artificial Sequence:  Hypothetical Probe Sequence
agccaggactcaagccgagtccat

SEQ ID NO: 4500 - DNA, 24 bp, Artificial Sequence
  Description of Artificial Sequence:  Hypothetical Probe Sequence
agccaggaccatttgagtgccagc

SEQ ID NO: 4501 - DNA, 24 bp, Artificial Sequence
  Description of Artificial Sequence:  Hypothetical Probe Sequence
agccaggagcaaatacgatgccat

SEQ ID NO: 4502 - DNA, 24 bp, Artificial Sequence
  Description of Artificial Sequence:  Hypothetical Probe Sequence
agccaggatgcgcgaaggtagtgc

SEQ ID NO: 4503 - DNA, 24 bp, Artificial Sequence
  Description of Artificial Sequence:  Hypothetical Probe Sequence
agccaggacagccttgaatcacgg

SEQ ID NO: 4504 - DNA, 24 bp, Artificial Sequence
  Description of Artificial Sequence:  Hypothetical Probe Sequence
agccaggagacctcgtctcatccc

SEQ ID NO: 4505 - DNA, 24 bp, Artificial Sequence
  Description of Artificial Sequence:  Hypothetical Probe Sequence
agccaggaggacaaaggtgctccc

SEQ ID NO: 4506 - DNA, 24 bp, Artificial Sequence
  Description of Artificial Sequence:  Hypothetical Probe Sequence
agccaggaacggccataatcgcaa

SEQ ID NO: 4507 - DNA, 24 bp, Artificial Sequence
  Description of Artificial Sequence:  Hypothetical Probe Sequence
agcccctatgatagccgatgcttg

SEQ ID NO: 4508 - DNA, 24 bp, Artificial Sequence
  Description of Artificial Sequence:  Hypothetical Probe Sequence
agcccctatgtcagcccacgctgt

SEQ ID NO: 4509 - DNA, 24 bp, Artificial Sequence
  Description of Artificial Sequence:  Hypothetical Probe Sequence
agcccctacttgaggacagccagc

SEQ ID NO: 4510 - DNA, 24 bp, Artificial Sequence
  Description of Artificial Sequence:  Hypothetical Probe Sequence
agcccctactcactcaatcgcacg

SEQ ID NO: 4511 - DNA, 24 bp, Artificial Sequence
  Description of Artificial Sequence:  Hypothetical Probe Sequence
agcccctagagtgcaatgcgagga

SEQ ID NO: 4512 - DNA, 24 bp, Artificial Sequence
  Description of Artificial Sequence:  Hypothetical Probe Sequence
agcccctagcaaccatgtgcgagt

SEQ ID NO: 4513 - DNA, 24 bp, Artificial Sequence
  Description of Artificial Sequence:  Hypothetical Probe Sequence
agcccctaaccttctggcttagcc

SEQ ID NO: 4514 - DNA, 24 bp, Artificial Sequence
  Description of Artificial Sequence:  Hypothetical Probe Sequence
agcccctagatggcaatcgtgtgc

SEQ ID NO: 4515 - DNA, 24 bp, Artificial Sequence
  Description of Artificial Sequence:  Hypothetical Probe Sequence
agcccctacacgaatcaatcacgg

SEQ ID NO: 4516 - DNA, 24 bp, Artificial Sequence
  Description of Artificial Sequence:  Hypothetical Probe Sequence
agcccctaacggcacgctgttgtc

SEQ ID NO: 4517 - DNA, 24 bp, Artificial Sequence
  Description of Artificial Sequence:  Hypothetical Probe Sequence
agccgatgtgatcttgatcgcagc

SEQ ID NO: 4518 - DNA, 24 bp, Artificial Sequence
  Description of Artificial Sequence:  Hypothetical Probe Sequence
agccgatgttagttgatgcgctca

SEQ ID NO: 4519 - DNA, 24 bp, Artificial Sequence
  Description of Artificial Sequence:  Hypothetical Probe Sequence
agccgatgtacatgtcgacccacg

SEQ ID NO: 4520 - DNA, 24 bp, Artificial Sequence
  Description of Artificial Sequence:  Hypothetical Probe Sequence
agccgatgtctgaatcgcaaggac

SEQ ID NO: 4521 - DNA, 24 bp, Artificial Sequence
  Description of Artificial Sequence:  Hypothetical Probe Sequence
agccgatgtgtcagcctgcgggac

SEQ ID NO: 4522 - DNA, 24 bp, Artificial Sequence
  Description of Artificial Sequence:  Hypothetical Probe Sequence
agccgatgctcaacctgcttcacg

SEQ ID NO: 4523 - DNA, 24 bp, Artificial Sequence
  Description of Artificial Sequence:  Hypothetical Probe Sequence
agccgatggcttagccttagtgcg

SEQ ID NO: 4524 - DNA, 24 bp, Artificial Sequence
  Description of Artificial Sequence:  Hypothetical Probe Sequence
agccgatgacctcagccctagacc

SEQ ID NO: 4525 - DNA, 24 bp, Artificial Sequence
  Description of Artificial Sequence:  Hypothetical Probe Sequence
agccgatgcctaccatgtgcgtct

SEQ ID NO: 4526 - DNA, 24 bp, Artificial Sequence
  Description of Artificial Sequence:  Hypothetical Probe Sequence
agcctcccttgaaccttcccagga

SEQ ID NO: 4527 - DNA, 24 bp, Artificial Sequence
  Description of Artificial Sequence:  Hypothetical Probe Sequence
agcctcccatactgcgctcagctt

SEQ ID NO: 4528 - DNA, 24 bp, Artificial Sequence
  Description of Artificial Sequence:  Hypothetical Probe Sequence
agcctccctacaaccttgcggatg

SEQ ID NO: 4529 - DNA, 24 bp, Artificial Sequence
  Description of Artificial Sequence:  Hypothetical Probe Sequence
agcctccctgtcaaaggtgcgagt

SEQ ID NO: 4530 - DNA, 24 bp, Artificial Sequence
  Description of Artificial Sequence:  Hypothetical Probe Sequence
agcctccctcgtacggggtagagt

SEQ ID NO: 4531 - DNA, 24 bp, Artificial Sequence
  Description of Artificial Sequence:  Hypothetical Probe Sequence
agcctccccttgttgaagtgacgg

SEQ ID NO: 4532 - DNA, 24 bp, Artificial Sequence
  Description of Artificial Sequence:  Hypothetical Probe Sequence
agcctcccccatcctaggacctgt

SEQ ID NO: 4533 - DNA, 24 bp, Artificial Sequence
  Description of Artificial Sequence:  Hypothetical Probe Sequence
agcctccccgaatctggtgcctgt

SEQ ID NO: 4534 - DNA, 24 bp, Artificial Sequence
  Description of Artificial Sequence:  Hypothetical Probe Sequence
agcctcccgtctggtaggacgctt

SEQ ID NO: 4535 - DNA, 24 bp, Artificial Sequence
  Description of Artificial Sequence:  Hypothetical Probe Sequence
agcctcccgagtcctatcccgagt

SEQ ID NO: 4536 - DNA, 24 bp, Artificial Sequence
  Description of Artificial Sequence:  Hypothetical Probe Sequence
agcctcccagtgcttgcttggacc

SEQ ID NO: 4537 - DNA, 24 bp, Artificial Sequence
  Description of Artificial Sequence:  Hypothetical Probe Sequence
agcctcccatcgttgaaatcggac

SEQ ID NO: 4538 - DNA, 24 bp, Artificial Sequence
  Description of Artificial Sequence:  Hypothetical Probe Sequence
agcctcccaggacctatcgtcgaa

SEQ ID NO: 4539 - DNA, 24 bp, Artificial Sequence
  Description of Artificial Sequence:  Hypothetical Probe Sequence
agcctccccctactgtctcatccc

SEQ ID NO: 4540 - DNA, 24 bp, Artificial Sequence
  Description of Artificial Sequence:  Hypothetical Probe Sequence
agcctcccgatggatggcaatgat

SEQ ID NO: 4541 - DNA, 24 bp, Artificial Sequence
  Description of Artificial Sequence:  Hypothetical Probe Sequence
agcctccctcccgcaaacctgatg

SEQ ID NO: 4542 - DNA, 24 bp, Artificial Sequence
  Description of Artificial Sequence:  Hypothetical Probe Sequence
agcctcccgtgcatcgttgacagc

SEQ ID NO: 4543 - DNA, 24 bp, Artificial Sequence
  Description of Artificial Sequence:  Hypothetical Probe Sequence
agcctcccacggccatgagtcgaa

SEQ ID NO: 4544 - DNA, 24 bp, Artificial Sequence
  Description of Artificial Sequence:  Hypothetical Probe Sequence
agcctcccagccaaagtcgttcgt

SEQ ID NO: 4545 - DNA, 24 bp, Artificial Sequence
  Description of Artificial Sequence:  Hypothetical Probe Sequence
agcctgcgaatcggtaagtgcgtt

SEQ ID NO: 4546 - DNA, 24 bp, Artificial Sequence
  Description of Artificial Sequence:  Hypothetical Probe Sequence
agcctgcgaaagtctgtcccccta

SEQ ID NO: 4547 - DNA, 24 bp, Artificial Sequence
  Description of Artificial Sequence:  Hypothetical Probe Sequence
agcctgcgctcacttggcaagcaa

SEQ ID NO: 4548 - DNA, 24 bp, Artificial Sequence
  Description of Artificial Sequence:  Hypothetical Probe Sequence
agcctgcgctgtgtcttgtccgaa

SEQ ID NO: 4549 - DNA, 24 bp, Artificial Sequence
  Description of Artificial Sequence:  Hypothetical Probe Sequence
agcctgcggagtgatgctgtgctt

SEQ ID NO: 4550 - DNA, 24 bp, Artificial Sequence
  Description of Artificial Sequence:  Hypothetical Probe Sequence
agcctgcgagtggagttcccatcg

SEQ ID NO: 4551 - DNA, 24 bp, Artificial Sequence
  Description of Artificial Sequence:  Hypothetical Probe Sequence
agcctgcgaggagcttcctatccc

SEQ ID NO: 4552 - DNA, 24 bp, Artificial Sequence
  Description of Artificial Sequence:  Hypothetical Probe Sequence
agcctgcgtgcgaaagcctatcgt

SEQ ID NO: 4553 - DNA, 24 bp, Artificial Sequence
  Description of Artificial Sequence:  Hypothetical Probe Sequence
agcctgcgcacgctcatctgcagc

SEQ ID NO: 4554 - DNA, 24 bp, Artificial Sequence
  Description of Artificial Sequence:  Hypothetical Probe Sequence
agcctgcggtgcgatgagccttga

SEQ ID NO: 4555 - DNA, 24 bp, Artificial Sequence
  Description of Artificial Sequence:  Hypothetical Probe Sequence
agcccacgaatcgaccggtacacg

SEQ ID NO: 4556 - DNA, 24 bp, Artificial Sequence
  Description of Artificial Sequence:  Hypothetical Probe Sequence
agcccacgtacactcaatcgtgcg

SEQ ID NO: 4557 - DNA, 24 bp, Artificial Sequence
  Description of Artificial Sequence:  Hypothetical Probe Sequence
agcccacgcttggcaaggtatcgt

SEQ ID NO: 4558 - DNA, 24 bp, Artificial Sequence
  Description of Artificial Sequence:  Hypothetical Probe Sequence
agcccacggtctaggaggtaacgg

SEQ ID NO: 4559 - DNA, 24 bp, Artificial Sequence
  Description of Artificial Sequence:  Hypothetical Probe Sequence
agcccacgaccttcccctcatgtc

SEQ ID NO: 4560 - DNA, 24 bp, Artificial Sequence
  Description of Artificial Sequence:  Hypothetical Probe Sequence
agcccacgcctacgttgcttttga

SEQ ID NO: 4561 - DNA, 24 bp, Artificial Sequence
  Description of Artificial Sequence:  Hypothetical Probe Sequence
agcccacgcagcggacttgagcaa

SEQ ID NO: 4562 - DNA, 24 bp, Artificial Sequence
  Description of Artificial Sequence:  Hypothetical Probe Sequence
agcccacggaccgcttgcaactgt

SEQ ID NO: 4563 - DNA, 24 bp, Artificial Sequence
  Description of Artificial Sequence:  Hypothetical Probe Sequence
agcccacgacggctcaaggagcaa

SEQ ID NO: 4564 - DNA, 24 bp, Artificial Sequence
  Description of Artificial Sequence:  Hypothetical Probe Sequence
agcccagctgatcctagaccgcaa

SEQ ID NO: 4565 - DNA, 24 bp, Artificial Sequence
  Description of Artificial Sequence:  Hypothetical Probe Sequence
agcccagcttagagtgcagccgaa

SEQ ID NO: 4566 - DNA, 24 bp, Artificial Sequence
  Description of Artificial Sequence:  Hypothetical Probe Sequence
agcccagcaaaggaccagtgacgg

SEQ ID NO: 4567 - DNA, 24 bp, Artificial Sequence
  Description of Artificial Sequence:  Hypothetical Probe Sequence
agcccagctacagatgtccccacg

SEQ ID NO: 4568 - DNA, 24 bp, Artificial Sequence
  Description of Artificial Sequence:  Hypothetical Probe Sequence
agcccagctcgtgcttgcttggta

SEQ ID NO: 4569 - DNA, 24 bp, Artificial Sequence
  Description of Artificial Sequence:  Hypothetical Probe Sequence
agcccagcccatttgaaggagtgc

SEQ ID NO: 4570 - DNA, 24 bp, Artificial Sequence
  Description of Artificial Sequence:  Hypothetical Probe Sequence
agcccagcgcttacctatcgctca

SEQ ID NO: 4571 - DNA, 24 bp, Artificial Sequence
  Description of Artificial Sequence:  Hypothetical Probe Sequence
agcccagcgtctataccagctccc

SEQ ID NO: 4572 - DNA, 24 bp, Artificial Sequence
  Description of Artificial Sequence:  Hypothetical Probe Sequence
agcccagcaggactgttcccctca

SEQ ID NO: 4573 - DNA, 24 bp, Artificial Sequence
  Description of Artificial Sequence:  Hypothetical Probe Sequence
agcccagcgaccctcaacctcacg

SEQ ID NO: 4574 - DNA, 24 bp, Artificial Sequence
  Description of Artificial Sequence:  Hypothetical Probe Sequence
agcccagcagccccatcctaccat

SEQ ID NO: 4575 - DNA, 24 bp, Artificial Sequence
  Description of Artificial Sequence:  Hypothetical Probe Sequence
agccgaccttgaggtacgaaatcg

SEQ ID NO: 4576 - DNA, 24 bp, Artificial Sequence
  Description of Artificial Sequence:  Hypothetical Probe Sequence
agccgacctgatggacgcaactca

SEQ ID NO: 4577 - DNA, 24 bp, Artificial Sequence
  Description of Artificial Sequence:  Hypothetical Probe Sequence
agccgaccaaagcagctccctgtc

SEQ ID NO: 4578 - DNA, 24 bp, Artificial Sequence
  Description of Artificial Sequence:  Hypothetical Probe Sequence
agccgacccttgaaagctgtcgtt

SEQ ID NO: 4579 - DNA, 24 bp, Artificial Sequence
  Description of Artificial Sequence:  Hypothetical Probe Sequence
agccgaccctcacctaggaccttg

SEQ ID NO: 4580 - DNA, 24 bp, Artificial Sequence
  Description of Artificial Sequence:  Hypothetical Probe Sequence
agccgaccgtctgatgtcccatcg

SEQ ID NO: 4581 - DNA, 24 bp, Artificial Sequence
  Description of Artificial Sequence:  Hypothetical Probe Sequence
agccgaccgcaactcaaatccagc

SEQ ID NO: 4582 - DNA, 24 bp, Artificial Sequence
  Description of Artificial Sequence:  Hypothetical Probe Sequence
agccgaccagtgttaggtgcccta

SEQ ID NO: 4583 - DNA, 24 bp, Artificial Sequence
  Description of Artificial Sequence:  Hypothetical Probe Sequence
agccgaccatcgtctggcaaccat

SEQ ID NO: 4584 - DNA, 24 bp, Artificial Sequence
  Description of Artificial Sequence:  Hypothetical Probe Sequence
agccgaccaggaagtgcgttatcg

SEQ ID NO: 4585 - DNA, 24 bp, Artificial Sequence
  Description of Artificial Sequence:  Hypothetical Probe Sequence
agccgacccacgagtgctgtcacg

SEQ ID NO: 4586 - DNA, 24 bp, Artificial Sequence
  Description of Artificial Sequence:  Hypothetical Probe Sequence
agccgaccgtgcatcgaaagatcg

SEQ ID NO: 4587 - DNA, 24 bp, Artificial Sequence
  Description of Artificial Sequence:  Hypothetical Probe Sequence
agccgtgcaatctcgttccctgat

SEQ ID NO: 4588 - DNA, 24 bp, Artificial Sequence
  Description of Artificial Sequence:  Hypothetical Probe Sequence
agccgtgcataccctacagcacgg

SEQ ID NO: 4589 - DNA, 24 bp, Artificial Sequence
  Description of Artificial Sequence:  Hypothetical Probe Sequence
agccgtgctctgagtgccatgatg

SEQ ID NO: 4590 - DNA, 24 bp, Artificial Sequence
  Description of Artificial Sequence:  Hypothetical Probe Sequence
agccgtgctcgttcgtgtctagcc

SEQ ID NO: 4591 - DNA, 24 bp, Artificial Sequence
  Description of Artificial Sequence:  Hypothetical Probe Sequence
agccgtgccttggagtgcaaacct

SEQ ID NO: 4592 - DNA, 24 bp, Artificial Sequence
  Description of Artificial Sequence:  Hypothetical Probe Sequence
agccgtgccgaagcaatgtcagga

SEQ ID NO: 4593 - DNA, 24 bp, Artificial Sequence
  Description of Artificial Sequence:  Hypothetical Probe Sequence
agccgtgcgcttgtgctcgtggta

SEQ ID NO: 4594 - DNA, 24 bp, Artificial Sequence
  Description of Artificial Sequence:  Hypothetical Probe Sequence
agccgtgcgtctgctttccctgtc

SEQ ID NO: 4595 - DNA, 24 bp, Artificial Sequence
  Description of Artificial Sequence:  Hypothetical Probe Sequence
agccgtgcatcggcaactgtcacg

SEQ ID NO: 4596 - DNA, 24 bp, Artificial Sequence
  Description of Artificial Sequence:  Hypothetical Probe Sequence
agccgtgcggaccttgtcgtcagc

SEQ ID NO: 4597 - DNA, 24 bp, Artificial Sequence
  Description of Artificial Sequence:  Hypothetical Probe Sequence
agccggacttagtacaagcctgcg

SEQ ID NO: 4598 - DNA, 24 bp, Artificial Sequence
  Description of Artificial Sequence:  Hypothetical Probe Sequence
agccggactgtctcgtggtaatcg

SEQ ID NO: 4599 - DNA, 24 bp, Artificial Sequence
  Description of Artificial Sequence:  Hypothetical Probe Sequence
agccggaccgtttgtcgaccttga

SEQ ID NO: 4600 - DNA, 24 bp, Artificial Sequence
  Description of Artificial Sequence:  Hypothetical Probe Sequence
agccggacccatcagcgagttgtc

SEQ ID NO: 4601 - DNA, 24 bp, Artificial Sequence
  Description of Artificial Sequence:  Hypothetical Probe Sequence
agccggacgcttcttgctcacgtt

SEQ ID NO: 4602 - DNA, 24 bp, Artificial Sequence
  Description of Artificial Sequence:  Hypothetical Probe Sequence
agccggacacctcttgaccttcgt

SEQ ID NO: 4603 - DNA, 24 bp, Artificial Sequence
  Description of Artificial Sequence:  Hypothetical Probe Sequence
agccggacatcgcgtttctgacct

SEQ ID NO: 4604 - DNA, 24 bp, Artificial Sequence
  Description of Artificial Sequence:  Hypothetical Probe Sequence
agccggacaggacctacagcaatc

SEQ ID NO: 4605 - DNA, 24 bp, Artificial Sequence
  Description of Artificial Sequence:  Hypothetical Probe Sequence
agccggactccctacacacgggac

SEQ ID NO: 4606 - DNA, 24 bp, Artificial Sequence
  Description of Artificial Sequence:  Hypothetical Probe Sequence
agccggacgtgcgagtgaccggta

SEQ ID NO: 4607 - DNA, 24 bp, Artificial Sequence
  Description of Artificial Sequence:  Hypothetical Probe Sequence
agccggacggacgacccagcttag

SEQ ID NO: 4608 - DNA, 24 bp, Artificial Sequence
  Description of Artificial Sequence:  Hypothetical Probe Sequence
agccacggaatctgatgcttcacg

SEQ ID NO: 4609 - DNA, 24 bp, Artificial Sequence
  Description of Artificial Sequence:  Hypothetical Probe Sequence
agccacggataccagctcgtacgg

SEQ ID NO: 4610 - DNA, 24 bp, Artificial Sequence
  Description of Artificial Sequence:  Hypothetical Probe Sequence
agccacggaaagaaaggatggtgc

SEQ ID NO: 4611 - DNA, 24 bp, Artificial Sequence
  Description of Artificial Sequence:  Hypothetical Probe Sequence
agccacggtacacctatcccgatg

SEQ ID NO: 4612 - DNA, 24 bp, Artificial Sequence
  Description of Artificial Sequence:  Hypothetical Probe Sequence
agccacggtctggatgcgttttga

SEQ ID NO: 4613 - DNA, 24 bp, Artificial Sequence
  Description of Artificial Sequence:  Hypothetical Probe Sequence
agccacggtgtcggacatcgcttg

SEQ ID NO: 4614 - DNA, 24 bp, Artificial Sequence
  Description of Artificial Sequence:  Hypothetical Probe Sequence
agccacgggcttgcttcacgacct

SEQ ID NO: 4615 - DNA, 24 bp, Artificial Sequence
  Description of Artificial Sequence:  Hypothetical Probe Sequence
agccacgggtctgtctgtgccacg

SEQ ID NO: 4616 - DNA, 24 bp, Artificial Sequence
  Description of Artificial Sequence:  Hypothetical Probe Sequence
agccacggatcggctttcgtgagt

SEQ ID NO: 4617 - DNA, 24 bp, Artificial Sequence
  Description of Artificial Sequence:  Hypothetical Probe Sequence
agccacgggaccagtggaccctgt

SEQ ID NO: 4618 - DNA, 24 bp, Artificial Sequence
  Description of Artificial Sequence:  Hypothetical Probe Sequence
agccacgggtgctacaggacgtgc

SEQ ID NO: 4619 - DNA, 24 bp, Artificial Sequence
  Description of Artificial Sequence:  Hypothetical Probe Sequence
agccacggacggcctaagtgcgtt

SEQ ID NO: 4620 - DNA, 24 bp, Artificial Sequence
  Description of Artificial Sequence:  Hypothetical Probe Sequence
agccagcctgatacctagccatcg

SEQ ID NO: 4621 - DNA, 24 bp, Artificial Sequence
  Description of Artificial Sequence:  Hypothetical Probe Sequence
agccagccaaagacctacggctgt

SEQ ID NO: 4622 - DNA, 24 bp, Artificial Sequence
  Description of Artificial Sequence:  Hypothetical Probe Sequence
agccagcctctggaccaggatcgt

SEQ ID NO: 4623 - DNA, 24 bp, Artificial Sequence
  Description of Artificial Sequence:  Hypothetical Probe Sequence
agccagcctcgtagtgggtaacgg

SEQ ID NO: 4624 - DNA, 24 bp, Artificial Sequence
  Description of Artificial Sequence:  Hypothetical Probe Sequence
agccagcccttgtgtccgaacttg

SEQ ID NO: 4625 - DNA, 24 bp, Artificial Sequence
  Description of Artificial Sequence:  Hypothetical Probe Sequence
agccagcccgttcgtttcgttaca

SEQ ID NO: 4626 - DNA, 24 bp, Artificial Sequence
  Description of Artificial Sequence:  Hypothetical Probe Sequence
agccagccctcagcttcttgggta

SEQ ID NO: 4627 - DNA, 24 bp, Artificial Sequence
  Description of Artificial Sequence:  Hypothetical Probe Sequence
agccagccgcttagtgcagcagtg

SEQ ID NO: 4628 - DNA, 24 bp, Artificial Sequence
  Description of Artificial Sequence:  Hypothetical Probe Sequence
agccagccgtctttgaggaccttg

SEQ ID NO: 4629 - DNA, 24 bp, Artificial Sequence
  Description of Artificial Sequence:  Hypothetical Probe Sequence
agccagccatcgtgatgatgagcc

SEQ ID NO: 4630 - DNA, 24 bp, Artificial Sequence
  Description of Artificial Sequence:  Hypothetical Probe Sequence
agccagcctccccagcgatgtgat

SEQ ID NO: 4631 - DNA, 24 bp, Artificial Sequence
  Description of Artificial Sequence:  Hypothetical Probe Sequence
agccagcccacgccatgcaactgt

SEQ ID NO: 4632 - DNA, 24 bp, Artificial Sequence
  Description of Artificial Sequence:  Hypothetical Probe Sequence
agccagccgacccagcaggagatg

SEQ ID NO: 4633 - DNA, 24 bp, Artificial Sequence
  Description of Artificial Sequence:  Hypothetical Probe Sequence
agccagccggacggtaatcggtct

SEQ ID NO: 4634 - DNA, 20 bp, Artificial Sequence
  Description of Artificial Sequence:  Hypothetical Probe Sequence
aatccagcgcaaaatctgcg

SEQ ID NO: 4635 - DNA, 20 bp, Artificial Sequence
  Description of Artificial Sequence:  Hypothetical Probe Sequence
aaagcctacacgacggcgaa

SEQ ID NO: 4636 - DNA, 20 bp, Artificial Sequence
  Description of Artificial Sequence:  Hypothetical Probe Sequence
tctgccatacgggcttacgg

SEQ ID NO: 4637 - DNA, 20 bp, Artificial Sequence
  Description of Artificial Sequence:  Hypothetical Probe Sequence
cttgtccccagcacggccat

SEQ ID NO: 4638 - DNA, 20 bp, Artificial Sequence
  Description of Artificial Sequence:  Hypothetical Probe Sequence
cgttgaccagcccgttgcaa

SEQ ID NO: 4639 - DNA, 20 bp, Artificial Sequence
  Description of Artificial Sequence:  Hypothetical Probe Sequence
cgaagctttcccccatgatg

SEQ ID NO: 4640 - DNA, 20 bp, Artificial Sequence
  Description of Artificial Sequence:  Hypothetical Probe Sequence
gcaaggacgaccgcaaacgg

SEQ ID NO: 4641 - DNA, 20 bp, Artificial Sequence
  Description of Artificial Sequence:  Hypothetical Probe Sequence
gatgacggacggtgcggcaa

SEQ ID NO: 4642 - DNA, 20 bp, Artificial Sequence
  Description of Artificial Sequence:  Hypothetical Probe Sequence
tcccatcgaaagggacgatg

SEQ ID NO: 4643 - DNA, 20 bp, Artificial Sequence
  Description of Artificial Sequence:  Hypothetical Probe Sequence
tgcgtctgggacgtgccttg

SEQ ID NO: 4644 - DNA, 20 bp, Artificial Sequence
  Description of Artificial Sequence:  Hypothetical Probe Sequence
cacgtcgtcagctcccgtgc

SEQ ID NO: 4645 - DNA, 20 bp, Artificial Sequence
  Description of Artificial Sequence:  Hypothetical Probe Sequence
cagcctgttgcggtgcgtct

SEQ ID NO: 4646 - DNA, 20 bp, Artificial Sequence
  Description of Artificial Sequence:  Hypothetical Probe Sequence
gtgcggtacttgcagcgatg

SEQ ID NO: 4647 - DNA, 20 bp, Artificial Sequence
  Description of Artificial Sequence:  Hypothetical Probe Sequence
acggtctgcacgtcccagcc

SEQ ID NO: 4648 - DNA, 20 bp, Artificial Sequence
  Description of Artificial Sequence:  Hypothetical Probe Sequence
tctggtgcgtgccagccagc

SEQ ID NO: 4649 - DNA, 20 bp, Artificial Sequence
  Description of Artificial Sequence:  Hypothetical Probe Sequence
tgtcgctttctgacggagcc

SEQ ID NO: 4650 - DNA, 20 bp, Artificial Sequence
  Description of Artificial Sequence:  Hypothetical Probe Sequence
cgtttgcgggtatccctcgt

SEQ ID NO: 4651 - DNA, 20 bp, Artificial Sequence
  Description of Artificial Sequence:  Hypothetical Probe Sequence
cgaaaggacagcagcctccc

SEQ ID NO: 4652 - DNA, 20 bp, Artificial Sequence
  Description of Artificial Sequence:  Hypothetical Probe Sequence
gcaagcaacgaacacgctgt

SEQ ID NO: 4653 - DNA, 20 bp, Artificial Sequence
  Description of Artificial Sequence:  Hypothetical Probe Sequence
tgcgagtggaccatcgccat

SEQ ID NO: 4654 - DNA, 20 bp, Artificial Sequence
  Description of Artificial Sequence:  Hypothetical Probe Sequence
cacgcttgccatggacggac

SEQ ID NO: 4655 - DNA, 20 bp, Artificial Sequence
  Description of Artificial Sequence:  Hypothetical Probe Sequence
gtgcctcaacgggtgcagcc

SEQ ID NO: 4656 - DNA, 20 bp, Artificial Sequence
  Description of Artificial Sequence:  Hypothetical Probe Sequence
tgatggaccgttagccgatg

SEQ ID NO: 4657 - DNA, 20 bp, Artificial Sequence
  Description of Artificial Sequence:  Hypothetical Probe Sequence
acggaggaggactgcgtgcg

SEQ ID NO: 4658 - DNA, 20 bp, Artificial Sequence
  Description of Artificial Sequence:  Hypothetical Probe Sequence
gatgagccagcctgcgagcc

SEQ ID NO: 4659 - DNA, 20 bp, Artificial Sequence
  Description of Artificial Sequence:  Hypothetical Probe Sequence
tcgtcgtttcccctcatgcg

SEQ ID NO: 4660 - DNA, 20 bp, Artificial Sequence
  Description of Artificial Sequence:  Hypothetical Probe Sequence
gcaactgtcgttcacggtgc

SEQ ID NO: 4661 - DNA, 20 bp, Artificial Sequence
  Description of Artificial Sequence:  Hypothetical Probe Sequence
aggacacgcagcgacctgcg

SEQ ID NO: 4662 - DNA, 20 bp, Artificial Sequence
  Description of Artificial Sequence:  Hypothetical Probe Sequence
gaccctgtgtctgctttgcg

SEQ ID NO: 4663 - DNA, 20 bp, Artificial Sequence
  Description of Artificial Sequence:  Hypothetical Probe Sequence
agccaaagcgaagtgcgatg

SEQ ID NO: 4664 - DNA, 20 bp, Artificial Sequence
  Description of Artificial Sequence:  Hypothetical Probe Sequence
gacctcgtgagttcccgcaa

SEQ ID NO: 4665 - DNA, 20 bp, Artificial Sequence
  Description of Artificial Sequence:  Hypothetical Probe Sequence
cttgacctatcgagccgtgc

SEQ ID NO: 4666 - DNA, 20 bp, Artificial Sequence
  Description of Artificial Sequence:  Hypothetical Probe Sequence
agccgcttgagtcgaaatcg

SEQ ID NO: 4667 - DNA, 20 bp, Artificial Sequence
  Description of Artificial Sequence:  Hypothetical Probe Sequence
cttgctcacctaccattgcg

SEQ ID NO: 4668 - DNA, 20 bp, Artificial Sequence
  Description of Artificial Sequence:  Hypothetical Probe Sequence
atcgcctaggtaacggggac

SEQ ID NO: 4669 - DNA, 20 bp, Artificial Sequence
  Description of Artificial Sequence:  Hypothetical Probe Sequence
cagcggtactgtggacccat

SEQ ID NO: 4670 - DNA, 20 bp, Artificial Sequence
  Description of Artificial Sequence:  Hypothetical Probe Sequence
agccacctaatctcccacgg

SEQ ID NO: 4671 - DNA, 20 bp, Artificial Sequence
  Description of Artificial Sequence:  Hypothetical Probe Sequence
tcgttcccacctccattccc

SEQ ID NO: 4672 - DNA, 20 bp, Artificial Sequence
  Description of Artificial Sequence:  Hypothetical Probe Sequence
atcgcagcgagtcagccacg

SEQ ID NO: 4673 - DNA, 20 bp, Artificial Sequence
  Description of Artificial Sequence:  Hypothetical Probe Sequence
cctaacctgatggtgcgcaa

SEQ ID NO: 4674 - DNA, 20 bp, Artificial Sequence
  Description of Artificial Sequence:  Hypothetical Probe Sequence
tgcggtctccatatcggtgc

SEQ ID NO: 4675 - DNA, 20 bp, Artificial Sequence
  Description of Artificial Sequence:  Hypothetical Probe Sequence
cacgcgttaccttgtcgatg

SEQ ID NO: 4676 - DNA, 20 bp, Artificial Sequence
  Description of Artificial Sequence:  Hypothetical Probe Sequence
tgtcgtgctctgaccttgcg

SEQ ID NO: 4677 - DNA, 20 bp, Artificial Sequence
  Description of Artificial Sequence:  Hypothetical Probe Sequence
acggaatcgtgctgcggctt

SEQ ID NO: 4678 - DNA, 20 bp, Artificial Sequence
  Description of Artificial Sequence:  Hypothetical Probe Sequence
tcgttctggcttggacgctt

SEQ ID NO: 4679 - DNA, 20 bp, Artificial Sequence
  Description of Artificial Sequence:  Hypothetical Probe Sequence
tcgttgcgtgtcggaccttg

SEQ ID NO: 4680 - DNA, 20 bp, Artificial Sequence
  Description of Artificial Sequence:  Hypothetical Probe Sequence
cgttgatgcgaatcgtcgaa

SEQ ID NO: 4681 - DNA, 20 bp, Artificial Sequence
  Description of Artificial Sequence:  Hypothetical Probe Sequence
cacgctcaaccttccccgtt

SEQ ID NO: 4682 - DNA, 20 bp, Artificial Sequence
  Description of Artificial Sequence:  Hypothetical Probe Sequence
ctgtgtgccgtttcgtgtgc

SEQ ID NO: 4683 - DNA, 20 bp, Artificial Sequence
  Description of Artificial Sequence:  Hypothetical Probe Sequence
ccatgcaatcccaggatgtc

SEQ ID NO: 4684 - DNA, 20 bp, Artificial Sequence
  Description of Artificial Sequence:  Hypothetical Probe Sequence
ccatcagctctggcaatgcg

SEQ ID NO: 4685 - DNA, 20 bp, Artificial Sequence
  Description of Artificial Sequence:  Hypothetical Probe Sequence
tctgggtaaggaagccatcg

SEQ ID NO: 4686 - DNA, 20 bp, Artificial Sequence
  Description of Artificial Sequence:  Hypothetical Probe Sequence
tgtcctgtccatcgaatgcg

SEQ ID NO: 4687 - DNA, 20 bp, Artificial Sequence
  Description of Artificial Sequence:  Hypothetical Probe Sequence
cgaacgtttacatgcgtcgt

SEQ ID NO: 4688 - DNA, 20 bp, Artificial Sequence
  Description of Artificial Sequence:  Hypothetical Probe Sequence
agtgagccgcaacttgggac

SEQ ID NO: 4689 - DNA, 20 bp, Artificial Sequence
  Description of Artificial Sequence:  Hypothetical Probe Sequence
ggacagtgagtgtgcgcacg

SEQ ID NO: 4690 - DNA, 20 bp, Artificial Sequence
  Description of Artificial Sequence:  Hypothetical Probe Sequence
gcaaagccataccttggctt

SEQ ID NO: 4691 - DNA, 20 bp, Artificial Sequence
  Description of Artificial Sequence:  Hypothetical Probe Sequence
cttgcctacgaacagccgaa

SEQ ID NO: 4692 - DNA, 20 bp, Artificial Sequence
  Description of Artificial Sequence:  Hypothetical Probe Sequence
gcaagtgcccatgtgcccta

SEQ ID NO: 4693 - DNA, 20 bp, Artificial Sequence
  Description of Artificial Sequence:  Hypothetical Probe Sequence
tctggaccggactccccgaa

SEQ ID NO: 4694 - DNA, 20 bp, Artificial Sequence
  Description of Artificial Sequence:  Hypothetical Probe Sequence
acggcagctacacacgagcc

SEQ ID NO: 4695 - DNA, 20 bp, Artificial Sequence
  Description of Artificial Sequence:  Hypothetical Probe Sequence
gaccacctcagcgcttgacc

SEQ ID NO: 4696 - DNA, 20 bp, Artificial Sequence
  Description of Artificial Sequence:  Hypothetical Probe Sequence
tcccttaggacccagcgtct

SEQ ID NO: 4697 - DNA, 20 bp, Artificial Sequence
  Description of Artificial Sequence:  Hypothetical Probe Sequence
tgcgccataaaggaccttag

SEQ ID NO: 4698 - DNA, 20 bp, Artificial Sequence
  Description of Artificial Sequence:  Hypothetical Probe Sequence
tgcgaggaccatggtaggta

SEQ ID NO: 4699 - DNA, 20 bp, Artificial Sequence
  Description of Artificial Sequence:  Hypothetical Probe Sequence
tcgtggacacggcacgctca

SEQ ID NO: 4700 - DNA, 20 bp, Artificial Sequence
  Description of Artificial Sequence:  Hypothetical Probe Sequence
agtgcagccacgaaagcgaa

SEQ ID NO: 4701 - DNA, 20 bp, Artificial Sequence
  Description of Artificial Sequence:  Hypothetical Probe Sequence
atcggagttgcgcgttggac

SEQ ID NO: 4702 - DNA, 20 bp, Artificial Sequence
  Description of Artificial Sequence:  Hypothetical Probe Sequence
gatggcttcagctgcgcgaa

SEQ ID NO: 4703 - DNA, 20 bp, Artificial Sequence
  Description of Artificial Sequence:  Hypothetical Probe Sequence
tcccttgaacggtcccggac

SEQ ID NO: 4704 - DNA, 20 bp, Artificial Sequence
  Description of Artificial Sequence:  Hypothetical Probe Sequence
gcaattgatcccgaccgtgc

SEQ ID NO: 4705 - DNA, 20 bp, Artificial Sequence
  Description of Artificial Sequence:  Hypothetical Probe Sequence
tcccacgggatgcgttgacc

SEQ ID NO: 4706 - DNA, 20 bp, Artificial Sequence
  Description of Artificial Sequence:  Hypothetical Probe Sequence
ggacatcgagtgtccccagc

SEQ ID NO: 4707 - DNA, 20 bp, Artificial Sequence
  Description of Artificial Sequence:  Hypothetical Probe Sequence
tgcgcgttctgtgagttgcg

SEQ ID NO: 4708 - DNA, 20 bp, Artificial Sequence
  Description of Artificial Sequence:  Hypothetical Probe Sequence
gtctgcaatcgtcacgcagc

SEQ ID NO: 4709 - DNA, 20 bp, Artificial Sequence
  Description of Artificial Sequence:  Hypothetical Probe Sequence
agtgcacggcttctgttgcg

SEQ ID NO: 4710 - DNA, 20 bp, Artificial Sequence
  Description of Artificial Sequence:  Hypothetical Probe Sequence
ctcagcttgaccgcttcagc

SEQ ID NO: 4711 - DNA, 20 bp, Artificial Sequence
  Description of Artificial Sequence:  Hypothetical Probe Sequence
cagccctaatcgacctgtgc

SEQ ID NO: 4712 - DNA, 20 bp, Artificial Sequence
  Description of Artificial Sequence:  Hypothetical Probe Sequence
tcgtgtgcgcttaatcacgg

SEQ ID NO: 4713 - DNA, 20 bp, Artificial Sequence
  Description of Artificial Sequence:  Hypothetical Probe Sequence
cgaagtctcttgacggacgg

SEQ ID NO: 4714 - DNA, 20 bp, Artificial Sequence
  Description of Artificial Sequence:  Hypothetical Probe Sequence
cgtttcccaatcatcggcaa

SEQ ID NO: 4715 - DNA, 20 bp, Artificial Sequence
  Description of Artificial Sequence:  Hypothetical Probe Sequence
gtgctgatgcaaatcggctt

SEQ ID NO: 4716 - DNA, 20 bp, Artificial Sequence
  Description of Artificial Sequence:  Hypothetical Probe Sequence
cttggtgcgcaaaggatgcg

SEQ ID NO: 4717 - DNA, 20 bp, Artificial Sequence
  Description of Artificial Sequence:  Hypothetical Probe Sequence
tcgtttgagcaagacccacg

SEQ ID NO: 4718 - DNA, 20 bp, Artificial Sequence
  Description of Artificial Sequence:  Hypothetical Probe Sequence
cgaacagctgcgaatcgtct

SEQ ID NO: 4719 - DNA, 20 bp, Artificial Sequence
  Description of Artificial Sequence:  Hypothetical Probe Sequences sp.
tcgtgcttacggcttgagcc

SEQ ID NO: 4720 - DNA, 20 bp, Artificial Sequence
  Description of Artificial Sequence:  Hypothetical Probe Sequence
tcccgagtacctggacacgg

SEQ ID NO: 4721 - DNA, 20 bp, Artificial Sequence
  Description of Artificial Sequence:  Hypothetical Probe Sequence
tcccgctttgattctgtcgt

SEQ ID NO: 4722 - DNA, 20 bp, Artificial Sequence
  Description of Artificial Sequence:  Hypothetical Probe Sequence
tcccacctgtctacctagcc

SEQ ID NO: 4723 - DNA, 20 bp, Artificial Sequence
  Description of Artificial Sequence:  Hypothetical Probe Sequence
tccccacgatacacctttga

SEQ ID NO: 4724 - DNA, 20 bp, Artificial Sequence
  Description of Artificial Sequence:  Hypothetical Probe Sequence
tgcgcttgatactgtcgctt

SEQ ID NO: 4725 - DNA, 20 bp, Artificial Sequence
  Description of Artificial Sequence:  Hypothetical Probe Sequence
tgcgctcaatacagcctcgt

SEQ ID NO: 4726 - DNA, 20 bp, Artificial Sequence
  Description of Artificial Sequence:  Hypothetical Probe Sequence
tgcgatcgcgaagcaatgat

SEQ ID NO: 4727 - DNA, 20 bp, Artificial Sequence
  Description of Artificial Sequence:  Hypothetical Probe Sequence
tgcgtccctctgtgatcacg

SEQ ID NO: 4728 - DNA, 20 bp, Artificial Sequence
  Description of Artificial Sequence:  Hypothetical Probe Sequence
tgcgcacgaggaatcgcttg

SEQ ID NO: 4729 - DNA, 20 bp, Artificial Sequence
  Description of Artificial Sequence:  Hypothetical Probe Sequence
gtgctacagtgcaaagcacg

SEQ ID NO: 4730 - DNA, 20 bp, Artificial Sequence
  Description of Artificial Sequence:  Hypothetical Probe Sequence
aaagggacgtgcgcttcgaa

SEQ ID NO: 4731 - DNA, 20 bp, Artificial Sequence
  Description of Artificial Sequence:  Hypothetical Probe Sequence
tctgcacgcgttgtgcggta

SEQ ID NO: 4732 - DNA, 20 bp, Artificial Sequence
  Description of Artificial Sequence:  Hypothetical Probe Sequence
tgtcccattccccacgcgtt

SEQ ID NO: 4733 - DNA, 20 bp, Artificial Sequence
  Description of Artificial Sequence:  Hypothetical Probe Sequence
tcgtagccggtatgcgacgg

SEQ ID NO: 4734 - DNA, 20 bp, Artificial Sequence
  Description of Artificial Sequence:  Hypothetical Probe Sequence
ccatgcttcgaaacggcgaa

SEQ ID NO: 4735 - DNA, 20 bp, Artificial Sequence
  Description of Artificial Sequence:  Hypothetical Probe Sequence
cgaaatcggcaacctatgcg

SEQ ID NO: 4736 - DNA, 20 bp, Artificial Sequence
  Description of Artificial Sequence:  Hypothetical Probe Sequence
tcccggtattagagcccacg

SEQ ID NO: 4737 - DNA, 20 bp, Artificial Sequence
  Description of Artificial Sequence:  Hypothetical Probe Sequence
tgcgtgcgctcaatcgagga

SEQ ID NO: 4738 - DNA, 20 bp, Artificial Sequence
  Description of Artificial Sequence:  Hypothetical Probe Sequence
tgcgagccgatgccatcttg

SEQ ID NO: 4739 - DNA, 20 bp, Artificial Sequence
  Description of Artificial Sequence:  Hypothetical Probe Sequence
cagcacgggacccctacacg

SEQ ID NO: 4740 - DNA, 20 bp, Artificial Sequence
  Description of Artificial Sequence:  Hypothetical Probe Sequence
gtgctcccgcaacgttgtgc

SEQ ID NO: 4741 - DNA, 20 bp, Artificial Sequence
  Description of Artificial Sequence:  Hypothetical Probe Sequence
acgggcaaacctcttgcttg

SEQ ID NO: 4742 - DNA, 20 bp, Artificial Sequence
  Description of Artificial Sequence:  Hypothetical Probe Sequence
acgggatggcaaggacctca

SEQ ID NO: 4743 - DNA, 20 bp, Artificial Sequence
  Description of Artificial Sequence:  Hypothetical Probe Sequence
agcctgtccgtttgcgacgg

SEQ ID NO: 4744 - DNA, 20 bp, Artificial Sequence
  Description of Artificial Sequence:  Hypothetical Probe Sequence
agccaggatcccaaagccta

SEQ ID NO: 4745 - DNA, 20 bp, Artificial Sequence
  Description of Artificial Sequence:  Hypothetical Probe Sequence
tctgacggtcccgcttacgg

SEQ ID NO: 4746 - DNA, 20 bp, Artificial Sequence
  Description of Artificial Sequence:  Hypothetical Probe Sequence
tgtccacgtgcgggacacgg

SEQ ID NO: 4747 - DNA, 20 bp, Artificial Sequence
  Description of Artificial Sequence:  Hypothetical Probe Sequence
cgaagtgccacgcacgcgtt

SEQ ID NO: 4748 - DNA, 20 bp, Artificial Sequence
  Description of Artificial Sequence:  Hypothetical Probe Sequence
ggtaacggctcaagccgctt

SEQ ID NO: 4749 - DNA, 20 bp, Artificial Sequence
  Description of Artificial Sequence:  Hypothetical Probe Sequence
tgatgcaaagccgtgcagcc

SEQ ID NO: 4750 - DNA, 20 bp, Artificial Sequence
  Description of Artificial Sequence:  Hypothetical Probe Sequence
gatggtgcgcttagccgcaa

SEQ ID NO: 4751 - DNA, 20 bp, Artificial Sequence
  Description of Artificial Sequence:  Hypothetical Probe Sequence
tccctcccggtatcgtacgg

SEQ ID NO: 4752 - DNA, 20 bp, Artificial Sequence
  Description of Artificial Sequence:  Hypothetical Probe Sequence
tccccacggagtggaccagc

SEQ ID NO: 4753 - DNA, 20 bp, Artificial Sequence
  Description of Artificial Sequence:  Hypothetical Probe Sequence
cacgatcgggacgcaacacg

SEQ ID NO: 4754 - DNA, 20 bp, Artificial Sequence
  Description of Artificial Sequence:  Hypothetical Probe Sequence
cacgtcccttgagaccgcaa

SEQ ID NO: 4755 - DNA, 20 bp, Artificial Sequence
  Description of Artificial Sequence:  Hypothetical Probe Sequence
cagccacgggacagccagtg

SEQ ID NO: 4756 - DNA, 20 bp, Artificial Sequence
  Description of Artificial Sequence:  Hypothetical Probe Sequence
cagcggacttagtcccgtgc

SEQ ID NO: 4757 - DNA, 20 bp, Artificial Sequence
  Description of Artificial Sequence:  Hypothetical Probe Sequence
gacccgaatgattgtcgcaa

SEQ ID NO: 4758 - DNA, 20 bp, Artificial Sequence
  Description of Artificial Sequence:  Hypothetical Probe Sequence
gaccatcgagcccacgagga

SEQ ID NO: 4759 - DNA, 20 bp, Artificial Sequence
  Description of Artificial Sequence:  Hypothetical Probe Sequence
gtgccgaagagtcacgggac

SEQ ID NO: 4760 - DNA, 20 bp, Artificial Sequence
  Description of Artificial Sequence:  Hypothetical Probe Sequence
gtgcgtctacggagcctgcg

SEQ ID NO: 4761 - DNA, 20 bp, Artificial Sequence
  Description of Artificial Sequence:  Hypothetical Probe Sequence
gtgcgagtacggacggcgtt

SEQ ID NO: 4762 - DNA, 20 bp, Artificial Sequence
  Description of Artificial Sequence:  Hypothetical Probe Sequence
gtgctgcgaaagaggatccc

SEQ ID NO: 4763 - DNA, 20 bp, Artificial Sequence
  Description of Artificial Sequence:  Hypothetical Probe Sequence
ggacgacccgaaggaccttg

SEQ ID NO: 4764 - DNA, 20 bp, Artificial Sequence
  Description of Artificial Sequence:  Hypothetical Probe Sequence
ggacagccgcttgaccgatg

SEQ ID NO: 4765 - DNA, 20 bp, Artificial Sequence
  Description of Artificial Sequence:  Hypothetical Probe Sequence
gcaatgcgctgtcctaacgg

SEQ ID NO: 4766 - DNA, 20 bp, Artificial Sequence
  Description of Artificial Sequence:  Hypothetical Probe Sequence
atcgcacgtctgcttgccat

SEQ ID NO: 4767 - DNA, 20 bp, Artificial Sequence
  Description of Artificial Sequence:  Hypothetical Probe Sequence
cagcgcaatacaggaccacg

SEQ ID NO: 4768 - DNA, 20 bp, Artificial Sequence
  Description of Artificial Sequence:  Hypothetical Probe Sequence
ggacctgtgtgccttgcgtt

SEQ ID NO: 4769 - DNA, 20 bp, Artificial Sequence
  Description of Artificial Sequence:  Hypothetical Probe Sequence
ggacggacaatcgatgcacg

SEQ ID NO: 4770 - DNA, 20 bp, Artificial Sequence
  Description of Artificial Sequence:  Hypothetical Probe Sequence
tctgcgttcctatgcgcgaa

SEQ ID NO: 4771 - DNA, 20 bp, Artificial Sequence
  Description of Artificial Sequence:  Hypothetical Probe Sequence
cgtttcccatacgatgcgaa

SEQ ID NO: 4772 - DNA, 20 bp, Artificial Sequence
  Description of Artificial Sequence:  Hypothetical Probe Sequence
cgaatctgtccctcccggac

SEQ ID NO: 4773 - DNA, 20 bp, Artificial Sequence
  Description of Artificial Sequence:  Hypothetical Probe Sequence
cgaagcaaacggtgtcgatg

SEQ ID NO: 4774 - DNA, 20 bp, Artificial Sequence
  Description of Artificial Sequence:  Hypothetical Probe Sequence
aatccgaacacggaccggac

SEQ ID NO: 4775 - DNA, 20 bp, Artificial Sequence
  Description of Artificial Sequence:  Hypothetical Probe Sequence
gcttttaggatgcagcacgg

SEQ ID NO: 4776 - DNA, 20 bp, Artificial Sequence
  Description of Artificial Sequence:  Hypothetical Probe Sequence
gcttccatcgaagaccggta

SEQ ID NO: 4777 - DNA, 20 bp, Artificial Sequence
  Description of Artificial Sequence:  Hypothetical Probe Sequence
gagtcgaatgcgtcccagcc

SEQ ID NO: 4778 - DNA, 20 bp, Artificial Sequence
  Description of Artificial Sequence:  Hypothetical Probe Sequence
aggaacggcgttcttggctt

SEQ ID NO: 4779 - DNA, 20 bp, Artificial Sequence
  Description of Artificial Sequence:  Hypothetical Probe Sequence
tgcgtcgttctgtcccgatg

SEQ ID NO: 4780 - DNA, 20 bp, Artificial Sequence
  Description of Artificial Sequence:  Hypothetical Probe Sequence
cagcgatgggacgagtcgtt

SEQ ID NO: 4781 - DNA, 20 bp, Artificial Sequence
  Description of Artificial Sequence:  Hypothetical Probe Sequence
gtgcaggactcaggactgcg

SEQ ID NO: 4782 - DNA, 20 bp, Artificial Sequence
  Description of Artificial Sequence:  Hypothetical Probe Sequence
ggactgcgccatacctgcaa

SEQ ID NO: 4783 - DNA, 20 bp, Artificial Sequence
  Description of Artificial Sequence:  Hypothetical Probe Sequence
agccatcgctgtgcttgcaa

SEQ ID NO: 4784 - DNA, 20 bp, Artificial Sequence
  Description of Artificial Sequence:  Hypothetical Probe Sequence
agccgtgcggtagaccggac

SEQ ID NO: 4785 - DNA, 20 bp, Artificial Sequence
  Description of Artificial Sequence:  Hypothetical Probe Sequence
gcttggacgagttgcggcaa

SEQ ID NO: 4786 - DNA, 20 bp, Artificial Sequence
  Description of Artificial Sequence:  Hypothetical Probe Sequence
gcaagaccatcgcacggcaa

SEQ ID NO: 4787 - DNA, 20 bp, Artificial Sequence
  Description of Artificial Sequence:  Hypothetical Probe Sequence
cagcctcaagcccgaagtgc

SEQ ID NO: 4788 - DNA, 20 bp, Artificial Sequence
  Description of Artificial Sequence:  Hypothetical Probe Sequence
gtgctcgtgctttgcgtgcg

SEQ ID NO: 4789 - DNA, 20 bp, Artificial Sequence
  Description of Artificial Sequence:  Hypothetical Probe Sequence
cgtttgtccttggatgcgaa

SEQ ID NO: 4790 - DNA, 20 bp, Artificial Sequence
  Description of Artificial Sequence:  Hypothetical Probe Sequence
ctcatcgtggaccgaaagcc

SEQ ID NO: 4791 - DNA, 20 bp, Artificial Sequence
  Description of Artificial Sequence:  Hypothetical Probe Sequence
cgaactgtagtgcagcacgg

SEQ ID NO: 4792 - DNA, 20 bp, Artificial Sequence
  Description of Artificial Sequence:  Hypothetical Probe Sequence
atcgcttgctgtacggcgaa

SEQ ID NO: 4793 - DNA, 20 bp, Artificial Sequence
  Description of Artificial Sequence:  Hypothetical Probe Sequence
atcgggtatgcgcacgtgtc

SEQ ID NO: 4794 - DNA, 20 bp, Artificial Sequence
  Description of Artificial Sequence:  Hypothetical Probe Sequence
tgcgatcgaggactcaacgg

SEQ ID NO: 4795 - DNA, 20 bp, Artificial Sequence
  Description of Artificial Sequence:  Hypothetical Probe Sequence
gaccgcaactgttcgtgctt

SEQ ID NO: 4796 - DNA, 20 bp, Artificial Sequence
  Description of Artificial Sequence:  Hypothetical Probe Sequence
ggaccgaaagtgccatggac

SEQ ID NO: 4797 - DNA, 20 bp, Artificial Sequence
  Description of Artificial Sequence:  Hypothetical Probe Sequence
ccattccctccccagcgcaa

SEQ ID NO: 4798 - DNA, 20 bp, Artificial Sequence
  Description of Artificial Sequence:  Hypothetical Probe Sequence
tccccttgcgaatgcgtgcg

SEQ ID NO: 4799 - DNA, 20 bp, Artificial Sequence
  Description of Artificial Sequence:  Hypothetical Probe Sequence
acggctgttcgttgtcgcaa

SEQ ID NO: 4800 - DNA, 20 bp, Artificial Sequence
  Description of Artificial Sequence:  Hypothetical Probe Sequence
acgggctttgtccacggagt

SEQ ID NO: 4801 - DNA, 20 bp, Artificial Sequence
  Description of Artificial Sequence:  Hypothetical Probe Sequence
acggacggccatccatgctt

SEQ ID NO: 4802 - DNA, 20 bp, Artificial Sequence
  Description of Artificial Sequence:  Hypothetical Probe Sequence
ttgaagcccgttcgaaacgg

SEQ ID NO: 4803 - DNA, 20 bp, Artificial Sequence
  Description of Artificial Sequence:  Hypothetical Probe Sequence
tgattgcgcttgggacgatg

SEQ ID NO: 4804 - DNA, 20 bp, Artificial Sequence
  Description of Artificial Sequence:  Hypothetical Probe Sequence
aatctgcgcgaatgtctgcg

SEQ ID NO: 4805 - DNA, 20 bp, Artificial Sequence
  Description of Artificial Sequence:  Hypothetical Probe Sequence
aatccacgttagtgcgcacg

SEQ ID NO: 4806 - DNA, 20 bp, Artificial Sequence
  Description of Artificial Sequence:  Hypothetical Probe Sequence
tctgcttgctgtgctttccc

SEQ ID NO: 4807 - DNA, 20 bp, Artificial Sequence
  Description of Artificial Sequence:  Hypothetical Probe Sequence
cttggcttagtggcttcacg

SEQ ID NO: 4808 - DNA, 20 bp, Artificial Sequence
  Description of Artificial Sequence:  Hypothetical Probe Sequence
cttggatgccatacggtgcg

SEQ ID NO: 4809 - DNA, 20 bp, Artificial Sequence
  Description of Artificial Sequence:  Hypothetical Probe Sequence
cttggaccctgtcacggcaa

SEQ ID NO: 4810 - DNA, 20 bp, Artificial Sequence
  Description of Artificial Sequence:  Hypothetical Probe Sequence
cgttatcgcacggagtgcaa

SEQ ID NO: 4811 - DNA, 20 bp, Artificial Sequence
  Description of Artificial Sequence:  Hypothetical Probe Sequence
cgttagccggacctgtcacg

SEQ ID NO: 4812 - DNA, 20 bp, Artificial Sequence
  Description of Artificial Sequence:  Hypothetical Probe Sequence
tctgccatgaccgacctccc

SEQ ID NO: 4813 - DNA, 20 bp, Artificial Sequence
  Description of Artificial Sequence:  Hypothetical Probe Sequence
gctttgtccagcgcaatccc

SEQ ID NO: 4814 - DNA, 20 bp, Artificial Sequence
  Description of Artificial Sequence:  Hypothetical Probe Sequence
gcttgtgcgtctgtgccgtt

SEQ ID NO: 4815 - DNA, 20 bp, Artificial Sequence
  Description of Artificial Sequence:  Hypothetical Probe Sequence
ggtacgttcgaatcccccat

SEQ ID NO: 4816 - DNA, 20 bp, Artificial Sequence
  Description of Artificial Sequence:  Hypothetical Probe Sequence
tctgggtagtgcatcgcgaa

SEQ ID NO: 4817 - DNA, 20 bp, Artificial Sequence
  Description of Artificial Sequence:  Hypothetical Probe Sequence
acctacgggtgccgttgtgc

SEQ ID NO: 4818 - DNA, 20 bp, Artificial Sequence
  Description of Artificial Sequence:  Hypothetical Probe Sequence
atcgtgcggtctacgggtgc

SEQ ID NO: 4819 - DNA, 20 bp, Artificial Sequence
  Description of Artificial Sequence:  Hypothetical Probe Sequence
atcgggaccagcatcggacc

SEQ ID NO: 4820 - DNA, 20 bp, Artificial Sequence
  Description of Artificial Sequence:  Hypothetical Probe Sequence
tcccctgtgaccagccgatg

SEQ ID NO: 4821 - DNA, 20 bp, Artificial Sequence
  Description of Artificial Sequence:  Hypothetical Probe Sequence
tgcgaaagggaccagcagga

SEQ ID NO: 4822 - DNA, 20 bp, Artificial Sequence
  Description of Artificial Sequence:  Hypothetical Probe Sequence
cacgacctttgatcccgatg

SEQ ID NO: 4823 - DNA, 20 bp, Artificial Sequence
  Description of Artificial Sequence:  Hypothetical Probe Sequence
gtgcaatcgacccacgcagc

SEQ ID NO: 4824 - DNA, 20 bp, Artificial Sequence
  Description of Artificial Sequence:  Hypothetical Probe Sequence
agccgacctcgtgatgcttg

SEQ ID NO: 4825 - DNA, 20 bp, Artificial Sequence
  Description of Artificial Sequence:  Hypothetical Probe Sequence
tcgtgtgctcgtgaccgcaa

SEQ ID NO: 4826 - DNA, 20 bp, Artificial Sequence
  Description of Artificial Sequence:  Hypothetical Probe Sequence
cgttttgaggacgaccatcg

SEQ ID NO: 4827 - DNA, 20 bp, Artificial Sequence
  Description of Artificial Sequence:  Hypothetical Probe Sequence
cgtttgattccccttggcaa

SEQ ID NO: 4828 - DNA, 20 bp, Artificial Sequence
  Description of Artificial Sequence:  Hypothetical Probe Sequence
tgtccgttgtgccgttcagc

SEQ ID NO: 4829 - DNA, 20 bp, Artificial Sequence
  Description of Artificial Sequence:  Hypothetical Probe Sequence
ccatttgaaaagcagctgcg

SEQ ID NO: 4830 - DNA, 20 bp, Artificial Sequence
  Description of Artificial Sequence:  Hypothetical Probe Sequence
tgtcgcttacggatacagcc

SEQ ID NO: 4831 - DNA, 20 bp, Artificial Sequence
  Description of Artificial Sequence:  Hypothetical Probe Sequence
ggtaggacatcgggaccacg

SEQ ID NO: 4832 - DNA, 20 bp, Artificial Sequence
  Description of Artificial Sequence:  Hypothetical Probe Sequence
gagtgcttgtgcgtgcgacc

SEQ ID NO: 4833 - DNA, 20 bp, Artificial Sequence
  Description of Artificial Sequence:  Hypothetical Probe Sequence
gcaacttgcttggtgctccc

SEQ ID NO: 4834 - DNA, 20 bp, Artificial Sequence
  Description of Artificial Sequence:  Hypothetical Probe Sequence
tgtcgcaaccatcacggtct

SEQ ID NO: 4835 - DNA, 20 bp, Artificial Sequence
  Description of Artificial Sequence:  Hypothetical Probe Sequence
tgtcgcaaggtaaatctgcg

SEQ ID NO: 4836 - DNA, 20 bp, Artificial Sequence
  Description of Artificial Sequence:  Hypothetical Probe Sequence
atcggaccaatcatcgcgaa

SEQ ID NO: 4837 - DNA, 20 bp, Artificial Sequence
  Description of Artificial Sequence:  Hypothetical Probe Sequence
aggacgaatcccatcggcaa

SEQ ID NO: 4838 - DNA, 20 bp, Artificial Sequence
  Description of Artificial Sequence:  Hypothetical Probe Sequence
gatgcttgtacatcccgcaa

SEQ ID NO: 4839 - DNA, 20 bp, Artificial Sequence
  Description of Artificial Sequence:  Hypothetical Probe Sequence
gatggatggacctgcgacgg

SEQ ID NO: 4840 - DNA, 20 bp, Artificial Sequence
  Description of Artificial Sequence:  Hypothetical Probe Sequence
tgtcgatgtccctcgtgctt

SEQ ID NO: 4841 - DNA, 20 bp, Artificial Sequence
  Description of Artificial Sequence:  Hypothetical Probe Sequence
tgtcgatgtgcgcctacagc

SEQ ID NO: 4842 - DNA, 20 bp, Artificial Sequence
  Description of Artificial Sequence:  Hypothetical Probe Sequence
gatgcacgacctttagcgaa

SEQ ID NO: 4843 - DNA, 20 bp, Artificial Sequence
  Description of Artificial Sequence:  Hypothetical Probe Sequence
tgcgcctatgatcttgcagc

SEQ ID NO: 4844 - DNA, 20 bp, Artificial Sequence
  Description of Artificial Sequence:  Hypothetical Probe Sequence
tgtccacggcaaaaagccta

SEQ ID NO: 4845 - DNA, 20 bp, Artificial Sequence
  Description of Artificial Sequence:  Hypothetical Probe Sequence
tgtccacgcagcaatcagcc

SEQ ID NO: 4846 - DNA, 20 bp, Artificial Sequence
  Description of Artificial Sequence:  Hypothetical Probe Sequence
cagcatcgccatgatggctt

SEQ ID NO: 4847 - DNA, 20 bp, Artificial Sequence
  Description of Artificial Sequence:  Hypothetical Probe Sequence
tgtccagccagccttgcgaa

SEQ ID NO: 4848 - DNA, 20 bp, Artificial Sequence
  Description of Artificial Sequence:  Hypothetical Probe Sequence
gaccaaagagccagcccgaa

SEQ ID NO: 4849 - DNA, 20 bp, Artificial Sequence
  Description of Artificial Sequence:  Hypothetical Probe Sequence
tgtcgaccggtaagccgacc

SEQ ID NO: 4850 - DNA, 20 bp, Artificial Sequence
  Description of Artificial Sequence:  Hypothetical Probe Sequence
gaccagtgcagcgatggcaa

SEQ ID NO: 4851 - DNA, 20 bp, Artificial Sequence
  Description of Artificial Sequence:  Hypothetical Probe Sequence
tgtcgacctcccgacctcgt

SEQ ID NO: 4852 - DNA, 20 bp, Artificial Sequence
  Description of Artificial Sequence:  Hypothetical Probe Sequence
gaccgtgctgtcaatccacg

SEQ ID NO: 4853 - DNA, 20 bp, Artificial Sequence
  Description of Artificial Sequence:  Hypothetical Probe Sequence
gtgctgtctcgtagcccgaa

SEQ ID NO: 4854 - DNA, 20 bp, Artificial Sequence
  Description of Artificial Sequence:  Hypothetical Probe Sequence
tgtcgtgccctatctgtgcg

SEQ ID NO: 4855 - DNA, 20 bp, Artificial Sequence
  Description of Artificial Sequence:  Hypothetical Probe Sequence
tgtcgtgccagcccatagga

SEQ ID NO: 4856 - DNA, 20 bp, Artificial Sequence
  Description of Artificial Sequence:  Hypothetical Probe Sequence
tgtcggacaaagtgcgacgg

SEQ ID NO: 4857 - DNA, 20 bp, Artificial Sequence
  Description of Artificial Sequence:  Hypothetical Probe Sequence
ggacctcaatacgtgccagc

SEQ ID NO: 4858 - DNA, 20 bp, Artificial Sequence
  Description of Artificial Sequence:  Hypothetical Probe Sequence
tgtcggacccatgaccctca

SEQ ID NO: 4859 - DNA, 20 bp, Artificial Sequence
  Description of Artificial Sequence:  Hypothetical Probe Sequence
acggcgttaaagtgtccgaa

SEQ ID NO: 4860 - DNA, 20 bp, Artificial Sequence
  Description of Artificial Sequence:  Hypothetical Probe Sequence
agcccttgcagcaaagcttg

SEQ ID NO: 4861 - DNA, 20 bp, Artificial Sequence
  Description of Artificial Sequence:  Hypothetical Probe Sequence
aaagacggtgtcgcaacacg

SEQ ID NO: 4862 - DNA, 20 bp, Artificial Sequence
  Description of Artificial Sequence:  Hypothetical Probe Sequence
cttgcttgcgttatcgccat

SEQ ID NO: 4863 - DNA, 20 bp, Artificial Sequence
  Description of Artificial Sequence:  Hypothetical Probe Sequence
cgttgcaactcaggtatgcg

SEQ ID NO: 4864 - DNA, 20 bp, Artificial Sequence
  Description of Artificial Sequence:  Hypothetical Probe Sequence
cgttaggaacctacggcgaa

SEQ ID NO: 4865 - DNA, 20 bp, Artificial Sequence
  Description of Artificial Sequence:  Hypothetical Probe Sequence
cgttcacgtacatcgttgcg

SEQ ID NO: 4866 - DNA, 20 bp, Artificial Sequence
  Description of Artificial Sequence:  Hypothetical Probe Sequence
ctgttcgtgaccacggtgcg

SEQ ID NO: 4867 - DNA, 20 bp, Artificial Sequence
  Description of Artificial Sequence:  Hypothetical Probe Sequence
ccatatcgcagcccatcagc

SEQ ID NO: 4868 - DNA, 20 bp, Artificial Sequence
  Description of Artificial Sequence:  Hypothetical Probe Sequence
tcgtccatggaccgaagcaa

SEQ ID NO: 4869 - DNA, 20 bp, Artificial Sequence
  Description of Artificial Sequence:  Hypothetical Probe Sequence
acctgtgccagccacggtgc

SEQ ID NO: 4870 - DNA, 20 bp, Artificial Sequence
  Description of Artificial Sequence:  Hypothetical Probe Sequence
atcgctgtacctcgtttgcg

SEQ ID NO: 4871 - DNA, 20 bp, Artificial Sequence
  Description of Artificial Sequence:  Hypothetical Probe Sequence
cctaacggatcgttgaagcc

SEQ ID NO: 4872 - DNA, 20 bp, Artificial Sequence
  Description of Artificial Sequence:  Hypothetical Probe Sequence
tcgtgatgatcggtgcacgg

SEQ ID NO: 4873 - DNA, 20 bp, Artificial Sequence
  Description of Artificial Sequence:  Hypothetical Probe Sequence
tcgttcccctcaagtggacc

SEQ ID NO: 4874 - DNA, 20 bp, Artificial Sequence
  Description of Artificial Sequence:  Hypothetical Probe Sequence
tcccagtggatgggacccat

SEQ ID NO: 4875 - DNA, 20 bp, Artificial Sequence
  Description of Artificial Sequence:  Hypothetical Probe Sequence
tcgttcccgatgaggaacgg

SEQ ID NO: 4876 - DNA, 20 bp, Artificial Sequence
  Description of Artificial Sequence:  Hypothetical Probe Sequence
tccccagccgttgtctcagc

SEQ ID NO: 4877 - DNA, 20 bp, Artificial Sequence
  Description of Artificial Sequence:  Hypothetical Probe Sequence
tgcggcaatgatccatcacg

SEQ ID NO: 4878 - DNA, 20 bp, Artificial Sequence
  Description of Artificial Sequence:  Hypothetical Probe Sequence
tgcgtcccctcagtgcctca

SEQ ID NO: 4879 - DNA, 20 bp, Artificial Sequence
  Description of Artificial Sequence:  Hypothetical Probe Sequence
tcgttgcgcacgtgatcgtt

SEQ ID NO: 4880 - DNA, 20 bp, Artificial Sequence
  Description of Artificial Sequence:  Hypothetical Probe Sequence
tgcggtgctgatggacatcg

SEQ ID NO: 4881 - DNA, 20 bp, Artificial Sequence
  Description of Artificial Sequence:  Hypothetical Probe Sequence
tcgtgaccgaccgatgtccc

SEQ ID NO: 4882 - DNA, 20 bp, Artificial Sequence
  Description of Artificial Sequence:  Hypothetical Probe Sequence
gtgcgatggagtgtgcccat

SEQ ID NO: 4883 - DNA, 20 bp, Artificial Sequence
  Description of Artificial Sequence:  Hypothetical Probe Sequence
gtgcgacctgatatcggtgc

SEQ ID NO: 4884 - DNA, 20 bp, Artificial Sequence
  Description of Artificial Sequence:  Hypothetical Probe Sequence
tcgtggacaggagatggctt

SEQ ID NO: 4885 - DNA, 20 bp, Artificial Sequence
  Description of Artificial Sequence:  Hypothetical Probe Sequence
acggtgatcacgcagcacgg

SEQ ID NO: 4886 - DNA, 20 bp, Artificial Sequence
  Description of Artificial Sequence:  Hypothetical Probe Sequence
tcgtacggggacaaagcgtt

SEQ ID NO: 4887 - DNA, 20 bp, Artificial Sequence
  Description of Artificial Sequence:  Hypothetical Probe Sequence
tgtcgtgcacggctgttgcg

SEQ ID NO: 4888 - DNA, 20 bp, Artificial Sequence
  Description of Artificial Sequence:  Hypothetical Probe Sequence
tcgtccatagcctcccggta

SEQ ID NO: 4889 - DNA, 20 bp, Artificial Sequence
  Description of Artificial Sequence:  Hypothetical Probe Sequence
ccatgtcttgcggcttacgg

SEQ ID NO: 4890 - DNA, 20 bp, Artificial Sequence
  Description of Artificial Sequence:  Hypothetical Probe Sequence
gctttcgtccatcttggtgc

SEQ ID NO: 4891 - DNA, 20 bp, Artificial Sequence
  Description of Artificial Sequence:  Hypothetical Probe Sequence
aggagctttgcgccatgcaa

SEQ ID NO: 4892 - DNA, 20 bp, Artificial Sequence
  Description of Artificial Sequence:  Hypothetical Probe Sequence
tcccaaaggcttgcaatccc

SEQ ID NO: 4893 - DNA, 20 bp, Artificial Sequence
  Description of Artificial Sequence:  Hypothetical Probe Sequence
cttgtgcgcttgaaagcgaa

SEQ ID NO: 4894 - DNA, 20 bp, Artificial Sequence
  Description of Artificial Sequence:  Hypothetical Probe Sequence
tgcggagttgtcagccggta

SEQ ID NO: 4895 - DNA, 20 bp, Artificial Sequence
  Description of Artificial Sequence:  Hypothetical Probe Sequence
cacgtgtctcccagccccat

SEQ ID NO: 4896 - DNA, 20 bp, Artificial Sequence
  Description of Artificial Sequence:  Hypothetical Probe Sequence
cacgctgtcgaattagcagc

SEQ ID NO: 4897 - DNA, 20 bp, Artificial Sequence
  Description of Artificial Sequence:  Hypothetical Probe Sequence
ggacacctctgtgtgcgcaa

SEQ ID NO: 4898 - DNA, 20 bp, Artificial Sequence
  Description of Artificial Sequence:  Hypothetical Probe Sequence
acggagtgacggcgaacgaa

SEQ ID NO: 4899 - DNA, 20 bp, Artificial Sequence
  Description of Artificial Sequence:  Hypothetical Probe Sequence
agccaatctgcggcaaccat

SEQ ID NO: 4900 - DNA, 20 bp, Artificial Sequence
  Description of Artificial Sequence:  Hypothetical Probe Sequence
agccgtctcctaatcgagcc

SEQ ID NO: 4901 - DNA, 20 bp, Artificial Sequence
  Description of Artificial Sequence:  Hypothetical Probe Sequence
agccagtgaaagtgcgcacg

SEQ ID NO: 4902 - DNA, 20 bp, Artificial Sequence
  Description of Artificial Sequence:  Hypothetical Probe Sequence
tctgtcgttcccgtgcggac

SEQ ID NO: 4903 - DNA, 20 bp, Artificial Sequence
  Description of Artificial Sequence:  Hypothetical Probe Sequence
tcgtgtctggaccacgtccc

SEQ ID NO: 4904 - DNA, 20 bp, Artificial Sequence
  Description of Artificial Sequence:  Hypothetical Probe Sequence
cgttgctttgcggatgtcgt

SEQ ID NO: 4905 - DNA, 20 bp, Artificial Sequence
  Description of Artificial Sequence:  Hypothetical Probe Sequence
ggtaaaagtcgttcccagcc

SEQ ID NO: 4906 - DNA, 20 bp, Artificial Sequence
  Description of Artificial Sequence:  Hypothetical Probe Sequence
ggtacacgccatcagccacg

SEQ ID NO: 4907 - DNA, 20 bp, Artificial Sequence
  Description of Artificial Sequence:  Hypothetical Probe Sequence
cctacacgcttgtgcggacc

SEQ ID NO: 4908 - DNA, 20 bp, Artificial Sequence
  Description of Artificial Sequence:  Hypothetical Probe Sequence
tccccgttggtaaatcccat

SEQ ID NO: 4909 - DNA, 20 bp, Artificial Sequence
  Description of Artificial Sequence:  Hypothetical Probe Sequence
tcccccattgtcgagtcgtt

SEQ ID NO: 4910 - DNA, 20 bp, Artificial Sequence
  Description of Artificial Sequence:  Hypothetical Probe Sequence
cgtttcccgtgctgcgagtg

SEQ ID NO: 4911 - DNA, 20 bp, Artificial Sequence
  Description of Artificial Sequence:  Hypothetical Probe Sequence
tgcgttagagtgcacgatcg

SEQ ID NO: 4912 - DNA, 20 bp, Artificial Sequence
  Description of Artificial Sequence:  Hypothetical Probe Sequence
cacgcacgtgtcaaagtccc

SEQ ID NO: 4913 - DNA, 20 bp, Artificial Sequence
  Description of Artificial Sequence:  Hypothetical Probe Sequence
gacccttggcaatacaacgg

SEQ ID NO: 4914 - DNA, 20 bp, Artificial Sequence
  Description of Artificial Sequence:  Hypothetical Probe Sequence
gtgcacggcttgtgtccgtt

SEQ ID NO: 4915 - DNA, 20 bp, Artificial Sequence
  Description of Artificial Sequence:  Hypothetical Probe Sequence
aaagtgcgtcgttgattgcg

SEQ ID NO: 4916 - DNA, 20 bp, Artificial Sequence
  Description of Artificial Sequence:  Hypothetical Probe Sequence
aaaggacctctgcagccgtt

SEQ ID NO: 4917 - DNA, 20 bp, Artificial Sequence
  Description of Artificial Sequence:  Hypothetical Probe Sequence
tcgtgcaacgttgaccacgg

SEQ ID NO: 4918 - DNA, 20 bp, Artificial Sequence
  Description of Artificial Sequence:  Hypothetical Probe Sequence
tcccggacaggagtgcacct

SEQ ID NO: 4919 - DNA, 20 bp, Artificial Sequence
  Description of Artificial Sequence:  Hypothetical Probe Sequence
gatgcagccgaaatcgcagc

SEQ ID NO: 4920 - DNA, 20 bp, Artificial Sequence
  Description of Artificial Sequence:  Hypothetical Probe Sequence
tccctgcgttgaggtatgcg

SEQ ID NO: 4921 - DNA, 20 bp, Artificial Sequence
  Description of Artificial Sequence:  Hypothetical Probe Sequence
tgcgacgggcaaccattgat

SEQ ID NO: 4922 - DNA, 20 bp, Artificial Sequence
  Description of Artificial Sequence:  Hypothetical Probe Sequence
gaccccatcttgatcggcaa

SEQ ID NO: 4923 - DNA, 20 bp, Artificial Sequence
  Description of Artificial Sequence:  Hypothetical Probe Sequence
gtgcatcggaccaccttgcg

SEQ ID NO: 4924 - DNA, 20 bp, Artificial Sequence
  Description of Artificial Sequence:  Hypothetical Probe Sequence
gtgccacgatacggaccgtt

SEQ ID NO: 4925 - DNA, 20 bp, Artificial Sequence
  Description of Artificial Sequence:  Hypothetical Probe Sequence
ggaccctaccattcccagcc

SEQ ID NO: 4926 - DNA, 20 bp, Artificial Sequence
  Description of Artificial Sequence:  Hypothetical Probe Sequence
ggaccacggtgcgatgctca

SEQ ID NO: 4927 - DNA, 20 bp, Artificial Sequence
  Description of Artificial Sequence:  Hypothetical Probe Sequence
tgtccagcttgaacggctgt

SEQ ID NO: 4928 - DNA, 20 bp, Artificial Sequence
  Description of Artificial Sequence:  Hypothetical Probe Sequence
ccattcgttcgtcgttgctt

SEQ ID NO: 4929 - DNA, 20 bp, Artificial Sequence
  Description of Artificial Sequence:  Hypothetical Probe Sequence
tcgtgagtcacgtgcgcagc

SEQ ID NO: 4930 - DNA, 20 bp, Artificial Sequence
  Description of Artificial Sequence:  Hypothetical Probe Sequence
tgcgatacggacatcggcaa

SEQ ID NO: 4931 - DNA, 20 bp, Artificial Sequence
  Description of Artificial Sequence:  Hypothetical Probe Sequence
tgcgcgaagatgctcacagc

SEQ ID NO: 4932 - DNA, 20 bp, Artificial Sequence
  Description of Artificial Sequence:  Hypothetical Probe Sequence
cacgaatcgcttgtgcgctt

SEQ ID NO: 4933 - DNA, 20 bp, Artificial Sequence
  Description of Artificial Sequence:  Hypothetical Probe Sequence
cagcagccaaaggtcttccc

SEQ ID NO: 4934 - DNA, 20 bp, Artificial Sequence
  Description of Artificial Sequence:  Hypothetical Probe Sequence
ttgatcccaatccgaatccc

SEQ ID NO: 4935 - DNA, 20 bp, Artificial Sequence
  Description of Artificial Sequence:  Hypothetical Probe Sequence
ttagcacgggtacagcacgg

SEQ ID NO: 4936 - DNA, 20 bp, Artificial Sequence
  Description of Artificial Sequence:  Hypothetical Probe Sequence
tgtctcccgtgcccatagcc

SEQ ID NO: 4937 - DNA, 20 bp, Artificial Sequence
  Description of Artificial Sequence:  Hypothetical Probe Sequence
tcgtaccttgcggtctcgtt

SEQ ID NO: 4938 - DNA, 20 bp, Artificial Sequence
  Description of Artificial Sequence:  Hypothetical Probe Sequence
tcgtcctaaggatcccagcc

SEQ ID NO: 4939 - DNA, 20 bp, Artificial Sequence
  Description of Artificial Sequence:  Hypothetical Probe Sequence
ctcacgttcacgcgtttgcg

SEQ ID NO: 4940 - DNA, 20 bp, Artificial Sequence
  Description of Artificial Sequence:  Hypothetical Probe Sequence
ccattgatcttgcacgcgtt

SEQ ID NO: 4941 - DNA, 20 bp, Artificial Sequence
  Description of Artificial Sequence:  Hypothetical Probe Sequence
cgaaccatcagcgaccgtct

SEQ ID NO: 4942 - DNA, 20 bp, Artificial Sequence
  Description of Artificial Sequence:  Hypothetical Probe Sequence
gcttctgttccccgtttccc

SEQ ID NO: 4943 - DNA, 20 bp, Artificial Sequence
  Description of Artificial Sequence:  Hypothetical Probe Sequence
atcgaccttctggatgcagc

SEQ ID NO: 4944 - DNA, 20 bp, Artificial Sequence
  Description of Artificial Sequence:  Hypothetical Probe Sequence
atcgacgggagttgtctgcg

SEQ ID NO: 4945 - DNA, 20 bp, Artificial Sequence
  Description of Artificial Sequence:  Hypothetical Probe Sequence
tgcggcttcgttaaagcttg

SEQ ID NO: 4946 - DNA, 20 bp, Artificial Sequence
  Description of Artificial Sequence:  Hypothetical Probe Sequence
cgaatgcgggtaatactgcg

SEQ ID NO: 4947 - DNA, 20 bp, Artificial Sequence
  Description of Artificial Sequence:  Hypothetical Probe Sequence
cgaaggacgtgcacctccta

SEQ ID NO: 4948 - DNA, 20 bp, Artificial Sequence
  Description of Artificial Sequence:  Hypothetical Probe Sequence
acggttagctgtcagcacgg

SEQ ID NO: 4949 - DNA, 20 bp, Artificial Sequence
  Description of Artificial Sequence:  Hypothetical Probe Sequence
cgaaacggagccgtctcgtt

SEQ ID NO: 4950 - DNA, 20 bp, Artificial Sequence
  Description of Artificial Sequence:  Hypothetical Probe Sequence
agccgcaaagtgaatcgtgc

SEQ ID NO: 4951 - DNA, 20 bp, Artificial Sequence
  Description of Artificial Sequence:  Hypothetical Probe Sequence
tcgtcgaagtctcacgccat

SEQ ID NO: 4952 - DNA, 20 bp, Artificial Sequence
  Description of Artificial Sequence:  Hypothetical Probe Sequence
cttgacggagccttgacacg

SEQ ID NO: 4953 - DNA, 20 bp, Artificial Sequence
  Description of Artificial Sequence:  Hypothetical Probe Sequence
cttgcgtttgcgcctagcaa

SEQ ID NO: 4954 - DNA, 20 bp, Artificial Sequence
  Description of Artificial Sequence:  Hypothetical Probe Sequence
gtgcggaccctaacggctca

SEQ ID NO: 4955 - DNA, 20 bp, Artificial Sequence
  Description of Artificial Sequence:  Hypothetical Probe Sequence
gacccagctgtcggaccacg

SEQ ID NO: 4956 - DNA, 20 bp, Artificial Sequence
  Description of Artificial Sequence:  Hypothetical Probe Sequence
gtgccttgtgcgcgaacgtt

SEQ ID NO: 4957 - DNA, 20 bp, Artificial Sequence
  Description of Artificial Sequence:  Hypothetical Probe Sequence
tacatcccggacacgggcaa

SEQ ID NO: 4958 - DNA, 20 bp, Artificial Sequence
  Description of Artificial Sequence:  Hypothetical Probe Sequence
tcgtgatggtcttgcgtccc

SEQ ID NO: 4959 - DNA, 20 bp, Artificial Sequence
  Description of Artificial Sequence:  Hypothetical Probe Sequence
cgttggaccttgctgttccc

SEQ ID NO: 4960 - DNA, 20 bp, Artificial Sequence
  Description of Artificial Sequence:  Hypothetical Probe Sequence
ctcaacctccattcgttccc

SEQ ID NO: 4961 - DNA, 20 bp, Artificial Sequence
  Description of Artificial Sequence:  Hypothetical Probe Sequence
ctcatgcgcacgtctggtgc

SEQ ID NO: 4962 - DNA, 20 bp, Artificial Sequence
  Description of Artificial Sequence:  Hypothetical Probe Sequence
gcaattagcacgccatcgaa

SEQ ID NO: 4963 - DNA, 20 bp, Artificial Sequence
  Description of Artificial Sequence:  Hypothetical Probe Sequence
agtgtcgtttgatgcgggac

SEQ ID NO: 4964 - DNA, 20 bp, Artificial Sequence
  Description of Artificial Sequence:  Hypothetical Probe Sequence
acctctcatgcgtgattgcg

SEQ ID NO: 4965 - DNA, 20 bp, Artificial Sequence
  Description of Artificial Sequence:  Hypothetical Probe Sequence
gcaaatcgatcgcgaacgaa

SEQ ID NO: 4966 - DNA, 20 bp, Artificial Sequence
  Description of Artificial Sequence:  Hypothetical Probe Sequence
gcaaatcgagccaatcggta

SEQ ID NO: 4967 - DNA, 20 bp, Artificial Sequence
  Description of Artificial Sequence:  Hypothetical Probe Sequence
ggacgtcttgtccgttcacg

SEQ ID NO: 4968 - DNA, 20 bp, Artificial Sequence
  Description of Artificial Sequence:  Hypothetical Probe Sequence
gcaaagcccgttcagcacct

SEQ ID NO: 4969 - DNA, 20 bp, Artificial Sequence
  Description of Artificial Sequence:  Hypothetical Probe Sequence
cgaacttgtctgggactgcg

SEQ ID NO: 4970 - DNA, 20 bp, Artificial Sequence
  Description of Artificial Sequence:  Hypothetical Probe Sequence
ttagcgtttgtctgcgtccc

SEQ ID NO: 4971 - DNA, 20 bp, Artificial Sequence
  Description of Artificial Sequence:  Hypothetical Probe Sequence
cgaaccattacatgcggctt

SEQ ID NO: 4972 - DNA, 20 bp, Artificial Sequence
  Description of Artificial Sequence:  Hypothetical Probe Sequence
gcttcgaagtgcctgtcagc

SEQ ID NO: 4973 - DNA, 20 bp, Artificial Sequence
  Description of Artificial Sequence:  Hypothetical Probe Sequence
gtgcttgacacgatcgcacg

SEQ ID NO: 4974 - DNA, 20 bp, Artificial Sequence
  Description of Artificial Sequence:  Hypothetical Probe Sequence
atcgaaagctcagtgcgcaa

SEQ ID NO: 4975 - DNA, 20 bp, Artificial Sequence
  Description of Artificial Sequence:  Hypothetical Probe Sequence
atcgcttgtgtctgcgagcc

SEQ ID NO: 4976 - DNA, 20 bp, Artificial Sequence
  Description of Artificial Sequence:  Hypothetical Probe Sequence
atcgcttgcgaaaaagctgt

SEQ ID NO: 4977 - DNA, 20 bp, Artificial Sequence
  Description of Artificial Sequence:  Hypothetical Probe Sequence
cgttgagtaggaggacggac

SEQ ID NO: 4978 - DNA, 20 bp, Artificial Sequence
  Description of Artificial Sequence:  Hypothetical Probe Sequence
ctcatctggtgcggacgcaa

SEQ ID NO: 4979 - DNA, 20 bp, Artificial Sequence
  Description of Artificial Sequence:  Hypothetical Probe Sequence
ctgtgatgcgttacggcacg

SEQ ID NO: 4980 - DNA, 20 bp, Artificial Sequence
  Description of Artificial Sequence:  Hypothetical Probe Sequence
atcgccataatccagccagc

SEQ ID NO: 4981 - DNA, 20 bp, Artificial Sequence
  Description of Artificial Sequence:  Hypothetical Probe Sequence
atcggcttcagcaaagtctg

SEQ ID NO: 4982 - DNA, 20 bp, Artificial Sequence
  Description of Artificial Sequence:  Hypothetical Probe Sequence
atcggagtggaccacgcttg

SEQ ID NO: 4983 - DNA, 20 bp, Artificial Sequence
  Description of Artificial Sequence:  Hypothetical Probe Sequence
agtgctcaaggaatcggcaa

SEQ ID NO: 4984 - DNA, 20 bp, Artificial Sequence
  Description of Artificial Sequence:  Hypothetical Probe Sequence
atcgcctagatgtgcgagga

SEQ ID NO: 4985 - DNA, 20 bp, Artificial Sequence
  Description of Artificial Sequence:  Hypothetical Probe Sequence
tcccagccctgtgatggtgc

SEQ ID NO: 4986 - DNA, 20 bp, Artificial Sequence
  Description of Artificial Sequence:  Hypothetical Probe Sequence
atcgggactacaatcgcagc

SEQ ID NO: 4987 - DNA, 20 bp, Artificial Sequence
  Description of Artificial Sequence:  Hypothetical Probe Sequence
acggtgtccgaaccatgcaa

SEQ ID NO: 4988 - DNA, 20 bp, Artificial Sequence
  Description of Artificial Sequence:  Hypothetical Probe Sequence
agccgagtttgacgaacacg

SEQ ID NO: 4989 - DNA, 20 bp, Artificial Sequence
  Description of Artificial Sequence:  Hypothetical Probe Sequence
tcgtgaccaggacagcacgg

SEQ ID NO: 4990 - DNA, 20 bp, Artificial Sequence
  Description of Artificial Sequence:  Hypothetical Probe Sequence
gcttgatgtcccgcaatccc

SEQ ID NO: 4991 - DNA, 20 bp, Artificial Sequence
  Description of Artificial Sequence:  Hypothetical Probe Sequence
agtgggtagcaatccccacg

SEQ ID NO: 4992 - DNA, 20 bp, Artificial Sequence
  Description of Artificial Sequence:  Hypothetical Probe Sequence
gtgcgtgccttggaccacct

SEQ ID NO: 4993 - DNA, 20 bp, Artificial Sequence
  Description of Artificial Sequence:  Hypothetical Probe Sequence
cagcaggagaccgaccgcaa

SEQ ID NO: 4994 - DNA, 20 bp, Artificial Sequence
  Description of Artificial Sequence:  Hypothetical Probe Sequence
gatgccatgcaacagcagga

SEQ ID NO: 4995 - DNA, 20 bp, Artificial Sequence
  Description of Artificial Sequence:  Hypothetical Probe Sequence
ggaccttgcacgtcgtcgaa

SEQ ID NO: 4996 - DNA, 20 bp, Artificial Sequence
  Description of Artificial Sequence:  Hypothetical Probe Sequence
tccctgattccccgaacgtt

SEQ ID NO: 4997 - DNA, 20 bp, Artificial Sequence
  Description of Artificial Sequence:  Hypothetical Probe Sequence
tacatgcgttaggacccacg

SEQ ID NO: 4998 - DNA, 20 bp, Artificial Sequence
  Description of Artificial Sequence:  Hypothetical Probe Sequence
tctggatgcacgaatcgtgc

SEQ ID NO: 4999 - DNA, 20 bp, Artificial Sequence
  Description of Artificial Sequence:  Hypothetical Probe Sequence
tccccttgtgcgatcgctgt

SEQ ID NO: 5000 - DNA, 20 bp, Artificial Sequence
  Description of Artificial Sequence:  Hypothetical Probe Sequence
tccccgttacggagtggtct

SEQ ID NO: 5001 - DNA, 20 bp, Artificial Sequence
  Description of Artificial Sequence:  Hypothetical Probe Sequence
tcccctcatacaacggccat

SEQ ID NO: 5002 - DNA, 20 bp, Artificial Sequence
  Description of Artificial Sequence:  Hypothetical Probe Sequence
tcccctcactgtcctatccc

SEQ ID NO: 5003 - DNA, 20 bp, Artificial Sequence
  Description of Artificial Sequence:  Hypothetical Probe Sequence
tcccctcacctaatacacgg

SEQ ID NO: 5004 - DNA, 20 bp, Artificial Sequence
  Description of Artificial Sequence:  Hypothetical Probe Sequence
tcccccatatacgcaacagc

SEQ ID NO: 5005 - DNA, 20 bp, Artificial Sequence
  Description of Artificial Sequence:  Hypothetical Probe Sequence
tccccgaatgatgcttcgtt

SEQ ID NO: 5006 - DNA, 20 bp, Artificial Sequence
  Description of Artificial Sequence:  Hypothetical Probe Sequence
tcccggtagaccccatgacc

SEQ ID NO: 5007 - DNA, 20 bp, Artificial Sequence
  Description of Artificial Sequence:  Hypothetical Probe Sequence
tcccgtctctgtgatgagcc

SEQ ID NO: 5008 - DNA, 20 bp, Artificial Sequence
  Description of Artificial Sequence:  Hypothetical Probe Sequence
tcccgagttgtcgaccccat

SEQ ID NO: 5009 - DNA, 20 bp, Artificial Sequence
  Description of Artificial Sequence:  Hypothetical Probe Sequence
tcccgcaaaggagagtgatg

SEQ ID NO: 5010 - DNA, 20 bp, Artificial Sequence
  Description of Artificial Sequence:  Hypothetical Probe Sequence
tcccatcgtgtctgatagcc

SEQ ID NO: 5011 - DNA, 20 bp, Artificial Sequence
  Description of Artificial Sequence:  Hypothetical Probe Sequence
tcccaggactgtttgacacg

SEQ ID NO: 5012 - DNA, 20 bp, Artificial Sequence
  Description of Artificial Sequence:  Hypothetical Probe Sequence
tccccacgtacaggacaatc

SEQ ID NO: 5013 - DNA, 20 bp, Artificial Sequence
  Description of Artificial Sequence:  Hypothetical Probe Sequence
tccccacggcttcttgacct

SEQ ID NO: 5014 - DNA, 20 bp, Artificial Sequence
  Description of Artificial Sequence:  Hypothetical Probe Sequence
tcccgaccgcttggtaccat

SEQ ID NO: 5015 - DNA, 20 bp, Artificial Sequence
  Description of Artificial Sequence:  Hypothetical Probe Sequence
tcccggactgatcgttgatg

SEQ ID NO: 5016 - DNA, 20 bp, Artificial Sequence
  Description of Artificial Sequence:  Hypothetical Probe Sequence
tcccggacttagcgaacttg

SEQ ID NO: 5017 - DNA, 20 bp, Artificial Sequence
  Description of Artificial Sequence:  Hypothetical Probe Sequence
tcccacggcgaatgtcccta

SEQ ID NO: 5018 - DNA, 20 bp, Artificial Sequence
  Description of Artificial Sequence:  Hypothetical Probe Sequence
tcccacggtcccgagtggta

SEQ ID NO: 5019 - DNA, 20 bp, Artificial Sequence
  Description of Artificial Sequence:  Hypothetical Probe Sequence
tcccagcctacatgtcacgg

SEQ ID NO: 5020 - DNA, 20 bp, Artificial Sequence
  Description of Artificial Sequence:  Hypothetical Probe Sequence
tcccagccgatggatgatcg

SEQ ID NO: 5021 - DNA, 20 bp, Artificial Sequence
  Description of Artificial Sequence:  Hypothetical Probe Sequence
tgcgttgacttgagtgacgg

SEQ ID NO: 5022 - DNA, 20 bp, Artificial Sequence
  Description of Artificial Sequence:  Hypothetical Probe Sequence
tgcgttgaacctacggggac

SEQ ID NO: 5023 - DNA, 20 bp, Artificial Sequence
  Description of Artificial Sequence:  Hypothetical Probe Sequence
tgcgtgatcgttctcacagc

SEQ ID NO: 5024 - DNA, 20 bp, Artificial Sequence
  Description of Artificial Sequence:  Hypothetical Probe Sequence
tgcgtgatgtctcacgcgaa

SEQ ID NO: 5025 - DNA, 20 bp, Artificial Sequence
  Description of Artificial Sequence:  Hypothetical Probe Sequence
tgcgtgatgatgtgtccgaa

SEQ ID NO: 5026 - DNA, 20 bp, Artificial Sequence
  Description of Artificial Sequence:  Hypothetical Probe Sequence
tgcgaatcctgttgtccagc

SEQ ID NO: 5027 - DNA, 20 bp, Artificial Sequence
  Description of Artificial Sequence:  Hypothetical Probe Sequence
tgcgatacgtctgagtagcc

SEQ ID NO: 5028 - DNA, 20 bp, Artificial Sequence
  Description of Artificial Sequence:  Hypothetical Probe Sequence
tgcgaaagtgatagccagtg

SEQ ID NO: 5029 - DNA, 20 bp, Artificial Sequence
  Description of Artificial Sequence:  Hypothetical Probe Sequence
tgcgaaaggtgcaggagagt

SEQ ID NO: 5030 - DNA, 20 bp, Artificial Sequence
  Description of Artificial Sequence:  Hypothetical Probe Sequence
tgcgtacatcgtacggctca

SEQ ID NO: 5031 - DNA, 20 bp, Artificial Sequence
  Description of Artificial Sequence:  Hypothetical Probe Sequence
tgcgtacaggactgcgaaag

SEQ ID NO: 5032 - DNA, 20 bp, Artificial Sequence
  Description of Artificial Sequence:  Hypothetical Probe Sequence
tgcgtcgtggtacctatgtc

SEQ ID NO: 5033 - DNA, 20 bp, Artificial Sequence
  Description of Artificial Sequence:  Hypothetical Probe Sequence
tgcgcgttcctaaaagccat

SEQ ID NO: 5034 - DNA, 20 bp, Artificial Sequence
  Description of Artificial Sequence:  Hypothetical Probe Sequence
tgcgctcactcagaccaaag

SEQ ID NO: 5035 - DNA, 20 bp, Artificial Sequence
  Description of Artificial Sequence:  Hypothetical Probe Sequence
tgcgctcacgaaccatcgtt

SEQ ID NO: 5036 - DNA, 20 bp, Artificial Sequence
  Description of Artificial Sequence:  Hypothetical Probe Sequence
tgcgctcagagtttagcacg

SEQ ID NO: 5037 - DNA, 20 bp, Artificial Sequence
  Description of Artificial Sequence:  Hypothetical Probe Sequence
tgcgctcaagccaggagctt

SEQ ID NO: 5038 - DNA, 20 bp, Artificial Sequence
  Description of Artificial Sequence:  Hypothetical Probe Sequence
tgcgctgtttgagtgctcgt

SEQ ID NO: 5039 - DNA, 20 bp, Artificial Sequence
  Description of Artificial Sequence:  Hypothetical Probe Sequence
tgcgctgtcgttaggatctg

SEQ ID NO: 5040 - DNA, 20 bp, Artificial Sequence
  Description of Artificial Sequence:  Hypothetical Probe Sequence
tgcgctgtgagtctgtcgaa

SEQ ID NO: 5041 - DNA, 20 bp, Artificial Sequence
  Description of Artificial Sequence:  Hypothetical Probe Sequence
tgcgccatctgtagcctgat

SEQ ID NO: 5042 - DNA, 20 bp, Artificial Sequence
  Description of Artificial Sequence:  Hypothetical Probe Sequence
tgcgcgaagaccacctctgt

SEQ ID NO: 5043 - DNA, 20 bp, Artificial Sequence
  Description of Artificial Sequence:  Hypothetical Probe Sequence
tgcgcgaaggacgcaattag

SEQ ID NO: 5044 - DNA, 20 bp, Artificial Sequence
  Description of Artificial Sequence:  Hypothetical Probe Sequence
tgcggcttaatcctcagcaa

SEQ ID NO: 5045 - DNA, 20 bp, Artificial Sequence
  Description of Artificial Sequence:  Hypothetical Probe Sequence
tgcgggtatctgctgtgacc

SEQ ID NO: 5046 - DNA, 20 bp, Artificial Sequence
  Description of Artificial Sequence:  Hypothetical Probe Sequence
tgcgggtagatgcctagacc

SEQ ID NO: 5047 - DNA, 20 bp, Artificial Sequence
  Description of Artificial Sequence:  Hypothetical Probe Sequence
tgcggagtgagtgcttcagc

SEQ ID NO: 5048 - DNA, 20 bp, Artificial Sequence
  Description of Artificial Sequence:  Hypothetical Probe Sequence
tgcggagttgcgagtgcgaa

SEQ ID NO: 5049 - DNA, 20 bp, Artificial Sequence
  Description of Artificial Sequence:  Hypothetical Probe Sequence
tgcggagtcacgtccctaca

SEQ ID NO: 5050 - DNA, 20 bp, Artificial Sequence
  Description of Artificial Sequence:  Hypothetical Probe Sequence
tgcgagtgaatcggacggac

SEQ ID NO: 5051 - DNA, 20 bp, Artificial Sequence
  Description of Artificial Sequence:  Hypothetical Probe Sequence
tgcgaccttctgtacagtgc

SEQ ID NO: 5052 - DNA, 20 bp, Artificial Sequence
  Description of Artificial Sequence:  Hypothetical Probe Sequence
tgcgatcggtgcgagtttga

SEQ ID NO: 5053 - DNA, 20 bp, Artificial Sequence
  Description of Artificial Sequence:  Hypothetical Probe Sequence
tgcgcctattagagccgtgc

SEQ ID NO: 5054 - DNA, 20 bp, Artificial Sequence
  Description of Artificial Sequence:  Hypothetical Probe Sequence
tgcgcctaaatcctgtcttg

SEQ ID NO: 5055 - DNA, 20 bp, Artificial Sequence
  Description of Artificial Sequence:  Hypothetical Probe Sequence
tgcgcctaagtgcgaaacct

SEQ ID NO: 5056 - DNA, 20 bp, Artificial Sequence
  Description of Artificial Sequence:  Hypothetical Probe Sequence
tgcggatgaggattgatcgt

SEQ ID NO: 5057 - DNA, 20 bp, Artificial Sequence
  Description of Artificial Sequence:  Hypothetical Probe Sequence
tgcgtcccatactgatgtgc

SEQ ID NO: 5058 - DNA, 20 bp, Artificial Sequence
  Description of Artificial Sequence:  Hypothetical Probe Sequence
tgcgtcccaggagtgcttag

SEQ ID NO: 5059 - DNA, 20 bp, Artificial Sequence
  Description of Artificial Sequence:  Hypothetical Probe Sequence
tgcggaccttagctcaccat

SEQ ID NO: 5060 - DNA, 20 bp, Artificial Sequence
  Description of Artificial Sequence:  Hypothetical Probe Sequence
tgcggtgcagtgggtatctg

SEQ ID NO: 5061 - DNA, 20 bp, Artificial Sequence
  Description of Artificial Sequence:  Hypothetical Probe Sequence
tgcgggacggtaacggtgat

SEQ ID NO: 5062 - DNA, 20 bp, Artificial Sequence
  Description of Artificial Sequence:  Hypothetical Probe Sequence
tgcgacggaaagggtatgtc

SEQ ID NO: 5063 - DNA, 20 bp, Artificial Sequence
  Description of Artificial Sequence:  Hypothetical Probe Sequence
tgcgagccctgtttaggatg

SEQ ID NO: 5064 - DNA, 20 bp, Artificial Sequence
  Description of Artificial Sequence:  Hypothetical Probe Sequence
cacggagtgatgagcccttg

SEQ ID NO: 5065 - DNA, 20 bp, Artificial Sequence
  Description of Artificial Sequence:  Hypothetical Probe Sequence
gcaaatactctggagttgcg

SEQ ID NO: 5066 - DNA, 20 bp, Artificial Sequence
  Description of Artificial Sequence:  Hypothetical Probe Sequence
cacgatcggcaaatcgtcgt

SEQ ID NO: 5067 - DNA, 20 bp, Artificial Sequence
  Description of Artificial Sequence:  Hypothetical Probe Sequence
aggaagtggcaacacgcagc

SEQ ID NO: 5068 - DNA, 20 bp, Artificial Sequence
  Description of Artificial Sequence:  Hypothetical Probe Sequence
aggagaccctcacgaatgcg

SEQ ID NO: 5069 - DNA, 20 bp, Artificial Sequence
  Description of Artificial Sequence:  Hypothetical Probe Sequence
cacgcagcgcttgctttctg

SEQ ID NO: 5070 - DNA, 20 bp, Artificial Sequence
  Description of Artificial Sequence:  Hypothetical Probe Sequence
cacgagccggtacgttggta

SEQ ID NO: 5071 - DNA, 20 bp, Artificial Sequence
  Description of Artificial Sequence:  Hypothetical Probe Sequence
cagcatacgtgctcccagga

SEQ ID NO: 5072 - DNA, 20 bp, Artificial Sequence
  Description of Artificial Sequence:  Hypothetical Probe Sequence
cagcgagtccatggacagtg

SEQ ID NO: 5073 - DNA, 20 bp, Artificial Sequence
  Description of Artificial Sequence:  Hypothetical Probe Sequence
cagcgagtggtaatcgtccc

SEQ ID NO: 5074 - DNA, 20 bp, Artificial Sequence
  Description of Artificial Sequence:  Hypothetical Probe Sequence
agtgatcgcttgagcctgcg

SEQ ID NO: 5075 - DNA, 20 bp, Artificial Sequence
  Description of Artificial Sequence:  Hypothetical Probe Sequence
cagccagcaaagcctaagga

SEQ ID NO: 5076 - DNA, 20 bp, Artificial Sequence
  Description of Artificial Sequence:  Hypothetical Probe Sequence
cagccagctacaagccagga

SEQ ID NO: 5077 - DNA, 20 bp, Artificial Sequence
  Description of Artificial Sequence:  Hypothetical Probe Sequence
gcaaacctgtctatcgcgaa

SEQ ID NO: 5078 - DNA, 20 bp, Artificial Sequence
  Description of Artificial Sequence:  Hypothetical Probe Sequence
gatgcgaatacagacccgaa

SEQ ID NO: 5079 - DNA, 20 bp, Artificial Sequence
  Description of Artificial Sequence:  Hypothetical Probe Sequence
gatggagtgatggaccacgg

SEQ ID NO: 5080 - DNA, 20 bp, Artificial Sequence
  Description of Artificial Sequence:  Hypothetical Probe Sequence
tcccgcaagtctggaccgaa

SEQ ID NO: 5081 - DNA, 20 bp, Artificial Sequence
  Description of Artificial Sequence:  Hypothetical Probe Sequence
gtgcgcttcctaacgggatg

SEQ ID NO: 5082 - DNA, 20 bp, Artificial Sequence
  Description of Artificial Sequence:  Hypothetical Probe Sequence
gtgcgcaacgttgcttttag

SEQ ID NO: 5083 - DNA, 20 bp, Artificial Sequence
  Description of Artificial Sequence:  Hypothetical Probe Sequence
aggacctaagccatcgacgg

SEQ ID NO: 5084 - DNA, 20 bp, Artificial Sequence
  Description of Artificial Sequence:  Hypothetical Probe Sequence
cttgaggatgtcgatggcaa

SEQ ID NO: 5085 - DNA, 20 bp, Artificial Sequence
  Description of Artificial Sequence:  Hypothetical Probe Sequence
cagccgttttgagatgccat

SEQ ID NO: 5086 - DNA, 20 bp, Artificial Sequence
  Description of Artificial Sequence:  Hypothetical Probe Sequence
ttgattgaatcgcgtttgcg

SEQ ID NO: 5087 - DNA, 20 bp, Artificial Sequence
  Description of Artificial Sequence:  Hypothetical Probe Sequence
acggctcaggacatacccat

SEQ ID NO: 5088 - DNA, 20 bp, Artificial Sequence
  Description of Artificial Sequence:  Hypothetical Probe Sequence
acggctgtggtactcatcgt

SEQ ID NO: 5089 - DNA, 20 bp, Artificial Sequence
  Description of Artificial Sequence:  Hypothetical Probe Sequence
agtggcttgtctgaccagcc

SEQ ID NO: 5090 - DNA, 20 bp, Artificial Sequence
  Description of Artificial Sequence:  Hypothetical Probe Sequence
atcgtctgtctggacccgaa

SEQ ID NO: 5091 - DNA, 20 bp, Artificial Sequence
  Description of Artificial Sequence:  Hypothetical Probe Sequence
acggaggatgatacctcacg

SEQ ID NO: 5092 - DNA, 20 bp, Artificial Sequence
  Description of Artificial Sequence:  Hypothetical Probe Sequence
agccttagccattctgcgaa

SEQ ID NO: 5093 - DNA, 20 bp, Artificial Sequence
  Description of Artificial Sequence:  Hypothetical Probe Sequence
agcctgtcgcaaataccgtt

SEQ ID NO: 5094 - DNA, 20 bp, Artificial Sequence
  Description of Artificial Sequence:  Hypothetical Probe Sequence
agcctcgtttagtcgttgcg

SEQ ID NO: 5095 - DNA, 20 bp, Artificial Sequence
  Description of Artificial Sequence:  Hypothetical Probe Sequence
agccgtctggactgattctg

SEQ ID NO: 5096 - DNA, 20 bp, Artificial Sequence
  Description of Artificial Sequence:  Hypothetical Probe Sequence
agccgagtttagcctacacg

SEQ ID NO: 5097 - DNA, 20 bp, Artificial Sequence
  Description of Artificial Sequence:  Hypothetical Probe Sequence
tgcgtacactgtccattccc

SEQ ID NO: 5098 - DNA, 20 bp, Artificial Sequence
  Description of Artificial Sequence:  Hypothetical Probe Sequence
agccgaccagccttagggac

SEQ ID NO: 5099 - DNA, 20 bp, Artificial Sequence
  Description of Artificial Sequence:  Hypothetical Probe Sequence
ttgaagccatcggctttccc

SEQ ID NO: 5100 - DNA, 20 bp, Artificial Sequence
  Description of Artificial Sequence:  Hypothetical Probe Sequence
aatccacgtccccgaaacgg

SEQ ID NO: 5101 - DNA, 20 bp, Artificial Sequence
  Description of Artificial Sequence:  Hypothetical Probe Sequence
aaagcgttctcatgcgcgtt

SEQ ID NO: 5102 - DNA, 20 bp, Artificial Sequence
  Description of Artificial Sequence:  Hypothetical Probe Sequence
tcgtcagccacgacggacgg

SEQ ID NO: 5103 - DNA, 20 bp, Artificial Sequence
  Description of Artificial Sequence:  Hypothetical Probe Sequence
tcgtgtgcacggtgcgatcg

SEQ ID NO: 5104 - DNA, 20 bp, Artificial Sequence
  Description of Artificial Sequence:  Hypothetical Probe Sequence
cttgcgaagtgcgtgccgtt

SEQ ID NO: 5105 - DNA, 20 bp, Artificial Sequence
  Description of Artificial Sequence:  Hypothetical Probe Sequence
cgtttccccacgagtgcgtt

SEQ ID NO: 5106 - DNA, 20 bp, Artificial Sequence
  Description of Artificial Sequence:  Hypothetical Probe Sequence
ccatgtgcacggcacgccat

SEQ ID NO: 5107 - DNA, 20 bp, Artificial Sequence
  Description of Artificial Sequence:  Hypothetical Probe Sequence
cgaaacggctcacagccacg

SEQ ID NO: 5108 - DNA, 20 bp, Artificial Sequence
  Description of Artificial Sequence:  Hypothetical Probe Sequence
gctttcccggtatcccggac

SEQ ID NO: 5109 - DNA, 20 bp, Artificial Sequence
  Description of Artificial Sequence:  Hypothetical Probe Sequence
agtgcgaaatcggtgcacct

SEQ ID NO: 5110 - DNA, 20 bp, Artificial Sequence
  Description of Artificial Sequence:  Hypothetical Probe Sequence
acctcagccacgagccagga

SEQ ID NO: 5111 - DNA, 20 bp, Artificial Sequence
  Description of Artificial Sequence:  Hypothetical Probe Sequence
acctagcctgcgtcccgacc

SEQ ID NO: 5112 - DNA, 20 bp, Artificial Sequence
  Description of Artificial Sequence:  Hypothetical Probe Sequence
tcccaaaggcaaagccatcg

SEQ ID NO: 5113 - DNA, 20 bp, Artificial Sequence
  Description of Artificial Sequence:  Hypothetical Probe Sequence
tccctccccctacacgcgtt

SEQ ID NO: 5114 - DNA, 20 bp, Artificial Sequence
  Description of Artificial Sequence:  Hypothetical Probe Sequence
tgcgttgacagcggacgcaa

SEQ ID NO: 5115 - DNA, 20 bp, Artificial Sequence
  Description of Artificial Sequence:  Hypothetical Probe Sequence
tgcgcgaacctagatgcacg

SEQ ID NO: 5116 - DNA, 20 bp, Artificial Sequence
  Description of Artificial Sequence:  Hypothetical Probe Sequence
tgcgggtattagcacggacc

SEQ ID NO: 5117 - DNA, 20 bp, Artificial Sequence
  Description of Artificial Sequence:  Hypothetical Probe Sequence
tgcgagtgacgggtgctccc

SEQ ID NO: 5118 - DNA, 20 bp, Artificial Sequence
  Description of Artificial Sequence:  Hypothetical Probe Sequence
tgcgcctatctgacggcttg

SEQ ID NO: 5119 - DNA, 20 bp, Artificial Sequence
  Description of Artificial Sequence:  Hypothetical Probe Sequence
tgcggatgcagctacatgcg

SEQ ID NO: 5120 - DNA, 20 bp, Artificial Sequence
  Description of Artificial Sequence:  Hypothetical Probe Sequence
cacgcttgcacgatcggtgc

SEQ ID NO: 5121 - DNA, 20 bp, Artificial Sequence
  Description of Artificial Sequence:  Hypothetical Probe Sequence
cacggtgcccatctgttgcg

SEQ ID NO: 5122 - DNA, 20 bp, Artificial Sequence
  Description of Artificial Sequence:  Hypothetical Probe Sequence
cacgacggaaaggcaaatcg

SEQ ID NO: 5123 - DNA, 20 bp, Artificial Sequence
  Description of Artificial Sequence:  Hypothetical Probe Sequence
cagcagccagtggtgctccc

SEQ ID NO: 5124 - DNA, 20 bp, Artificial Sequence
  Description of Artificial Sequence:  Hypothetical Probe Sequence
ttgagacctgcgcagccgaa

SEQ ID NO: 5125 - DNA, 20 bp, Artificial Sequence
  Description of Artificial Sequence:  Hypothetical Probe Sequence
ggacacggtccctgtctgcg

SEQ ID NO: 5126 - DNA, 20 bp, Artificial Sequence
  Description of Artificial Sequence:  Hypothetical Probe Sequence
ttgaacggcttgcttgccat

SEQ ID NO: 5127 - DNA, 20 bp, Artificial Sequence
  Description of Artificial Sequence:  Hypothetical Probe Sequence
acgggagtacggcacgcttg

SEQ ID NO: 5128 - DNA, 20 bp, Artificial Sequence
  Description of Artificial Sequence:  Hypothetical Probe Sequence
agcccttgaggaacggggta

SEQ ID NO: 5129 - DNA, 20 bp, Artificial Sequence
  Description of Artificial Sequence:  Hypothetical Probe Sequence
ttgaagccctcaagccgcaa

SEQ ID NO: 5130 - DNA, 20 bp, Artificial Sequence
  Description of Artificial Sequence:  Hypothetical Probe Sequence
tgattgcggcaacttgcacg

SEQ ID NO: 5131 - DNA, 20 bp, Artificial Sequence
  Description of Artificial Sequence:  Hypothetical Probe Sequence
tctgccatggacacgggtgc

SEQ ID NO: 5132 - DNA, 20 bp, Artificial Sequence
  Description of Artificial Sequence:  Hypothetical Probe Sequence
tctgcagcaggaccattgcg

SEQ ID NO: 5133 - DNA, 20 bp, Artificial Sequence
  Description of Artificial Sequence:  Hypothetical Probe Sequence
tcgtcagccagcgtgcgatg

SEQ ID NO: 5134 - DNA, 20 bp, Artificial Sequence
  Description of Artificial Sequence:  Hypothetical Probe Sequence
cttgccattcccggaccagc

SEQ ID NO: 5135 - DNA, 20 bp, Artificial Sequence
  Description of Artificial Sequence:  Hypothetical Probe Sequence
cgaagcttagcccctatgcg

SEQ ID NO: 5136 - DNA, 20 bp, Artificial Sequence
  Description of Artificial Sequence:  Hypothetical Probe Sequence
ggtatgcgtcgttcgttccc

SEQ ID NO: 5137 - DNA, 20 bp, Artificial Sequence
  Description of Artificial Sequence:  Hypothetical Probe Sequence
gcaagatggatgtcccagcc

SEQ ID NO: 5138 - DNA, 20 bp, Artificial Sequence
  Description of Artificial Sequence:  Hypothetical Probe Sequence
gatggcaacagctcccccat

SEQ ID NO: 5139 - DNA, 20 bp, Artificial Sequence
  Description of Artificial Sequence:  Hypothetical Probe Sequence
gatgacgggacccacgtgcg

SEQ ID NO: 5140 - DNA, 20 bp, Artificial Sequence
  Description of Artificial Sequence:  Hypothetical Probe Sequence
tcccgagtagcccacgtcgt

SEQ ID NO: 5141 - DNA, 20 bp, Artificial Sequence
  Description of Artificial Sequence:  Hypothetical Probe Sequence
tcccgtgcaaagacggacct

SEQ ID NO: 5142 - DNA, 20 bp, Artificial Sequence
  Description of Artificial Sequence:  Hypothetical Probe Sequence
tgcggagtcttgacggggac

SEQ ID NO: 5143 - DNA, 20 bp, Artificial Sequence
  Description of Artificial Sequence:  Hypothetical Probe Sequence
tgcggatgaatcatcgtgcg

SEQ ID NO: 5144 - DNA, 20 bp, Artificial Sequence
  Description of Artificial Sequence:  Hypothetical Probe Sequence
cagcatcgtcccgcaaatcg

SEQ ID NO: 5145 - DNA, 20 bp, Artificial Sequence
  Description of Artificial Sequence:  Hypothetical Probe Sequence
gaccgatgcacgacgggcaa

SEQ ID NO: 5146 - DNA, 20 bp, Artificial Sequence
  Description of Artificial Sequence:  Hypothetical Probe Sequence
tgatgaccgtgcagccggta

SEQ ID NO: 5147 - DNA, 20 bp, Artificial Sequence
  Description of Artificial Sequence:  Hypothetical Probe Sequence
gtgctccctacatccctgcg

SEQ ID NO: 5148 - DNA, 20 bp, Artificial Sequence
  Description of Artificial Sequence:  Hypothetical Probe Sequence
gtgcggacgatgagccggta

SEQ ID NO: 5149 - DNA, 20 bp, Artificial Sequence
  Description of Artificial Sequence:  Hypothetical Probe Sequence
ggacggacatcggaccgctt

SEQ ID NO: 5150 - DNA, 20 bp, Artificial Sequence
  Description of Artificial Sequence:  Hypothetical Probe Sequence
acggtcgtcagccgtttgcg

SEQ ID NO: 5151 - DNA, 20 bp, Artificial Sequence
  Description of Artificial Sequence:  Hypothetical Probe Sequence
acggcttgcacgacggagga

SEQ ID NO: 5152 - DNA, 20 bp, Artificial Sequence
  Description of Artificial Sequence:  Hypothetical Probe Sequence
acggcgttttagcacgtgcg

SEQ ID NO: 5153 - DNA, 20 bp, Artificial Sequence
  Description of Artificial Sequence:  Hypothetical Probe Sequence
acggcctagatgacggcgtt

SEQ ID NO: 5154 - DNA, 20 bp, Artificial Sequence
  Description of Artificial Sequence:  Hypothetical Probe Sequence
cttggcaactcacagcgcaa

SEQ ID NO: 5155 - DNA, 20 bp, Artificial Sequence
  Description of Artificial Sequence:  Hypothetical Probe Sequence
cgttagcctctgcagcgcaa

SEQ ID NO: 5156 - DNA, 20 bp, Artificial Sequence
  Description of Artificial Sequence:  Hypothetical Probe Sequence
ccatagccttgaagccggac

SEQ ID NO: 5157 - DNA, 20 bp, Artificial Sequence
  Description of Artificial Sequence:  Hypothetical Probe Sequence
cgaaacctagccagccccta

SEQ ID NO: 5158 - DNA, 20 bp, Artificial Sequence
  Description of Artificial Sequence:  Hypothetical Probe Sequence
aggatgcgctcatccccgtt

SEQ ID NO: 5159 - DNA, 20 bp, Artificial Sequence
  Description of Artificial Sequence:  Hypothetical Probe Sequence
gatgcgaacacggatgtgcg

SEQ ID NO: 5160 - DNA, 20 bp, Artificial Sequence
  Description of Artificial Sequence:  Hypothetical Probe Sequence
tccccgttcgaagatgcgaa

SEQ ID NO: 5161 - DNA, 20 bp, Artificial Sequence
  Description of Artificial Sequence:  Hypothetical Probe Sequence
tcccatcgacggtgcgggta

SEQ ID NO: 5162 - DNA, 20 bp, Artificial Sequence
  Description of Artificial Sequence:  Hypothetical Probe Sequence
tcccagcccgaaagcccagc

SEQ ID NO: 5163 - DNA, 20 bp, Artificial Sequence
  Description of Artificial Sequence:  Hypothetical Probe Sequence
tgcgcttgtgcggtgcatcg

SEQ ID NO: 5164 - DNA, 20 bp, Artificial Sequence
  Description of Artificial Sequence:  Hypothetical Probe Sequence
cagccctatctgcagcgacc

SEQ ID NO: 5165 - DNA, 20 bp, Artificial Sequence
  Description of Artificial Sequence:  Hypothetical Probe Sequence
cagcacggtacacacggctt

SEQ ID NO: 5166 - DNA, 20 bp, Artificial Sequence
  Description of Artificial Sequence:  Hypothetical Probe Sequence
gaccgatggcttcacgtgcg

SEQ ID NO: 5167 - DNA, 20 bp, Artificial Sequence
  Description of Artificial Sequence:  Hypothetical Probe Sequence
gtgcgaccgtgccgtttgat

SEQ ID NO: 5168 - DNA, 20 bp, Artificial Sequence
  Description of Artificial Sequence:  Hypothetical Probe Sequence
ggacatcgcctaagcccgaa

SEQ ID NO: 5169 - DNA, 20 bp, Artificial Sequence
  Description of Artificial Sequence:  Hypothetical Probe Sequence
ggaccctatccccgaatccc

SEQ ID NO: 5170 - DNA, 20 bp, Artificial Sequence
  Description of Artificial Sequence:  Hypothetical Probe Sequence
ggactccctctgacggcagc

SEQ ID NO: 5171 - DNA, 20 bp, Artificial Sequence
  Description of Artificial Sequence:  Hypothetical Probe Sequence
ggaccacgtcgtatcgagcc

SEQ ID NO: 5172 - DNA, 20 bp, Artificial Sequence
  Description of Artificial Sequence:  Hypothetical Probe Sequence
acggatcgatcgagccggac

SEQ ID NO: 5173 - DNA, 20 bp, Artificial Sequence
  Description of Artificial Sequence:  Hypothetical Probe Sequence
acggaggaacggcacggcaa

SEQ ID NO: 5174 - DNA, 20 bp, Artificial Sequence
  Description of Artificial Sequence:  Hypothetical Probe Sequence
agccgcaagagtgtgccacg

SEQ ID NO: 5175 - DNA, 20 bp, Artificial Sequence
  Description of Artificial Sequence:  Hypothetical Probe Sequence
aaagcgtttcccagcccttg

SEQ ID NO: 5176 - DNA, 20 bp, Artificial Sequence
  Description of Artificial Sequence:  Hypothetical Probe Sequence
cgttgcaactgtagcccacg

SEQ ID NO: 5177 - DNA, 20 bp, Artificial Sequence
  Description of Artificial Sequence:  Hypothetical Probe Sequence
ctcaacggtcccatacacgg

SEQ ID NO: 5178 - DNA, 20 bp, Artificial Sequence
  Description of Artificial Sequence:  Hypothetical Probe Sequence
cgaaaatcagcctgcgcgtt

SEQ ID NO: 5179 - DNA, 20 bp, Artificial Sequence
  Description of Artificial Sequence:  Hypothetical Probe Sequence
cgaaaaaggatgcgaatgcg

SEQ ID NO: 5180 - DNA, 20 bp, Artificial Sequence
  Description of Artificial Sequence:  Hypothetical Probe Sequence
cgaactcaacgggcaagtgc

SEQ ID NO: 5181 - DNA, 20 bp, Artificial Sequence
  Description of Artificial Sequence:  Hypothetical Probe Sequence
cgaaagtgcacgcacggtgc

SEQ ID NO: 5182 - DNA, 20 bp, Artificial Sequence
  Description of Artificial Sequence:  Hypothetical Probe Sequence
ggtagcaaaaagggacgcaa

SEQ ID NO: 5183 - DNA, 20 bp, Artificial Sequence
  Description of Artificial Sequence:  Hypothetical Probe Sequence
cctatgcgtgtcatcggctt

SEQ ID NO: 5184 - DNA, 20 bp, Artificial Sequence
  Description of Artificial Sequence:  Hypothetical Probe Sequence
tcccgtctcgaagacccgaa

SEQ ID NO: 5185 - DNA, 20 bp, Artificial Sequence
  Description of Artificial Sequence:  Hypothetical Probe Sequence
tgcggctttacaggacgctt

SEQ ID NO: 5186 - DNA, 20 bp, Artificial Sequence
  Description of Artificial Sequence:  Hypothetical Probe Sequence
tgcgaggagacctcccacgg

SEQ ID NO: 5187 - DNA, 20 bp, Artificial Sequence
  Description of Artificial Sequence:  Hypothetical Probe Sequence
tgcggaccggtatcccacct

SEQ ID NO: 5188 - DNA, 20 bp, Artificial Sequence
  Description of Artificial Sequence:  Hypothetical Probe Sequence
tgcggtgctctgacggtcgt

SEQ ID NO: 5189 - DNA, 20 bp, Artificial Sequence
  Description of Artificial Sequence:  Hypothetical Probe Sequence
cacgtcgtacgggcaacagc

SEQ ID NO: 5190 - DNA, 20 bp, Artificial Sequence
  Description of Artificial Sequence:  Hypothetical Probe Sequence
cagccttgcttgggacggac

SEQ ID NO: 5191 - DNA, 20 bp, Artificial Sequence
  Description of Artificial Sequence:  Hypothetical Probe Sequence
cagccctaaggaggacagcc

SEQ ID NO: 5192 - DNA, 20 bp, Artificial Sequence
  Description of Artificial Sequence:  Hypothetical Probe Sequence
aatccagctgcgcgttcgaa

SEQ ID NO: 5193 - DNA, 20 bp, Artificial Sequence
  Description of Artificial Sequence:  Hypothetical Probe Sequence
cagcacgggtctagccgatg

SEQ ID NO: 5194 - DNA, 20 bp, Artificial Sequence
  Description of Artificial Sequence:  Hypothetical Probe Sequence
gaccaatcgcttgaccgcaa

SEQ ID NO: 5195 - DNA, 20 bp, Artificial Sequence
  Description of Artificial Sequence:  Hypothetical Probe Sequence
gaccccatcgttagtgtgcg

SEQ ID NO: 5196 - DNA, 20 bp, Artificial Sequence
  Description of Artificial Sequence:  Hypothetical Probe Sequence
gacccctaacggaaagcgtt

SEQ ID NO: 5197 - DNA, 20 bp, Artificial Sequence
  Description of Artificial Sequence:  Hypothetical Probe Sequence
gaccgatgccattcgtcgaa

SEQ ID NO: 5198 - DNA, 20 bp, Artificial Sequence
  Description of Artificial Sequence:  Hypothetical Probe Sequence
gaccggacaggatgattgcg

SEQ ID NO: 5199 - DNA, 20 bp, Artificial Sequence
  Description of Artificial Sequence:  Hypothetical Probe Sequence
gtgcctcaataccagcacgg

SEQ ID NO: 5200 - DNA, 20 bp, Artificial Sequence
  Description of Artificial Sequence:  Hypothetical Probe Sequence
gtgcgatgcagcgtctgcaa

SEQ ID NO: 5201 - DNA, 20 bp, Artificial Sequence
  Description of Artificial Sequence:  Hypothetical Probe Sequence
ggacagccaggaatcgatcg

SEQ ID NO: 5202 - DNA, 20 bp, Artificial Sequence
  Description of Artificial Sequence:  Hypothetical Probe Sequence
acggctcactcatcccctca

SEQ ID NO: 5203 - DNA, 20 bp, Artificial Sequence
  Description of Artificial Sequence:  Hypothetical Probe Sequence
acggacctctcaagccgacc

SEQ ID NO: 5204 - DNA, 20 bp, Artificial Sequence
  Description of Artificial Sequence:  Hypothetical Probe Sequence
acgggatgcgaacgaagtgc

SEQ ID NO: 5205 - DNA, 20 bp, Artificial Sequence
  Description of Artificial Sequence:  Hypothetical Probe Sequence
agcccgttaaagtgcggatg

SEQ ID NO: 5206 - DNA, 20 bp, Artificial Sequence
  Description of Artificial Sequence:  Hypothetical Probe Sequence
agccctcaatcgcagcagcc

SEQ ID NO: 5207 - DNA, 20 bp, Artificial Sequence
  Description of Artificial Sequence:  Hypothetical Probe Sequence
agccggtaccatagcctgcg

SEQ ID NO: 5208 - DNA, 20 bp, Artificial Sequence
  Description of Artificial Sequence:  Hypothetical Probe Sequence
agccaggatgtccctatgcg

SEQ ID NO: 5209 - DNA, 20 bp, Artificial Sequence
  Description of Artificial Sequence:  Hypothetical Probe Sequence
ccatcgaaggactgcgcagc

SEQ ID NO: 5210 - DNA, 20 bp, Artificial Sequence
  Description of Artificial Sequence:  Hypothetical Probe Sequence
gcaaacggctcatcccggta

SEQ ID NO: 5211 - DNA, 20 bp, Artificial Sequence
  Description of Artificial Sequence:  Hypothetical Probe Sequence
cctaacggcagctgcgctgt

SEQ ID NO: 5212 - DNA, 20 bp, Artificial Sequence
  Description of Artificial Sequence:  Hypothetical Probe Sequence
gatgacggcagctcccgcaa

SEQ ID NO: 5213 - DNA, 20 bp, Artificial Sequence
  Description of Artificial Sequence:  Hypothetical Probe Sequence
tgcgctgttccccacgagcc

SEQ ID NO: 5214 - DNA, 20 bp, Artificial Sequence
  Description of Artificial Sequence:  Hypothetical Probe Sequence
tgcgcgaattaggcaaagcc

SEQ ID NO: 5215 - DNA, 20 bp, Artificial Sequence
  Description of Artificial Sequence:  Hypothetical Probe Sequence
cacgatcgtccccgaacgaa

SEQ ID NO: 5216 - DNA, 20 bp, Artificial Sequence
  Description of Artificial Sequence:  Hypothetical Probe Sequence
cagcggaccctaagccagcc

SEQ ID NO: 5217 - DNA, 20 bp, Artificial Sequence
  Description of Artificial Sequence:  Hypothetical Probe Sequence
gaccgagttgcgtcccgatg

SEQ ID NO: 5218 - DNA, 20 bp, Artificial Sequence
  Description of Artificial Sequence:  Hypothetical Probe Sequence
gtgctgcgggtaccatggac

SEQ ID NO: 5219 - DNA, 20 bp, Artificial Sequence
  Description of Artificial Sequence:  Hypothetical Probe Sequence
gtgccacgatcgcttgtccc

SEQ ID NO: 5220 - DNA, 20 bp, Artificial Sequence
  Description of Artificial Sequence:  Hypothetical Probe Sequence
ggacgacctgtcggacgcaa

SEQ ID NO: 5221 - DNA, 20 bp, Artificial Sequence
  Description of Artificial Sequence:  Hypothetical Probe Sequence
acggcctaacggtgtccgtt

SEQ ID NO: 5222 - DNA, 20 bp, Artificial Sequence
  Description of Artificial Sequence:  Hypothetical Probe Sequence
acggtccccgttggaccagc

SEQ ID NO: 5223 - DNA, 20 bp, Artificial Sequence
  Description of Artificial Sequence:  Hypothetical Probe Sequence
agcccgaacagctccctcgt

SEQ ID NO: 5224 - DNA, 20 bp, Artificial Sequence
  Description of Artificial Sequence:  Hypothetical Probe Sequence
tcgtagccatcgcacgcagc

SEQ ID NO: 5225 - DNA, 20 bp, Artificial Sequence
  Description of Artificial Sequence:  Hypothetical Probe Sequence
cgttttgacgttagcctgcg

SEQ ID NO: 5226 - DNA, 20 bp, Artificial Sequence
  Description of Artificial Sequence:  Hypothetical Probe Sequence
aaagcgttatcgtcccgacc

SEQ ID NO: 5227 - DNA, 20 bp, Artificial Sequence
  Description of Artificial Sequence:  Hypothetical Probe Sequence
cgttgaccgatgacggccat

SEQ ID NO: 5228 - DNA, 20 bp, Artificial Sequence
  Description of Artificial Sequence:  Hypothetical Probe Sequence
aaagccatgctttccctccc

SEQ ID NO: 5229 - DNA, 20 bp, Artificial Sequence
  Description of Artificial Sequence:  Hypothetical Probe Sequence
cgaatcgttcgtcttgcacg

SEQ ID NO: 5230 - DNA, 20 bp, Artificial Sequence
  Description of Artificial Sequence:  Hypothetical Probe Sequence
cgaacgaagatgccatcagc

SEQ ID NO: 5231 - DNA, 20 bp, Artificial Sequence
  Description of Artificial Sequence:  Hypothetical Probe Sequence
cgaacagcgacccctacagc

SEQ ID NO: 5232 - DNA, 20 bp, Artificial Sequence
  Description of Artificial Sequence:  Hypothetical Probe Sequence
gcttatcgtgcgtcgtgctt

SEQ ID NO: 5233 - DNA, 20 bp, Artificial Sequence
  Description of Artificial Sequence:  Hypothetical Probe Sequence
gcaaaaagtgtccagcggac

SEQ ID NO: 5234 - DNA, 20 bp, Artificial Sequence
  Description of Artificial Sequence:  Hypothetical Probe Sequence
gcaatcgttgtcggtatgcg

SEQ ID NO: 5235 - DNA, 20 bp, Artificial Sequence
  Description of Artificial Sequence:  Hypothetical Probe Sequence
gcaaagtgcgaacacggcaa

SEQ ID NO: 5236 - DNA, 20 bp, Artificial Sequence
  Description of Artificial Sequence:  Hypothetical Probe Sequence
aaaggcaacagcgcaagcaa

SEQ ID NO: 5237 - DNA, 20 bp, Artificial Sequence
  Description of Artificial Sequence:  Hypothetical Probe Sequence
atcggcaaaaagtccccgaa

SEQ ID NO: 5238 - DNA, 20 bp, Artificial Sequence
  Description of Artificial Sequence:  Hypothetical Probe Sequence
atcgcagcgcttgatgtgcg

SEQ ID NO: 5239 - DNA, 20 bp, Artificial Sequence
  Description of Artificial Sequence:  Hypothetical Probe Sequence
gatgctcaagcccagcacgg

SEQ ID NO: 5240 - DNA, 20 bp, Artificial Sequence
  Description of Artificial Sequence:  Hypothetical Probe Sequence
aaagtcccgagttgcgtgcg

SEQ ID NO: 5241 - DNA, 20 bp, Artificial Sequence
  Description of Artificial Sequence:  Hypothetical Probe Sequence
tgcgagccatcgacctacgg

SEQ ID NO: 5242 - DNA, 20 bp, Artificial Sequence
  Description of Artificial Sequence:  Hypothetical Probe Sequence
cacggcttggtagtgcgacc

SEQ ID NO: 5243 - DNA, 20 bp, Artificial Sequence
  Description of Artificial Sequence:  Hypothetical Probe Sequence
cacggcaatgatcacggacc

SEQ ID NO: 5244 - DNA, 20 bp, Artificial Sequence
  Description of Artificial Sequence:  Hypothetical Probe Sequence
cacgagtgggacgtgcatcg

SEQ ID NO: 5245 - DNA, 20 bp, Artificial Sequence
  Description of Artificial Sequence:  Hypothetical Probe Sequence
cagcgcttggtaatcgggta

SEQ ID NO: 5246 - DNA, 20 bp, Artificial Sequence
  Description of Artificial Sequence:  Hypothetical Probe Sequence
gaccggtaaaagcgaagcaa

SEQ ID NO: 5247 - DNA, 20 bp, Artificial Sequence
  Description of Artificial Sequence:  Hypothetical Probe Sequence
gtgctcgtcagcagtgcgtt

SEQ ID NO: 5248 - DNA, 20 bp, Artificial Sequence
  Description of Artificial Sequence:  Hypothetical Probe Sequence
gtgccttggtgcgatgccta

SEQ ID NO: 5249 - DNA, 20 bp, Artificial Sequence
  Description of Artificial Sequence:  Hypothetical Probe Sequence
gtgcctcatgtcacgggtgc

SEQ ID NO: 5250 - DNA, 20 bp, Artificial Sequence
  Description of Artificial Sequence:  Hypothetical Probe Sequence
aaaggtgccgaaatcgggac

SEQ ID NO: 5251 - DNA, 20 bp, Artificial Sequence
  Description of Artificial Sequence:  Hypothetical Probe Sequence
gtgccagcggtaggaccagc

SEQ ID NO: 5252 - DNA, 20 bp, Artificial Sequence
  Description of Artificial Sequence:  Hypothetical Probe Sequence
ggacttgaacgggcttgcaa

SEQ ID NO: 5253 - DNA, 20 bp, Artificial Sequence
  Description of Artificial Sequence:  Hypothetical Probe Sequence
ggacctcagcaaagccccat

SEQ ID NO: 5254 - DNA, 20 bp, Artificial Sequence
  Description of Artificial Sequence:  Hypothetical Probe Sequence
ggacccatgcttccatgacc

SEQ ID NO: 5255 - DNA, 20 bp, Artificial Sequence
  Description of Artificial Sequence:  Hypothetical Probe Sequence
acggtctggcttacgggtgc

SEQ ID NO: 5256 - DNA, 20 bp, Artificial Sequence
  Description of Artificial Sequence:  Hypothetical Probe Sequence
acggcgttgtgcaaagtccc

SEQ ID NO: 5257 - DNA, 20 bp, Artificial Sequence
  Description of Artificial Sequence:  Hypothetical Probe Sequence
acggatcgcacgcctagcaa

SEQ ID NO: 5258 - DNA, 20 bp, Artificial Sequence
  Description of Artificial Sequence:  Hypothetical Probe Sequence
agccgagtggacatcgtgcg

SEQ ID NO: 5259 - DNA, 20 bp, Artificial Sequence
  Description of Artificial Sequence:  Hypothetical Probe Sequence
agccagtgacggccatcacg

SEQ ID NO: 5260 - DNA, 20 bp, Artificial Sequence
  Description of Artificial Sequence:  Hypothetical Probe Sequence
tccccgaaggtaacggcagc

SEQ ID NO: 5261 - DNA, 20 bp, Artificial Sequence
  Description of Artificial Sequence:  Hypothetical Probe Sequence
tcccatcggagttcccgacc

SEQ ID NO: 5262 - DNA, 20 bp, Artificial Sequence
  Description of Artificial Sequence:  Hypothetical Probe Sequence
tgcgggacgagtgacccacg

SEQ ID NO: 5263 - DNA, 20 bp, Artificial Sequence
  Description of Artificial Sequence:  Hypothetical Probe Sequence
cagctgcgtacatgcgccat

SEQ ID NO: 5264 - DNA, 20 bp, Artificial Sequence
  Description of Artificial Sequence:  Hypothetical Probe Sequence
gaccgcaacgaaagcctccc

SEQ ID NO: 5265 - DNA, 20 bp, Artificial Sequence
  Description of Artificial Sequence:  Hypothetical Probe Sequence
gtgcacgggcaagaccgtgc

SEQ ID NO: 5266 - DNA, 20 bp, Artificial Sequence
  Description of Artificial Sequence:  Hypothetical Probe Sequence
acggtcgtatcgcttgccat

SEQ ID NO: 5267 - DNA, 20 bp, Artificial Sequence
  Description of Artificial Sequence:  Hypothetical Probe Sequence
acggcttgctcagaccgcaa

SEQ ID NO: 5268 - DNA, 20 bp, Artificial Sequence
  Description of Artificial Sequence:  Hypothetical Probe Sequence
acgggagttgcgcagcctca

SEQ ID NO: 5269 - DNA, 20 bp, Artificial Sequence
  Description of Artificial Sequence:  Hypothetical Probe Sequence
acggacctgatgcagcgcaa

SEQ ID NO: 5270 - DNA, 20 bp, Artificial Sequence
  Description of Artificial Sequence:  Hypothetical Probe Sequence
tacaacggcacgtgcgacct

SEQ ID NO: 5271 - DNA, 20 bp, Artificial Sequence
  Description of Artificial Sequence:  Hypothetical Probe Sequence
agccgcaagtcttgcgttga

SEQ ID NO: 5272 - DNA, 20 bp, Artificial Sequence
  Description of Artificial Sequence:  Hypothetical Probe Sequence
agccatcgcagccttggcaa

SEQ ID NO: 5273 - DNA, 20 bp, Artificial Sequence
  Description of Artificial Sequence:  Hypothetical Probe Sequence
tctgcgtttgcggcaaagcc

SEQ ID NO: 5274 - DNA, 20 bp, Artificial Sequence
  Description of Artificial Sequence:  Hypothetical Probe Sequence
tctgcgaatgcggaccgtct

SEQ ID NO: 5275 - DNA, 20 bp, Artificial Sequence
  Description of Artificial Sequence:  Hypothetical Probe Sequence
tctgtcgtgcttgaccagcc

SEQ ID NO: 5276 - DNA, 20 bp, Artificial Sequence
  Description of Artificial Sequence:  Hypothetical Probe Sequence
cttgcgttgctttgtccgtt

SEQ ID NO: 5277 - DNA, 20 bp, Artificial Sequence
  Description of Artificial Sequence:  Hypothetical Probe Sequence
cgttttgagtgcagcccagc

SEQ ID NO: 5278 - DNA, 20 bp, Artificial Sequence
  Description of Artificial Sequence:  Hypothetical Probe Sequence
tctgcgttcgttcttgcgaa

SEQ ID NO: 5279 - DNA, 20 bp, Artificial Sequence
  Description of Artificial Sequence:  Hypothetical Probe Sequence
cgttgatgaggacagctgcg

SEQ ID NO: 5280 - DNA, 20 bp, Artificial Sequence
  Description of Artificial Sequence:  Hypothetical Probe Sequence
ctcagcaaacctgtgcacgg

SEQ ID NO: 5281 - DNA, 20 bp, Artificial Sequence
  Description of Artificial Sequence:  Hypothetical Probe Sequence
ctcacagcacgggtgcgatg

SEQ ID NO: 5282 - DNA, 20 bp, Artificial Sequence
  Description of Artificial Sequence:  Hypothetical Probe Sequence
ctgtcacggacccagccgtt

SEQ ID NO: 5283 - DNA, 20 bp, Artificial Sequence
  Description of Artificial Sequence:  Hypothetical Probe Sequence
tctgccatcgaaagtggtgc

SEQ ID NO: 5284 - DNA, 20 bp, Artificial Sequence
  Description of Artificial Sequence:  Hypothetical Probe Sequence
ccatggtacgtttgcggacc

SEQ ID NO: 5285 - DNA, 20 bp, Artificial Sequence
  Description of Artificial Sequence:  Hypothetical Probe Sequence
ccattcccatcgtctgcacg

SEQ ID NO: 5286 - DNA, 20 bp, Artificial Sequence
  Description of Artificial Sequence:  Hypothetical Probe Sequence
cgaatctgcgtttgattgcg

SEQ ID NO: 5287 - DNA, 20 bp, Artificial Sequence
  Description of Artificial Sequence:  Hypothetical Probe Sequence
cgaaagtgacggagcccgtt

SEQ ID NO: 5288 - DNA, 20 bp, Artificial Sequence
  Description of Artificial Sequence:  Hypothetical Probe Sequence
cgaagtgccttgtcgttccc

SEQ ID NO: 5289 - DNA, 20 bp, Artificial Sequence
  Description of Artificial Sequence:  Hypothetical Probe Sequence
tctggcttaggaacgggctt

SEQ ID NO: 5290 - DNA, 20 bp, Artificial Sequence
  Description of Artificial Sequence:  Hypothetical Probe Sequence
gctttgcgaatccttggctt

SEQ ID NO: 5291 - DNA, 20 bp, Artificial Sequence
  Description of Artificial Sequence:  Hypothetical Probe Sequence
tctggcttgaccgacccgaa

SEQ ID NO: 5292 - DNA, 20 bp, Artificial Sequence
  Description of Artificial Sequence:  Hypothetical Probe Sequence
ggtatccccgaatgtccacg

SEQ ID NO: 5293 - DNA, 20 bp, Artificial Sequence
  Description of Artificial Sequence:  Hypothetical Probe Sequence
gcaatgatatcgcacggtgc

SEQ ID NO: 5294 - DNA, 20 bp, Artificial Sequence
  Description of Artificial Sequence:  Hypothetical Probe Sequence
tctggcaaaaaggctttccc

SEQ ID NO: 5295 - DNA, 20 bp, Artificial Sequence
  Description of Artificial Sequence:  Hypothetical Probe Sequence
gcaactgtcagcgcttcgaa

SEQ ID NO: 5296 - DNA, 20 bp, Artificial Sequence
  Description of Artificial Sequence:  Hypothetical Probe Sequence
gcaaggtatctgcagccagc

SEQ ID NO: 5297 - DNA, 20 bp, Artificial Sequence
  Description of Artificial Sequence:  Hypothetical Probe Sequence
agtggcaatccctccctgcg

SEQ ID NO: 5298 - DNA, 20 bp, Artificial Sequence
  Description of Artificial Sequence:  Hypothetical Probe Sequence
atcggtgctgcgaatcgtgc

SEQ ID NO: 5299 - DNA, 20 bp, Artificial Sequence
  Description of Artificial Sequence:  Hypothetical Probe Sequence
cctacagccgaatcccgctt

SEQ ID NO: 5300 - DNA, 20 bp, Artificial Sequence
  Description of Artificial Sequence:  Hypothetical Probe Sequence
tctggatgccatgtgccgaa

SEQ ID NO: 5301 - DNA, 20 bp, Artificial Sequence
  Description of Artificial Sequence:  Hypothetical Probe Sequence
tctggatgcgaaaaagtgcg

SEQ ID NO: 5302 - DNA, 20 bp, Artificial Sequence
  Description of Artificial Sequence:  Hypothetical Probe Sequence
tctggatgggacggtatgcg

SEQ ID NO: 5303 - DNA, 20 bp, Artificial Sequence
  Description of Artificial Sequence:  Hypothetical Probe Sequence
tcccccattcgtgatggtgc

SEQ ID NO: 5304 - DNA, 20 bp, Artificial Sequence
  Description of Artificial Sequence:  Hypothetical Probe Sequence
tcccgctttctggatgtgcg

SEQ ID NO: 5305 - DNA, 20 bp, Artificial Sequence
  Description of Artificial Sequence:  Hypothetical Probe Sequence
tcccggtaccatatcgcgaa

SEQ ID NO: 5306 - DNA, 20 bp, Artificial Sequence
  Description of Artificial Sequence:  Hypothetical Probe Sequence
tcccgagtggacgcaaccat

SEQ ID NO: 5307 - DNA, 20 bp, Artificial Sequence
  Description of Artificial Sequence:  Hypothetical Probe Sequence
tcccagcccctatcccacct

SEQ ID NO: 5308 - DNA, 20 bp, Artificial Sequence
  Description of Artificial Sequence:  Hypothetical Probe Sequence
tgcgtctgtccccgaagcaa

SEQ ID NO: 5309 - DNA, 20 bp, Artificial Sequence
  Description of Artificial Sequence:  Hypothetical Probe Sequence
tgcgtgcggatgacctacgg

SEQ ID NO: 5310 - DNA, 20 bp, Artificial Sequence
  Description of Artificial Sequence:  Hypothetical Probe Sequence
tgcggacctcgttgatcacg

SEQ ID NO: 5311 - DNA, 20 bp, Artificial Sequence
  Description of Artificial Sequence:  Hypothetical Probe Sequence
tctgcacgcttgttagcagc

SEQ ID NO: 5312 - DNA, 20 bp, Artificial Sequence
  Description of Artificial Sequence:  Hypothetical Probe Sequence
tctgcacgccatgtgccgtt

SEQ ID NO: 5313 - DNA, 20 bp, Artificial Sequence
  Description of Artificial Sequence:  Hypothetical Probe Sequence
cacggagttgtcggacgtgc

SEQ ID NO: 5314 - DNA, 20 bp, Artificial Sequence
  Description of Artificial Sequence:  Hypothetical Probe Sequence
tctgcacgcctaagccctgt

SEQ ID NO: 5315 - DNA, 20 bp, Artificial Sequence
  Description of Artificial Sequence:  Hypothetical Probe Sequence
cacggatgacggacctcgaa

SEQ ID NO: 5316 - DNA, 20 bp, Artificial Sequence
  Description of Artificial Sequence:  Hypothetical Probe Sequence
cagcctgtggtacacgcgtt

SEQ ID NO: 5317 - DNA, 20 bp, Artificial Sequence
  Description of Artificial Sequence:  Hypothetical Probe Sequence
cagccgaagcttgcaaacgg

SEQ ID NO: 5318 - DNA, 20 bp, Artificial Sequence
  Description of Artificial Sequence:  Hypothetical Probe Sequence
tctgcagcgtgcgcaaagcc

SEQ ID NO: 5319 - DNA, 20 bp, Artificial Sequence
  Description of Artificial Sequence:  Hypothetical Probe Sequence
tctggacctgcgccatctca

SEQ ID NO: 5320 - DNA, 20 bp, Artificial Sequence
  Description of Artificial Sequence:  Hypothetical Probe Sequence
gacccacggacctgtccagc

SEQ ID NO: 5321 - DNA, 20 bp, Artificial Sequence
  Description of Artificial Sequence:  Hypothetical Probe Sequence
tctggaccgaccagtgcgtt

SEQ ID NO: 5322 - DNA, 20 bp, Artificial Sequence
  Description of Artificial Sequence:  Hypothetical Probe Sequence
gtgctcgtctgtgtgcacgg

SEQ ID NO: 5323 - DNA, 20 bp, Artificial Sequence
  Description of Artificial Sequence:  Hypothetical Probe Sequence
tctggtgcggtacagcctca

SEQ ID NO: 5324 - DNA, 20 bp, Artificial Sequence
  Description of Artificial Sequence:  Hypothetical Probe Sequence
gtgcatcgggacatcggtgc

SEQ ID NO: 5325 - DNA, 20 bp, Artificial Sequence
  Description of Artificial Sequence:  Hypothetical Probe Sequence
ggaccgttgtctagcccgtt

SEQ ID NO: 5326 - DNA, 20 bp, Artificial Sequence
  Description of Artificial Sequence:  Hypothetical Probe Sequence
ggaccctaatcgacggcgtt

SEQ ID NO: 5327 - DNA, 20 bp, Artificial Sequence
  Description of Artificial Sequence:  Hypothetical Probe Sequence
acgggagtgcaacacggacc

SEQ ID NO: 5328 - DNA, 20 bp, Artificial Sequence
  Description of Artificial Sequence:  Hypothetical Probe Sequence
acgggcaacttgatcgctca

SEQ ID NO: 5329 - DNA, 20 bp, Artificial Sequence
  Description of Artificial Sequence:  Hypothetical Probe Sequence
acgggatgacctagccgatg

SEQ ID NO: 5330 - DNA, 20 bp, Artificial Sequence
  Description of Artificial Sequence:  Hypothetical Probe Sequence
acggacgggcttagtgtgcg

SEQ ID NO: 5331 - DNA, 20 bp, Artificial Sequence
  Description of Artificial Sequence:  Hypothetical Probe Sequence
agccaaaggtgcccatcgtt

SEQ ID NO: 5332 - DNA, 20 bp, Artificial Sequence
  Description of Artificial Sequence:  Hypothetical Probe Sequence
tctgagccgcaaggtaacgg

SEQ ID NO: 5333 - DNA, 20 bp, Artificial Sequence
  Description of Artificial Sequence:  Hypothetical Probe Sequence
ttgaagccccattgcgccta

SEQ ID NO: 5334 - DNA, 20 bp, Artificial Sequence
  Description of Artificial Sequence:  Hypothetical Probe Sequence
aatccagcgtgctgcgtgcg

SEQ ID NO: 5335 - DNA, 20 bp, Artificial Sequence
  Description of Artificial Sequence:  Hypothetical Probe Sequence
aatcacggagcccacgggac

SEQ ID NO: 5336 - DNA, 20 bp, Artificial Sequence
  Description of Artificial Sequence:  Hypothetical Probe Sequence
aatcagccagcccagctccc

SEQ ID NO: 5337 - DNA, 20 bp, Artificial Sequence
  Description of Artificial Sequence:  Hypothetical Probe Sequence
aaagccatacggcagcgatg

SEQ ID NO: 5338 - DNA, 20 bp, Artificial Sequence
  Description of Artificial Sequence:  Hypothetical Probe Sequence
aaagcagccacgtgattgcg

SEQ ID NO: 5339 - DNA, 20 bp, Artificial Sequence
  Description of Artificial Sequence:  Hypothetical Probe Sequence
tgtccgaaggaccagctccc

SEQ ID NO: 5340 - DNA, 20 bp, Artificial Sequence
  Description of Artificial Sequence:  Hypothetical Probe Sequence
tgtcgcaaagccaaagtccc

SEQ ID NO: 5341 - DNA, 20 bp, Artificial Sequence
  Description of Artificial Sequence:  Hypothetical Probe Sequence
tcgtcacgtgcggacctgcg

SEQ ID NO: 5342 - DNA, 20 bp, Artificial Sequence
  Description of Artificial Sequence:  Hypothetical Probe Sequence
tcgtacggcgttttgatgcg

SEQ ID NO: 5343 - DNA, 20 bp, Artificial Sequence
  Description of Artificial Sequence:  Hypothetical Probe Sequence
cttgctcaatcggtgcgtgc

SEQ ID NO: 5344 - DNA, 20 bp, Artificial Sequence
  Description of Artificial Sequence:  Hypothetical Probe Sequence
cttgcacgttaggacccgaa

SEQ ID NO: 5345 - DNA, 20 bp, Artificial Sequence
  Description of Artificial Sequence:  Hypothetical Probe Sequence
tgtccttggacccgaagtgc

SEQ ID NO: 5346 - DNA, 20 bp, Artificial Sequence
  Description of Artificial Sequence:  Hypothetical Probe Sequence
cgttaccttcccgaccgacc

SEQ ID NO: 5347 - DNA, 20 bp, Artificial Sequence
  Description of Artificial Sequence:  Hypothetical Probe Sequence
ctcagcaatgtcggacagcc

SEQ ID NO: 5348 - DNA, 20 bp, Artificial Sequence
  Description of Artificial Sequence:  Hypothetical Probe Sequence
ctcatcccacctcacgagcc

SEQ ID NO: 5349 - DNA, 20 bp, Artificial Sequence
  Description of Artificial Sequence:  Hypothetical Probe Sequence
ctgtacggaatcagccgacc

SEQ ID NO: 5350 - DNA, 20 bp, Artificial Sequence
  Description of Artificial Sequence:  Hypothetical Probe Sequence
ccatcttggacccagcacgg

SEQ ID NO: 5351 - DNA, 20 bp, Artificial Sequence
  Description of Artificial Sequence:  Hypothetical Probe Sequence
tgtcccatcgaaaatccgaa

SEQ ID NO: 5352 - DNA, 20 bp, Artificial Sequence
  Description of Artificial Sequence:  Hypothetical Probe Sequence
ccatgcaaaggaaggagcaa

SEQ ID NO: 5353 - DNA, 20 bp, Artificial Sequence
  Description of Artificial Sequence:  Hypothetical Probe Sequence
ccatcctacgttgtgcgcaa

SEQ ID NO: 5354 - DNA, 20 bp, Artificial Sequence
  Description of Artificial Sequence:  Hypothetical Probe Sequence
ccatgatggcaagtgccagc

SEQ ID NO: 5355 - DNA, 20 bp, Artificial Sequence
  Description of Artificial Sequence:  Hypothetical Probe Sequence
tgtcccatcagcacgggatg

SEQ ID NO: 5356 - DNA, 20 bp, Artificial Sequence
  Description of Artificial Sequence:  Hypothetical Probe Sequence
ccatagccatactgcggtgc

SEQ ID NO: 5357 - DNA, 20 bp, Artificial Sequence
  Description of Artificial Sequence:  Hypothetical Probe Sequence
cgaacgttgcttggacgatg

SEQ ID NO: 5358 - DNA, 20 bp, Artificial Sequence
  Description of Artificial Sequence:  Hypothetical Probe Sequence
cgaagcttcttgggacggta

SEQ ID NO: 5359 - DNA, 20 bp, Artificial Sequence
  Description of Artificial Sequence:  Hypothetical Probe Sequence
tgtccgaaacctcgaatgcg

SEQ ID NO: 5360 - DNA, 20 bp, Artificial Sequence
  Description of Artificial Sequence:  Hypothetical Probe Sequence
cgaaaggaaggaggacgcaa

SEQ ID NO: 5361 - DNA, 20 bp, Artificial Sequence
  Description of Artificial Sequence:  Hypothetical Probe Sequence
cgaacctactcatccccacg

SEQ ID NO: 5362 - DNA, 20 bp, Artificial Sequence
  Description of Artificial Sequence:  Hypothetical Probe Sequence
cgaacagcggacaaagagcc

SEQ ID NO: 5363 - DNA, 20 bp, Artificial Sequence
  Description of Artificial Sequence:  Hypothetical Probe Sequence
gcttcgttcgttatcggcaa

SEQ ID NO: 5364 - DNA, 20 bp, Artificial Sequence
  Description of Artificial Sequence:  Hypothetical Probe Sequence
gcttccatcgttgatgacgg

SEQ ID NO: 5365 - DNA, 20 bp, Artificial Sequence
  Description of Artificial Sequence:  Hypothetical Probe Sequence
gcttgcttccattgtcgctt

SEQ ID NO: 5366 - DNA, 20 bp, Artificial Sequence
  Description of Artificial Sequence:  Hypothetical Probe Sequence
gcttatcgacctagccgtgc

SEQ ID NO: 5367 - DNA, 20 bp, Artificial Sequence
  Description of Artificial Sequence:  Hypothetical Probe Sequence
tgtcgcttaggaagccacgg

SEQ ID NO: 5368 - DNA, 20 bp, Artificial Sequence
  Description of Artificial Sequence:  Hypothetical Probe Sequence
ggtatcgttccctcccgtgc

SEQ ID NO: 5369 - DNA, 20 bp, Artificial Sequence
  Description of Artificial Sequence:  Hypothetical Probe Sequence
ggtagcaaacctacggcagc

SEQ ID NO: 5370 - DNA, 20 bp, Artificial Sequence
  Description of Artificial Sequence:  Hypothetical Probe Sequence
tgtcggtacagccagcgcaa

SEQ ID NO: 5371 - DNA, 20 bp, Artificial Sequence
  Description of Artificial Sequence:  Hypothetical Probe Sequence
gtcttcgtggaccgtttccc

SEQ ID NO: 5372 - DNA, 20 bp, Artificial Sequence
  Description of Artificial Sequence:  Hypothetical Probe Sequence
gtctcgaatcccgaccacgg

SEQ ID NO: 5373 - DNA, 20 bp, Artificial Sequence
  Description of Artificial Sequence:  Hypothetical Probe Sequence
tgtcgagtcagcagcccgaa

SEQ ID NO: 5374 - DNA, 20 bp, Artificial Sequence
  Description of Artificial Sequence:  Hypothetical Probe Sequence
gcaattgaccatagccgacc

SEQ ID NO: 5375 - DNA, 20 bp, Artificial Sequence
  Description of Artificial Sequence:  Hypothetical Probe Sequence
gcaaaatctcgtgatgtgcg

SEQ ID NO: 5376 - DNA, 20 bp, Artificial Sequence
  Description of Artificial Sequence:  Hypothetical Probe Sequence
gcaatcgtgcttgatgccat

SEQ ID NO: 5377 - DNA, 20 bp, Artificial Sequence
  Description of Artificial Sequence:  Hypothetical Probe Sequence
tgtcgcaagagttgcgcacg

SEQ ID NO: 5378 - DNA, 20 bp, Artificial Sequence
  Description of Artificial Sequence:  Hypothetical Probe Sequence
gcaaagtggtctgtgccgaa

SEQ ID NO: 5379 - DNA, 20 bp, Artificial Sequence
  Description of Artificial Sequence:  Hypothetical Probe Sequence
tgtcgcaatgcggaccccta

SEQ ID NO: 5380 - DNA, 20 bp, Artificial Sequence
  Description of Artificial Sequence:  Hypothetical Probe Sequence
agtgcagcagccggactgcg

SEQ ID NO: 5381 - DNA, 20 bp, Artificial Sequence
  Description of Artificial Sequence:  Hypothetical Probe Sequence
acctcacgcgaaacggcgtt

SEQ ID NO: 5382 - DNA, 20 bp, Artificial Sequence
  Description of Artificial Sequence:  Hypothetical Probe Sequence
atcgtcgtcagcgcaaagcc

SEQ ID NO: 5383 - DNA, 20 bp, Artificial Sequence
  Description of Artificial Sequence:  Hypothetical Probe Sequence
atcggatggcaaacgggtgc

SEQ ID NO: 5384 - DNA, 20 bp, Artificial Sequence
  Description of Artificial Sequence:  Hypothetical Probe Sequence
tgtcatcgtgcgcagcgtgc

SEQ ID NO: 5385 - DNA, 20 bp, Artificial Sequence
  Description of Artificial Sequence:  Hypothetical Probe Sequence
cctacagcagcccagcgtgc

SEQ ID NO: 5386 - DNA, 20 bp, Artificial Sequence
  Description of Artificial Sequence:  Hypothetical Probe Sequence
tgtccctaacgggacctgcg

SEQ ID NO: 5387 - DNA, 20 bp, Artificial Sequence
  Description of Artificial Sequence:  Hypothetical Probe Sequence
gatggtgcccatcttgccat

SEQ ID NO: 5388 - DNA, 20 bp, Artificial Sequence
  Description of Artificial Sequence:  Hypothetical Probe Sequence
gatgggacgatgcgtttccc

SEQ ID NO: 5389 - DNA, 20 bp, Artificial Sequence
  Description of Artificial Sequence:  Hypothetical Probe Sequence
tccccgttaggattgatgcg

SEQ ID NO: 5390 - DNA, 20 bp, Artificial Sequence
  Description of Artificial Sequence:  Hypothetical Probe Sequence
tcccaggaggacgaccgctt

SEQ ID NO: 5391 - DNA, 20 bp, Artificial Sequence
  Description of Artificial Sequence:  Hypothetical Probe Sequence
tgcgttgaacgggaccacct

SEQ ID NO: 5392 - DNA, 20 bp, Artificial Sequence
  Description of Artificial Sequence:  Hypothetical Probe Sequence
tgcgaatcgacccagcccat

SEQ ID NO: 5393 - DNA, 20 bp, Artificial Sequence
  Description of Artificial Sequence:  Hypothetical Probe Sequence
tgcgaaagcagccttggctt

SEQ ID NO: 5394 - DNA, 20 bp, Artificial Sequence
  Description of Artificial Sequence:  Hypothetical Probe Sequence
tgcgggtacgaacctaacgg

SEQ ID NO: 5395 - DNA, 20 bp, Artificial Sequence
  Description of Artificial Sequence:  Hypothetical Probe Sequence
tgcgagtggcaatgcggcaa

SEQ ID NO: 5396 - DNA, 20 bp, Artificial Sequence
  Description of Artificial Sequence:  Hypothetical Probe Sequence
tgcgaggacgaacacgacct

SEQ ID NO: 5397 - DNA, 20 bp, Artificial Sequence
  Description of Artificial Sequence:  Hypothetical Probe Sequence
tgtctgcgtgcggtgcccta

SEQ ID NO: 5398 - DNA, 20 bp, Artificial Sequence
  Description of Artificial Sequence:  Hypothetical Probe Sequence
tgcggtgccagctctggtgc

SEQ ID NO: 5399 - DNA, 20 bp, Artificial Sequence
  Description of Artificial Sequence:  Hypothetical Probe Sequence
cacgtcgtgacccttgccat

SEQ ID NO: 5400 - DNA, 20 bp, Artificial Sequence
  Description of Artificial Sequence:  Hypothetical Probe Sequence
tgtccacgcttggacccacg

SEQ ID NO: 5401 - DNA, 20 bp, Artificial Sequence
  Description of Artificial Sequence:  Hypothetical Probe Sequence
tgtccacggcttcctagcaa

SEQ ID NO: 5402 - DNA, 20 bp, Artificial Sequence
  Description of Artificial Sequence:  Hypothetical Probe Sequence
cacgggtactgtcacgacgg

SEQ ID NO: 5403 - DNA, 20 bp, Artificial Sequence
  Description of Artificial Sequence:  Hypothetical Probe Sequence
tgtccacggacctcgtgctt

SEQ ID NO: 5404 - DNA, 20 bp, Artificial Sequence
  Description of Artificial Sequence:  Hypothetical Probe Sequence
cagcaccttcgtacggtccc

SEQ ID NO: 5405 - DNA, 20 bp, Artificial Sequence
  Description of Artificial Sequence:  Hypothetical Probe Sequence
cagcgaccttgaggaccagc

SEQ ID NO: 5406 - DNA, 20 bp, Artificial Sequence
  Description of Artificial Sequence:  Hypothetical Probe Sequence
tgtcgaccaatctcccgtgc

SEQ ID NO: 5407 - DNA, 20 bp, Artificial Sequence
  Description of Artificial Sequence:  Hypothetical Probe Sequence
gaccaggactcatgcggcaa

SEQ ID NO: 5408 - DNA, 20 bp, Artificial Sequence
  Description of Artificial Sequence:  Hypothetical Probe Sequence
gtgcaatcaatccacgccat

SEQ ID NO: 5409 - DNA, 20 bp, Artificial Sequence
  Description of Artificial Sequence:  Hypothetical Probe Sequence
tgtcgtgctcgtgcaagacc

SEQ ID NO: 5410 - DNA, 20 bp, Artificial Sequence
  Description of Artificial Sequence:  Hypothetical Probe Sequence
gtgccttgctgtcacgcacg

SEQ ID NO: 5411 - DNA, 20 bp, Artificial Sequence
  Description of Artificial Sequence:  Hypothetical Probe Sequence
tgtcgtgcggtatctggcaa

SEQ ID NO: 5412 - DNA, 20 bp, Artificial Sequence
  Description of Artificial Sequence:  Hypothetical Probe Sequence
gtgcgtcttctgggacggac

SEQ ID NO: 5413 - DNA, 20 bp, Artificial Sequence
  Description of Artificial Sequence:  Hypothetical Probe Sequence
tgtcgtgcacctacctgtgc

SEQ ID NO: 5414 - DNA, 20 bp, Artificial Sequence
  Description of Artificial Sequence:  Hypothetical Probe Sequence
gtgcaggactgtcgaaacgg

SEQ ID NO: 5415 - DNA, 20 bp, Artificial Sequence
  Description of Artificial Sequence:  Hypothetical Probe Sequence
tgtcgtgctccccgaaaatc

SEQ ID NO: 5416 - DNA, 20 bp, Artificial Sequence
  Description of Artificial Sequence:  Hypothetical Probe Sequence
tgtcggacctgtgcttagcc

SEQ ID NO: 5417 - DNA, 20 bp, Artificial Sequence
  Description of Artificial Sequence:  Hypothetical Probe Sequence
ggacgtctggtaagccgctt

SEQ ID NO: 5418 - DNA, 20 bp, Artificial Sequence
  Description of Artificial Sequence:  Hypothetical Probe Sequence
tgtcggacacctcgttacgg

SEQ ID NO: 5419 - DNA, 20 bp, Artificial Sequence
  Description of Artificial Sequence:  Hypothetical Probe Sequence
tgtcggaccctaaatcgctt

SEQ ID NO: 5420 - DNA, 20 bp, Artificial Sequence
  Description of Artificial Sequence:  Hypothetical Probe Sequence
ggacgatgagtgcctaagcc

SEQ ID NO: 5421 - DNA, 20 bp, Artificial Sequence
  Description of Artificial Sequence:  Hypothetical Probe Sequence
ggactcccgaccagtggtgc

SEQ ID NO: 5422 - DNA, 20 bp, Artificial Sequence
  Description of Artificial Sequence:  Hypothetical Probe Sequence
tgtcacggttgatcccacgg

SEQ ID NO: 5423 - DNA, 20 bp, Artificial Sequence
  Description of Artificial Sequence:  Hypothetical Probe Sequence
tgtcacggcttgcgttgcaa

SEQ ID NO: 5424 - DNA, 20 bp, Artificial Sequence
  Description of Artificial Sequence:  Hypothetical Probe Sequence
acgggcttacctgatgccat

SEQ ID NO: 5425 - DNA, 20 bp, Artificial Sequence
  Description of Artificial Sequence:  Hypothetical Probe Sequence
acgggagtaggacgtttgcg

SEQ ID NO: 5426 - DNA, 20 bp, Artificial Sequence
  Description of Artificial Sequence:  Hypothetical Probe Sequence
tgtcacgggcaaaaagcgaa

SEQ ID NO: 5427 - DNA, 20 bp, Artificial Sequence
  Description of Artificial Sequence:  Hypothetical Probe Sequence
acggtccccttgggacagga

SEQ ID NO: 5428 - DNA, 20 bp, Artificial Sequence
  Description of Artificial Sequence:  Hypothetical Probe Sequence
agccctgtataccgaatgcg

SEQ ID NO: 5429 - DNA, 20 bp, Artificial Sequence
  Description of Artificial Sequence:  Hypothetical Probe Sequence
agccgcttttgacgtttcgt

SEQ ID NO: 5430 - DNA, 20 bp, Artificial Sequence
  Description of Artificial Sequence:  Hypothetical Probe Sequence
agccacctgcaagatggctt

SEQ ID NO: 5431 - DNA, 20 bp, Artificial Sequence
  Description of Artificial Sequence:  Hypothetical Probe Sequence
agccatcgttagcagccagc

SEQ ID NO: 5432 - DNA, 20 bp, Artificial Sequence
  Description of Artificial Sequence:  Hypothetical Probe Sequence
tgtcagccgaccgctttcgt

SEQ ID NO: 5433 - DNA, 20 bp, Artificial Sequence
  Description of Artificial Sequence:  Hypothetical Probe Sequence
tgatgcttcttggtgcgctt

SEQ ID NO: 5434 - DNA, 20 bp, Artificial Sequence
  Description of Artificial Sequence:  Hypothetical Probe Sequence
ttagggacagccagccacgg

SEQ ID NO: 5435 - DNA, 20 bp, Artificial Sequence
  Description of Artificial Sequence:  Hypothetical Probe Sequence
aatccacgcgttggtaacgg

SEQ ID NO: 5436 - DNA, 20 bp, Artificial Sequence
  Description of Artificial Sequence:  Hypothetical Probe Sequence
aaagggacaggatccctgcg

SEQ ID NO: 5437 - DNA, 20 bp, Artificial Sequence
  Description of Artificial Sequence:  Hypothetical Probe Sequence
aaagagccaaagcacgccat

SEQ ID NO: 5438 - DNA, 20 bp, Artificial Sequence
  Description of Artificial Sequence:  Hypothetical Probe Sequence
tcgttctgtgcgcgaagtgc

SEQ ID NO: 5439 - DNA, 20 bp, Artificial Sequence
  Description of Artificial Sequence:  Hypothetical Probe Sequence
tctgcacgatacgaccgctt

SEQ ID NO: 5440 - DNA, 20 bp, Artificial Sequence
  Description of Artificial Sequence:  Hypothetical Probe Sequence
tcgttgtccgttgagttgcg

SEQ ID NO: 5441 - DNA, 20 bp, Artificial Sequence
  Description of Artificial Sequence:  Hypothetical Probe Sequence
tgtcctcaacggtgcggctt

SEQ ID NO: 5442 - DNA, 20 bp, Artificial Sequence
  Description of Artificial Sequence:  Hypothetical Probe Sequence
tgtcgagttgcgcttggacc

SEQ ID NO: 5443 - DNA, 20 bp, Artificial Sequence
  Description of Artificial Sequence:  Hypothetical Probe Sequence
tcgttgtccacgagcccgtt

SEQ ID NO: 5444 - DNA, 20 bp, Artificial Sequence
  Description of Artificial Sequence:  Hypothetical Probe Sequence
tcgttgtcacggtcgtgcaa

SEQ ID NO: 5445 - DNA, 20 bp, Artificial Sequence
  Description of Artificial Sequence:  Hypothetical Probe Sequence
tcgttcgtggtatgcgccta

SEQ ID NO: 5446 - DNA, 20 bp, Artificial Sequence
  Description of Artificial Sequence:  Hypothetical Probe Sequence
tcgttgcgatcgtacatgcg

SEQ ID NO: 5447 - DNA, 20 bp, Artificial Sequence
  Description of Artificial Sequence:  Hypothetical Probe Sequence
cttgcgttcttgcttgcagc

SEQ ID NO: 5448 - DNA, 20 bp, Artificial Sequence
  Description of Artificial Sequence:  Hypothetical Probe Sequence
tcgtcttgtcccggactccc

SEQ ID NO: 5449 - DNA, 20 bp, Artificial Sequence
  Description of Artificial Sequence:  Hypothetical Probe Sequence
tcgtcttggaccagccacct

SEQ ID NO: 5450 - DNA, 20 bp, Artificial Sequence
  Description of Artificial Sequence:  Hypothetical Probe Sequence
cttgagccagccatacacgg

SEQ ID NO: 5451 - DNA, 20 bp, Artificial Sequence
  Description of Artificial Sequence:  Hypothetical Probe Sequence
cgtttgatgcaacagcgtgc

SEQ ID NO: 5452 - DNA, 20 bp, Artificial Sequence
  Description of Artificial Sequence:  Hypothetical Probe Sequence
cgtttgtcaatcgtgcgtgc

SEQ ID NO: 5453 - DNA, 20 bp, Artificial Sequence
  Description of Artificial Sequence:  Hypothetical Probe Sequence
cgttcgaaggtagcaatgcg

SEQ ID NO: 5454 - DNA, 20 bp, Artificial Sequence
  Description of Artificial Sequence:  Hypothetical Probe Sequence
cgttacctcgttcgaatgcg

SEQ ID NO: 5455 - DNA, 20 bp, Artificial Sequence
  Description of Artificial Sequence:  Hypothetical Probe Sequence
tcgtcgttgacccacgcacg

SEQ ID NO: 5456 - DNA, 20 bp, Artificial Sequence
  Description of Artificial Sequence:  Hypothetical Probe Sequence
tcgtcgttagccagccttga

SEQ ID NO: 5457 - DNA, 20 bp, Artificial Sequence
  Description of Artificial Sequence:  Hypothetical Probe Sequence
tcgtctcacagcgtgccgtt

SEQ ID NO: 5458 - DNA, 20 bp, Artificial Sequence
  Description of Artificial Sequence:  Hypothetical Probe Sequence
ctcaagccttaggtgccacg

SEQ ID NO: 5459 - DNA, 20 bp, Artificial Sequence
  Description of Artificial Sequence:  Hypothetical Probe Sequence
ctgtagcccagctgcggctt

SEQ ID NO: 5460 - DNA, 20 bp, Artificial Sequence
  Description of Artificial Sequence:  Hypothetical Probe Sequence
ccatctcaagccccatgcaa

SEQ ID NO: 5461 - DNA, 20 bp, Artificial Sequence
  Description of Artificial Sequence:  Hypothetical Probe Sequence
ccatcagcggtaacgggacc

SEQ ID NO: 5462 - DNA, 20 bp, Artificial Sequence
  Description of Artificial Sequence:  Hypothetical Probe Sequence
tcgtccatgacccacgcttg

SEQ ID NO: 5463 - DNA, 20 bp, Artificial Sequence
  Description of Artificial Sequence:  Hypothetical Probe Sequence
cgaaaatcacggtgtcgctt

SEQ ID NO: 5464 - DNA, 20 bp, Artificial Sequence
  Description of Artificial Sequence:  Hypothetical Probe Sequence
tcgtcgaaaaaggaccacgg

SEQ ID NO: 5465 - DNA, 20 bp, Artificial Sequence
  Description of Artificial Sequence:  Hypothetical Probe Sequence
cgaatctgtgcgggaccacg

SEQ ID NO: 5466 - DNA, 20 bp, Artificial Sequence
  Description of Artificial Sequence:  Hypothetical Probe Sequence
tcgtcgaaaccttcccggac

SEQ ID NO: 5467 - DNA, 20 bp, Artificial Sequence
  Description of Artificial Sequence:  Hypothetical Probe Sequence
tcgtcgaaaggaatcggatg

SEQ ID NO: 5468 - DNA, 20 bp, Artificial Sequence
  Description of Artificial Sequence:  Hypothetical Probe Sequence
tcgtcgaagtgcgcaatccc

SEQ ID NO: 5469 - DNA, 20 bp, Artificial Sequence
  Description of Artificial Sequence:  Hypothetical Probe Sequence
tcgtgcttctcagacctgcg

SEQ ID NO: 5470 - DNA, 20 bp, Artificial Sequence
  Description of Artificial Sequence:  Hypothetical Probe Sequence
tcgtggtaagcccacggagt

SEQ ID NO: 5471 - DNA, 20 bp, Artificial Sequence
  Description of Artificial Sequence:  Hypothetical Probe Sequence
gtctcgtttcccacggagcc

SEQ ID NO: 5472 - DNA, 20 bp, Artificial Sequence
  Description of Artificial Sequence:  Hypothetical Probe Sequence
gtctgcaaagccagccgtgc

SEQ ID NO: 5473 - DNA, 20 bp, Artificial Sequence
  Description of Artificial Sequence:  Hypothetical Probe Sequence
tcgtgtctgtgcatcgtgcg

SEQ ID NO: 5474 - DNA, 20 bp, Artificial Sequence
  Description of Artificial Sequence:  Hypothetical Probe Sequence
gagttcgtcagcggacgacc

SEQ ID NO: 5475 - DNA, 20 bp, Artificial Sequence
  Description of Artificial Sequence:  Hypothetical Probe Sequence
gagtccattgcggtcttccc

SEQ ID NO: 5476 - DNA, 20 bp, Artificial Sequence
  Description of Artificial Sequence:  Hypothetical Probe Sequence
tcgtgcaattgatgtcgtgc

SEQ ID NO: 5477 - DNA, 20 bp, Artificial Sequence
  Description of Artificial Sequence:  Hypothetical Probe Sequence
tcgtgcaagcttcttggatg

SEQ ID NO: 5478 - DNA, 20 bp, Artificial Sequence
  Description of Artificial Sequence:  Hypothetical Probe Sequence
tcgtgcaatgcggtgctcgt

SEQ ID NO: 5479 - DNA, 20 bp, Artificial Sequence
  Description of Artificial Sequence:  Hypothetical Probe Sequence
tcgtgcaaggacagcctcgt

SEQ ID NO: 5480 - DNA, 20 bp, Artificial Sequence
  Description of Artificial Sequence:  Hypothetical Probe Sequence
agtgtgcgggtaacgggtgc

SEQ ID NO: 5481 - DNA, 20 bp, Artificial Sequence
  Description of Artificial Sequence:  Hypothetical Probe Sequence
agtggtgcgatggtgcgtgc

SEQ ID NO: 5482 - DNA, 20 bp, Artificial Sequence
  Description of Artificial Sequence:  Hypothetical Probe Sequence
acctcagcacggacggggac

SEQ ID NO: 5483 - DNA, 20 bp, Artificial Sequence
  Description of Artificial Sequence:  Hypothetical Probe Sequence
tcgtatcggcttatcgcacg

SEQ ID NO: 5484 - DNA, 20 bp, Artificial Sequence
  Description of Artificial Sequence:  Hypothetical Probe Sequence
atcgggacgacctcccagga

SEQ ID NO: 5485 - DNA, 20 bp, Artificial Sequence
  Description of Artificial Sequence:  Hypothetical Probe Sequence
aggagacctctgagccagcc

SEQ ID NO: 5486 - DNA, 20 bp, Artificial Sequence
  Description of Artificial Sequence:  Hypothetical Probe Sequence
aggaagccccatccatgtgc

SEQ ID NO: 5487 - DNA, 20 bp, Artificial Sequence
  Description of Artificial Sequence:  Hypothetical Probe Sequence
cctaaaagtgcgtgcgagcc

SEQ ID NO: 5488 - DNA, 20 bp, Artificial Sequence
  Description of Artificial Sequence:  Hypothetical Probe Sequence
tcgtgatgagccgcaacagc

SEQ ID NO: 5489 - DNA, 20 bp, Artificial Sequence
  Description of Artificial Sequence:  Hypothetical Probe Sequence
tcgttcccctgtttagcgaa

SEQ ID NO: 5490 - DNA, 20 bp, Artificial Sequence
  Description of Artificial Sequence:  Hypothetical Probe Sequence
tcgttcccccataaaggtgc

SEQ ID NO: 5491 - DNA, 20 bp, Artificial Sequence
  Description of Artificial Sequence:  Hypothetical Probe Sequence
tcccgtctgcaacctagcaa

SEQ ID NO: 5492 - DNA, 20 bp, Artificial Sequence
  Description of Artificial Sequence:  Hypothetical Probe Sequence
tcccgagtccatcttggcaa

SEQ ID NO: 5493 - DNA, 20 bp, Artificial Sequence
  Description of Artificial Sequence:  Hypothetical Probe Sequence
tcgttccctgcgtcgtacgg

SEQ ID NO: 5494 - DNA, 20 bp, Artificial Sequence
  Description of Artificial Sequence:  Hypothetical Probe Sequence
tcgttcccggactgtcgtgc

SEQ ID NO: 5495 - DNA, 20 bp, Artificial Sequence
  Description of Artificial Sequence:  Hypothetical Probe Sequence
tcgttgcgaatcaatcgcaa

SEQ ID NO: 5496 - DNA, 20 bp, Artificial Sequence
  Description of Artificial Sequence:  Hypothetical Probe Sequence
tgcgtcgtagtggagttgcg

SEQ ID NO: 5497 - DNA, 20 bp, Artificial Sequence
  Description of Artificial Sequence:  Hypothetical Probe Sequence
tcgttgcgctcattgatgcg

SEQ ID NO: 5498 - DNA, 20 bp, Artificial Sequence
  Description of Artificial Sequence:  Hypothetical Probe Sequence
tgcggagtggtagacccacg

SEQ ID NO: 5499 - DNA, 20 bp, Artificial Sequence
  Description of Artificial Sequence:  Hypothetical Probe Sequence
tcgttgcgagtgaaagcgaa

SEQ ID NO: 5500 - DNA, 20 bp, Artificial Sequence
  Description of Artificial Sequence:  Hypothetical Probe Sequence
tgcggatgggtaggacagcc

SEQ ID NO: 5501 - DNA, 20 bp, Artificial Sequence
  Description of Artificial Sequence:  Hypothetical Probe Sequence
tcgttgcgcagctgtccacg

SEQ ID NO: 5502 - DNA, 20 bp, Artificial Sequence
  Description of Artificial Sequence:  Hypothetical Probe Sequence
tcgttgcggaccaaaggtgc

SEQ ID NO: 5503 - DNA, 20 bp, Artificial Sequence
  Description of Artificial Sequence:  Hypothetical Probe Sequence
tcgttgcgagccaatctcgt

SEQ ID NO: 5504 - DNA, 20 bp, Artificial Sequence
  Description of Artificial Sequence:  Hypothetical Probe Sequence
cacgaaagatacacggcagc

SEQ ID NO: 5505 - DNA, 20 bp, Artificial Sequence
  Description of Artificial Sequence:  Hypothetical Probe Sequence
cacgtctgtccctgcgagcc

SEQ ID NO: 5506 - DNA, 20 bp, Artificial Sequence
  Description of Artificial Sequence:  Hypothetical Probe Sequence
cacgcttgctcacagctccc

SEQ ID NO: 5507 - DNA, 20 bp, Artificial Sequence
  Description of Artificial Sequence:  Hypothetical Probe Sequence
tcgtcacgcgtttctgggta

SEQ ID NO: 5508 - DNA, 20 bp, Artificial Sequence
  Description of Artificial Sequence:  Hypothetical Probe Sequence
tcgtcacgctgtagccccta

SEQ ID NO: 5509 - DNA, 20 bp, Artificial Sequence
  Description of Artificial Sequence:  Hypothetical Probe Sequence
tcgtcacgccatgatggatg

SEQ ID NO: 5510 - DNA, 20 bp, Artificial Sequence
  Description of Artificial Sequence:  Hypothetical Probe Sequence
cacggcaatacagaccggac

SEQ ID NO: 5511 - DNA, 20 bp, Artificial Sequence
  Description of Artificial Sequence:  Hypothetical Probe Sequence
cacgagtgaaaggcttgtgc

SEQ ID NO: 5512 - DNA, 20 bp, Artificial Sequence
  Description of Artificial Sequence:  Hypothetical Probe Sequence
tcgtcacgatcgtctgacgg

SEQ ID NO: 5513 - DNA, 20 bp, Artificial Sequence
  Description of Artificial Sequence:  Hypothetical Probe Sequence
tcgtcacgacgggatgacgg

SEQ ID NO: 5514 - DNA, 20 bp, Artificial Sequence
  Description of Artificial Sequence:  Hypothetical Probe Sequence
tcgtcagcctcatgtcagcc

SEQ ID NO: 5515 - DNA, 20 bp, Artificial Sequence
  Description of Artificial Sequence:  Hypothetical Probe Sequence
cagcccatgacctgtcagcc

SEQ ID NO: 5516 - DNA, 20 bp, Artificial Sequence
  Description of Artificial Sequence:  Hypothetical Probe Sequence
cagcggtattgaggaccgtt

SEQ ID NO: 5517 - DNA, 20 bp, Artificial Sequence
  Description of Artificial Sequence:  Hypothetical Probe Sequence
cagcgagtagtgcagcgtgc

SEQ ID NO: 5518 - DNA, 20 bp, Artificial Sequence
  Description of Artificial Sequence:  Hypothetical Probe Sequence
cagcgaccgagttcgttccc

SEQ ID NO: 5519 - DNA, 20 bp, Artificial Sequence
  Description of Artificial Sequence:  Hypothetical Probe Sequence
gaccaatccgttggactgcg

SEQ ID NO: 5520 - DNA, 20 bp, Artificial Sequence
  Description of Artificial Sequence:  Hypothetical Probe Sequence
gaccaaagcttgagccgtgc

SEQ ID NO: 5521 - DNA, 20 bp, Artificial Sequence
  Description of Artificial Sequence:  Hypothetical Probe Sequence
gacccgttaccttctgacgg

SEQ ID NO: 5522 - DNA, 20 bp, Artificial Sequence
  Description of Artificial Sequence:  Hypothetical Probe Sequence
gaccctgtttgaagccgctt

SEQ ID NO: 5523 - DNA, 20 bp, Artificial Sequence
  Description of Artificial Sequence:  Hypothetical Probe Sequence
gaccgcttccatgagttccc

SEQ ID NO: 5524 - DNA, 20 bp, Artificial Sequence
  Description of Artificial Sequence:  Hypothetical Probe Sequence
gaccgtctggacgtgcgacc

SEQ ID NO: 5525 - DNA, 20 bp, Artificial Sequence
  Description of Artificial Sequence:  Hypothetical Probe Sequence
gaccatcgtcgtaggatgcg

SEQ ID NO: 5526 - DNA, 20 bp, Artificial Sequence
  Description of Artificial Sequence:  Hypothetical Probe Sequence
tcgtgtgcaatctctgccat

SEQ ID NO: 5527 - DNA, 20 bp, Artificial Sequence
  Description of Artificial Sequence:  Hypothetical Probe Sequence
gtgctctgccatagccgcaa

SEQ ID NO: 5528 - DNA, 20 bp, Artificial Sequence
  Description of Artificial Sequence:  Hypothetical Probe Sequence
tcgtgtgctgtcgcaatccc

SEQ ID NO: 5529 - DNA, 20 bp, Artificial Sequence
  Description of Artificial Sequence:  Hypothetical Probe Sequence
gtgccttgataccacgcagc

SEQ ID NO: 5530 - DNA, 20 bp, Artificial Sequence
  Description of Artificial Sequence:  Hypothetical Probe Sequence
tcgtgtgcctgtgcttccat

SEQ ID NO: 5531 - DNA, 20 bp, Artificial Sequence
  Description of Artificial Sequence:  Hypothetical Probe Sequence
gtgcggtaacctacggacgg

SEQ ID NO: 5532 - DNA, 20 bp, Artificial Sequence
  Description of Artificial Sequence:  Hypothetical Probe Sequence
gtgcgtctggacagtgcgtt

SEQ ID NO: 5533 - DNA, 20 bp, Artificial Sequence
  Description of Artificial Sequence:  Hypothetical Probe Sequence
tcgtgtgcgagtcacgagga

SEQ ID NO: 5534 - DNA, 20 bp, Artificial Sequence
  Description of Artificial Sequence:  Hypothetical Probe Sequence
tcgtgtgcgcaaaaagagcc

SEQ ID NO: 5535 - DNA, 20 bp, Artificial Sequence
  Description of Artificial Sequence:  Hypothetical Probe Sequence
ggacttgatccctgcgcgtt

SEQ ID NO: 5536 - DNA, 20 bp, Artificial Sequence
  Description of Artificial Sequence:  Hypothetical Probe Sequence
ggacaatccagcgacccgtt

SEQ ID NO: 5537 - DNA, 20 bp, Artificial Sequence
  Description of Artificial Sequence:  Hypothetical Probe Sequence
ggacaaaggcaagtgccgaa

SEQ ID NO: 5538 - DNA, 20 bp, Artificial Sequence
  Description of Artificial Sequence:  Hypothetical Probe Sequence
tcgtggaccttggaccgtct

SEQ ID NO: 5539 - DNA, 20 bp, Artificial Sequence
  Description of Artificial Sequence:  Hypothetical Probe Sequence
tcgtggacctgttgcgccta

SEQ ID NO: 5540 - DNA, 20 bp, Artificial Sequence
  Description of Artificial Sequence:  Hypothetical Probe Sequence
ggacgagttctggtgcgacc

SEQ ID NO: 5541 - DNA, 20 bp, Artificial Sequence
  Description of Artificial Sequence:  Hypothetical Probe Sequence
ggacgatgcctacagcccat

SEQ ID NO: 5542 - DNA, 20 bp, Artificial Sequence
  Description of Artificial Sequence:  Hypothetical Probe Sequence
ggactccctcccatacagcc

SEQ ID NO: 5543 - DNA, 20 bp, Artificial Sequence
  Description of Artificial Sequence:  Hypothetical Probe Sequence
tcgtggactgcggtgcctca

SEQ ID NO: 5544 - DNA, 20 bp, Artificial Sequence
  Description of Artificial Sequence:  Hypothetical Probe Sequence
ggaccacgttagatcggcaa

SEQ ID NO: 5545 - DNA, 20 bp, Artificial Sequence
  Description of Artificial Sequence:  Hypothetical Probe Sequence
ggacagccccatagtgcgaa

SEQ ID NO: 5546 - DNA, 20 bp, Artificial Sequence
  Description of Artificial Sequence:  Hypothetical Probe Sequence
acggtcgttctgatcgcgtt

SEQ ID NO: 5547 - DNA, 20 bp, Artificial Sequence
  Description of Artificial Sequence:  Hypothetical Probe Sequence
acggccatggtatcgtgcaa

SEQ ID NO: 5548 - DNA, 20 bp, Artificial Sequence
  Description of Artificial Sequence:  Hypothetical Probe Sequence
acggcctaatcgctcaatcg

SEQ ID NO: 5549 - DNA, 20 bp, Artificial Sequence
  Description of Artificial Sequence:  Hypothetical Probe Sequence
tcgtagccttgacagcgcaa

SEQ ID NO: 5550 - DNA, 20 bp, Artificial Sequence
  Description of Artificial Sequence:  Hypothetical Probe Sequence
agcctgtcggtaagcctgcg

SEQ ID NO: 5551 - DNA, 20 bp, Artificial Sequence
  Description of Artificial Sequence:  Hypothetical Probe Sequence
agcctcgtaggactgttgcg

SEQ ID NO: 5552 - DNA, 20 bp, Artificial Sequence
  Description of Artificial Sequence:  Hypothetical Probe Sequence
agcccgtttctgttgatgcg

SEQ ID NO: 5553 - DNA, 20 bp, Artificial Sequence
  Description of Artificial Sequence:  Hypothetical Probe Sequence
agccccatgagtgaccccat

SEQ ID NO: 5554 - DNA, 20 bp, Artificial Sequence
  Description of Artificial Sequence:  Hypothetical Probe Sequence
agcctgcgatactccccacg

SEQ ID NO: 5555 - DNA, 20 bp, Artificial Sequence
  Description of Artificial Sequence:  Hypothetical Probe Sequence
ttgaagccgaccggtaacgg

SEQ ID NO: 5556 - DNA, 20 bp, Artificial Sequence
  Description of Artificial Sequence:  Hypothetical Probe Sequence
aatcgaccacgggtgcacgg

SEQ ID NO: 5557 - DNA, 20 bp, Artificial Sequence
  Description of Artificial Sequence:  Hypothetical Probe Sequence
aaagtcccggaccgaatgcg

SEQ ID NO: 5558 - DNA, 20 bp, Artificial Sequence
  Description of Artificial Sequence:  Hypothetical Probe Sequence
tctgcacggacccctatgcg

SEQ ID NO: 5559 - DNA, 20 bp, Artificial Sequence
  Description of Artificial Sequence:  Hypothetical Probe Sequence
cttgcttgacctgcaaacgg

SEQ ID NO: 5560 - DNA, 20 bp, Artificial Sequence
  Description of Artificial Sequence:  Hypothetical Probe Sequence
cttgatcgttagtgcgacgg

SEQ ID NO: 5561 - DNA, 20 bp, Artificial Sequence
  Description of Artificial Sequence:  Hypothetical Probe Sequence
cttgcctacttgcacggcaa

SEQ ID NO: 5562 - DNA, 20 bp, Artificial Sequence
  Description of Artificial Sequence:  Hypothetical Probe Sequence
cttggatgggacatcgcgaa

SEQ ID NO: 5563 - DNA, 20 bp, Artificial Sequence
  Description of Artificial Sequence:  Hypothetical Probe Sequence
cgttttgaagccggtaacgg

SEQ ID NO: 5564 - DNA, 20 bp, Artificial Sequence
  Description of Artificial Sequence:  Hypothetical Probe Sequence
cttgcgttaccttgcggacc

SEQ ID NO: 5565 - DNA, 20 bp, Artificial Sequence
  Description of Artificial Sequence:  Hypothetical Probe Sequence
ctcacacgggacaggaagcc

SEQ ID NO: 5566 - DNA, 20 bp, Artificial Sequence
  Description of Artificial Sequence:  Hypothetical Probe Sequence
ctcagtgccagcgaccacgg

SEQ ID NO: 5567 - DNA, 20 bp, Artificial Sequence
  Description of Artificial Sequence:  Hypothetical Probe Sequence
ctgtgcaagtgccgttacgg

SEQ ID NO: 5568 - DNA, 20 bp, Artificial Sequence
  Description of Artificial Sequence:  Hypothetical Probe Sequence
cttgccatccatcacggcaa

SEQ ID NO: 5569 - DNA, 20 bp, Artificial Sequence
  Description of Artificial Sequence:  Hypothetical Probe Sequence
ccatgcttagtggtgcagcc

SEQ ID NO: 5570 - DNA, 20 bp, Artificial Sequence
  Description of Artificial Sequence:  Hypothetical Probe Sequence
cttgcgaattgaatcggtgc

SEQ ID NO: 5571 - DNA, 20 bp, Artificial Sequence
  Description of Artificial Sequence:  Hypothetical Probe Sequence
cgaagcttcctaggacgctt

SEQ ID NO: 5572 - DNA, 20 bp, Artificial Sequence
  Description of Artificial Sequence:  Hypothetical Probe Sequence
cttggcttccatcacgtccc

SEQ ID NO: 5573 - DNA, 20 bp, Artificial Sequence
  Description of Artificial Sequence:  Hypothetical Probe Sequence
gcttgtcttcccgaccggac

SEQ ID NO: 5574 - DNA, 20 bp, Artificial Sequence
  Description of Artificial Sequence:  Hypothetical Probe Sequence
gcttcagcggacctgttccc

SEQ ID NO: 5575 - DNA, 20 bp, Artificial Sequence
  Description of Artificial Sequence:  Hypothetical Probe Sequence
gcttgtgccttgcttggctt

SEQ ID NO: 5576 - DNA, 20 bp, Artificial Sequence
  Description of Artificial Sequence:  Hypothetical Probe Sequence
gcttacggcgttagccagga

SEQ ID NO: 5577 - DNA, 20 bp, Artificial Sequence
  Description of Artificial Sequence:  Hypothetical Probe Sequence
gtcttcgtcctatcccacgg

SEQ ID NO: 5578 - DNA, 20 bp, Artificial Sequence
  Description of Artificial Sequence:  Hypothetical Probe Sequence
gtctcacggcaagacccagc

SEQ ID NO: 5579 - DNA, 20 bp, Artificial Sequence
  Description of Artificial Sequence:  Hypothetical Probe Sequence
gcaagctttgattcccccat

SEQ ID NO: 5580 - DNA, 20 bp, Artificial Sequence
  Description of Artificial Sequence:  Hypothetical Probe Sequence
gcaagagtggacaggatgcg

SEQ ID NO: 5581 - DNA, 20 bp, Artificial Sequence
  Description of Artificial Sequence:  Hypothetical Probe Sequence
gcaaacctttagcacgcgtt

SEQ ID NO: 5582 - DNA, 20 bp, Artificial Sequence
  Description of Artificial Sequence:  Hypothetical Probe Sequence
gcaaatcgaaaggatggctt

SEQ ID NO: 5583 - DNA, 20 bp, Artificial Sequence
  Description of Artificial Sequence:  Hypothetical Probe Sequence
cttggcaaaggaagccctgt

SEQ ID NO: 5584 - DNA, 20 bp, Artificial Sequence
  Description of Artificial Sequence:  Hypothetical Probe Sequence
gcaagaccagccgtgcgacc

SEQ ID NO: 5585 - DNA, 20 bp, Artificial Sequence
  Description of Artificial Sequence:  Hypothetical Probe Sequence
agtgcgaagaccatcgacgg

SEQ ID NO: 5586 - DNA, 20 bp, Artificial Sequence
  Description of Artificial Sequence:  Hypothetical Probe Sequence
acctgtgcggacagcccgaa

SEQ ID NO: 5587 - DNA, 20 bp, Artificial Sequence
  Description of Artificial Sequence:  Hypothetical Probe Sequence
aggatgcgacctcagcggac

SEQ ID NO: 5588 - DNA, 20 bp, Artificial Sequence
  Description of Artificial Sequence:  Hypothetical Probe Sequence
aggacacgagcccagccgaa

SEQ ID NO: 5589 - DNA, 20 bp, Artificial Sequence
  Description of Artificial Sequence:  Hypothetical Probe Sequence
cttgcctaatcgaggatgcg

SEQ ID NO: 5590 - DNA, 20 bp, Artificial Sequence
  Description of Artificial Sequence:  Hypothetical Probe Sequence
cctaacggtcccaatcctca

SEQ ID NO: 5591 - DNA, 20 bp, Artificial Sequence
  Description of Artificial Sequence:  Hypothetical Probe Sequence
cttggatgtcgtgaccagcc

SEQ ID NO: 5592 - DNA, 20 bp, Artificial Sequence
  Description of Artificial Sequence:  Hypothetical Probe Sequence
cttggatgcttgcagcagcc

SEQ ID NO: 5593 - DNA, 20 bp, Artificial Sequence
  Description of Artificial Sequence:  Hypothetical Probe Sequence
cttggatgcgttgcttgacc

SEQ ID NO: 5594 - DNA, 20 bp, Artificial Sequence
  Description of Artificial Sequence:  Hypothetical Probe Sequence
gatgctgttcgtcagccgaa

SEQ ID NO: 5595 - DNA, 20 bp, Artificial Sequence
  Description of Artificial Sequence:  Hypothetical Probe Sequence
gatggcaaagccgagtgctt

SEQ ID NO: 5596 - DNA, 20 bp, Artificial Sequence
  Description of Artificial Sequence:  Hypothetical Probe Sequence
tcccctgtcttgagccccat

SEQ ID NO: 5597 - DNA, 20 bp, Artificial Sequence
  Description of Artificial Sequence:  Hypothetical Probe Sequence
tcccacgggcaattgaatcg

SEQ ID NO: 5598 - DNA, 20 bp, Artificial Sequence
  Description of Artificial Sequence:  Hypothetical Probe Sequence
tgcgtgtccagcgtgctccc

SEQ ID NO: 5599 - DNA, 20 bp, Artificial Sequence
  Description of Artificial Sequence:  Hypothetical Probe Sequence
tgcgtcgtttgacagccagc

SEQ ID NO: 5600 - DNA, 20 bp, Artificial Sequence
  Description of Artificial Sequence:  Hypothetical Probe Sequence
tgcgtgcgccattctgctgt

SEQ ID NO: 5601 - DNA, 20 bp, Artificial Sequence
  Description of Artificial Sequence:  Hypothetical Probe Sequence
cttgtgcgcagcagtgcacg

SEQ ID NO: 5602 - DNA, 20 bp, Artificial Sequence
  Description of Artificial Sequence:  Hypothetical Probe Sequence
cacgaatctctggaccgtgc

SEQ ID NO: 5603 - DNA, 20 bp, Artificial Sequence
  Description of Artificial Sequence:  Hypothetical Probe Sequence
cttgcacgcttgttgagcaa

SEQ ID NO: 5604 - DNA, 20 bp, Artificial Sequence
  Description of Artificial Sequence:  Hypothetical Probe Sequence
cttgcacgagtggcaaagcc

SEQ ID NO: 5605 - DNA, 20 bp, Artificial Sequence
  Description of Artificial Sequence:  Hypothetical Probe Sequence
cacgaggacctacacgccat

SEQ ID NO: 5606 - DNA, 20 bp, Artificial Sequence
  Description of Artificial Sequence:  Hypothetical Probe Sequence
cttgcagctgatacgggcaa

SEQ ID NO: 5607 - DNA, 20 bp, Artificial Sequence
  Description of Artificial Sequence:  Hypothetical Probe Sequence
cagcaatcgtgcatcgagcc

SEQ ID NO: 5608 - DNA, 20 bp, Artificial Sequence
  Description of Artificial Sequence:  Hypothetical Probe Sequence
cagcctcaggtatcccccat

SEQ ID NO: 5609 - DNA, 20 bp, Artificial Sequence
  Description of Artificial Sequence:  Hypothetical Probe Sequence
cttgcagcggtaatcgtgcg

SEQ ID NO: 5610 - DNA, 20 bp, Artificial Sequence
  Description of Artificial Sequence:  Hypothetical Probe Sequence
cagcgtctaaagacggctca

SEQ ID NO: 5611 - DNA, 20 bp, Artificial Sequence
  Description of Artificial Sequence:  Hypothetical Probe Sequence
cagcgacctacagtgccagc

SEQ ID NO: 5612 - DNA, 20 bp, Artificial Sequence
  Description of Artificial Sequence:  Hypothetical Probe Sequence
gaccttgagaccacgggcaa

SEQ ID NO: 5613 - DNA, 20 bp, Artificial Sequence
  Description of Artificial Sequence:  Hypothetical Probe Sequence
gaccaggacctaacggacgg

SEQ ID NO: 5614 - DNA, 20 bp, Artificial Sequence
  Description of Artificial Sequence:  Hypothetical Probe Sequence
gaccggaccctagatgccat

SEQ ID NO: 5615 - DNA, 20 bp, Artificial Sequence
  Description of Artificial Sequence:  Hypothetical Probe Sequence
cttggtgcggtactcaagcc

SEQ ID NO: 5616 - DNA, 20 bp, Artificial Sequence
  Description of Artificial Sequence:  Hypothetical Probe Sequence
gtgcgtcttcgtgtgccgaa

SEQ ID NO: 5617 - DNA, 20 bp, Artificial Sequence
  Description of Artificial Sequence:  Hypothetical Probe Sequence
gtgcgagtaatcgacccgtt

SEQ ID NO: 5618 - DNA, 20 bp, Artificial Sequence
  Description of Artificial Sequence:  Hypothetical Probe Sequence
cttggtgcggactctgtgcg

SEQ ID NO: 5619 - DNA, 20 bp, Artificial Sequence
  Description of Artificial Sequence:  Hypothetical Probe Sequence
ggacatcgaggagcttgcaa

SEQ ID NO: 5620 - DNA, 20 bp, Artificial Sequence
  Description of Artificial Sequence:  Hypothetical Probe Sequence
cttgggacgacccgttgctt

SEQ ID NO: 5621 - DNA, 20 bp, Artificial Sequence
  Description of Artificial Sequence:  Hypothetical Probe Sequence
acgggagtagccacggggta

SEQ ID NO: 5622 - DNA, 20 bp, Artificial Sequence
  Description of Artificial Sequence:  Hypothetical Probe Sequence
acggacctcacggaccctgt

SEQ ID NO: 5623 - DNA, 20 bp, Artificial Sequence
  Description of Artificial Sequence:  Hypothetical Probe Sequence
acggaggatcgtagccggac

SEQ ID NO: 5624 - DNA, 20 bp, Artificial Sequence
  Description of Artificial Sequence:  Hypothetical Probe Sequence
acgggatgggtaaggatgcg

SEQ ID NO: 5625 - DNA, 20 bp, Artificial Sequence
  Description of Artificial Sequence:  Hypothetical Probe Sequence
agccttgactcatcccgcaa

SEQ ID NO: 5626 - DNA, 20 bp, Artificial Sequence
  Description of Artificial Sequence:  Hypothetical Probe Sequence
agcctgatagcctgcgacgg

SEQ ID NO: 5627 - DNA, 20 bp, Artificial Sequence
  Description of Artificial Sequence:  Hypothetical Probe Sequence
agccgagtgtgctgattgcg

SEQ ID NO: 5628 - DNA, 20 bp, Artificial Sequence
  Description of Artificial Sequence:  Hypothetical Probe Sequence
agcctccctgatccatacgg

SEQ ID NO: 5629 - DNA, 20 bp, Artificial Sequence
  Description of Artificial Sequence:  Hypothetical Probe Sequence
agcccagcggactacatgcg

SEQ ID NO: 5630 - DNA, 20 bp, Artificial Sequence
  Description of Artificial Sequence:  Hypothetical Probe Sequence
agccggacgagttcgtagcc

SEQ ID NO: 5631 - DNA, 20 bp, Artificial Sequence
  Description of Artificial Sequence:  Hypothetical Probe Sequence
ttgaatcgggacgtgcagga

SEQ ID NO: 5632 - DNA, 20 bp, Artificial Sequence
  Description of Artificial Sequence:  Hypothetical Probe Sequence
tgatcacgctcatgcgcagc

SEQ ID NO: 5633 - DNA, 20 bp, Artificial Sequence
  Description of Artificial Sequence:  Hypothetical Probe Sequence
ttaggcaagatgggaccgtt

SEQ ID NO: 5634 - DNA, 20 bp, Artificial Sequence
  Description of Artificial Sequence:  Hypothetical Probe Sequence
aatcgcaagctttgtcgtgc

SEQ ID NO: 5635 - DNA, 20 bp, Artificial Sequence
  Description of Artificial Sequence:  Hypothetical Probe Sequence
aatctccccacgtcccgtgc

SEQ ID NO: 5636 - DNA, 20 bp, Artificial Sequence
  Description of Artificial Sequence:  Hypothetical Probe Sequence
aatccacgctcaagccagcc

SEQ ID NO: 5637 - DNA, 20 bp, Artificial Sequence
  Description of Artificial Sequence:  Hypothetical Probe Sequence
aaagccattcccaaagcacg

SEQ ID NO: 5638 - DNA, 20 bp, Artificial Sequence
  Description of Artificial Sequence:  Hypothetical Probe Sequence
tctgcgttggtaaggagcaa

SEQ ID NO: 5639 - DNA, 20 bp, Artificial Sequence
  Description of Artificial Sequence:  Hypothetical Probe Sequence
tctggcaattagcttgcgaa

SEQ ID NO: 5640 - DNA, 20 bp, Artificial Sequence
  Description of Artificial Sequence:  Hypothetical Probe Sequence
tctgggacaatcgcaatccc

SEQ ID NO: 5641 - DNA, 20 bp, Artificial Sequence
  Description of Artificial Sequence:  Hypothetical Probe Sequence
cgtttctgagccggacagcc

SEQ ID NO: 5642 - DNA, 20 bp, Artificial Sequence
  Description of Artificial Sequence:  Hypothetical Probe Sequence
tgtcccatcacgtgtctgcg

SEQ ID NO: 5643 - DNA, 20 bp, Artificial Sequence
  Description of Artificial Sequence:  Hypothetical Probe Sequence
tgtcgtcttgcgggtatgcg

SEQ ID NO: 5644 - DNA, 20 bp, Artificial Sequence
  Description of Artificial Sequence:  Hypothetical Probe Sequence
tgtcatcgcgttcacgtccc

SEQ ID NO: 5645 - DNA, 20 bp, Artificial Sequence
  Description of Artificial Sequence:  Hypothetical Probe Sequence
tgtcgatgccataccttgcg

SEQ ID NO: 5646 - DNA, 20 bp, Artificial Sequence
  Description of Artificial Sequence:  Hypothetical Probe Sequence
cgtttcgtaaagcgaatgcg

SEQ ID NO: 5647 - DNA, 20 bp, Artificial Sequence
  Description of Artificial Sequence:  Hypothetical Probe Sequence
cgtttcgtggtaacggcgtt

SEQ ID NO: 5648 - DNA, 20 bp, Artificial Sequence
  Description of Artificial Sequence:  Hypothetical Probe Sequence
tcgtacggaaagcttgccat

SEQ ID NO: 5649 - DNA, 20 bp, Artificial Sequence
  Description of Artificial Sequence:  Hypothetical Probe Sequence
cttgcagccgttccatgcaa

SEQ ID NO: 5650 - DNA, 20 bp, Artificial Sequence
  Description of Artificial Sequence:  Hypothetical Probe Sequence
cgttttgagcaatcccatcg

SEQ ID NO: 5651 - DNA, 20 bp, Artificial Sequence
  Description of Artificial Sequence:  Hypothetical Probe Sequence
cgttaaagacggtcccgtgc

SEQ ID NO: 5652 - DNA, 20 bp, Artificial Sequence
  Description of Artificial Sequence:  Hypothetical Probe Sequence
cgttcgaaaaagaggatgcg

SEQ ID NO: 5653 - DNA, 20 bp, Artificial Sequence
  Description of Artificial Sequence:  Hypothetical Probe Sequence
cgttcgttgtcttgcgtgcg

SEQ ID NO: 5654 - DNA, 20 bp, Artificial Sequence
  Description of Artificial Sequence:  Hypothetical Probe Sequence
ctcaatcggacccacgcgaa

SEQ ID NO: 5655 - DNA, 20 bp, Artificial Sequence
  Description of Artificial Sequence:  Hypothetical Probe Sequence
cgttctcaacgggacccttg

SEQ ID NO: 5656 - DNA, 20 bp, Artificial Sequence
  Description of Artificial Sequence:  Hypothetical Probe Sequence
ctgttcgtaggaacggacgg

SEQ ID NO: 5657 - DNA, 20 bp, Artificial Sequence
  Description of Artificial Sequence:  Hypothetical Probe Sequence
ccattgtcgaccagcccagc

SEQ ID NO: 5658 - DNA, 20 bp, Artificial Sequence
  Description of Artificial Sequence:  Hypothetical Probe Sequence
ccatccatcgaactgttgcg

SEQ ID NO: 5659 - DNA, 20 bp, Artificial Sequence
  Description of Artificial Sequence:  Hypothetical Probe Sequence
cgttccatatcgccattgcg

SEQ ID NO: 5660 - DNA, 20 bp, Artificial Sequence
  Description of Artificial Sequence:  Hypothetical Probe Sequence
ccatgatgtgatcagcgcaa

SEQ ID NO: 5661 - DNA, 20 bp, Artificial Sequence
  Description of Artificial Sequence:  Hypothetical Probe Sequence
ccatgaccaatcgatgcgaa

SEQ ID NO: 5662 - DNA, 20 bp, Artificial Sequence
  Description of Artificial Sequence:  Hypothetical Probe Sequence
cgttccatggacgcaaacct

SEQ ID NO: 5663 - DNA, 20 bp, Artificial Sequence
  Description of Artificial Sequence:  Hypothetical Probe Sequence
cgttccatacggagcctctg

SEQ ID NO: 5664 - DNA, 20 bp, Artificial Sequence
  Description of Artificial Sequence:  Hypothetical Probe Sequence
cgttcgaatcgtagccgatg

SEQ ID NO: 5665 - DNA, 20 bp, Artificial Sequence
  Description of Artificial Sequence:  Hypothetical Probe Sequence
cgaacttgcacggcttgacc

SEQ ID NO: 5666 - DNA, 20 bp, Artificial Sequence
  Description of Artificial Sequence:  Hypothetical Probe Sequence
cgaactcagatgtcccgtgc

SEQ ID NO: 5667 - DNA, 20 bp, Artificial Sequence
  Description of Artificial Sequence:  Hypothetical Probe Sequence
cgttcgaagagttgcggctt

SEQ ID NO: 5668 - DNA, 20 bp, Artificial Sequence
  Description of Artificial Sequence:  Hypothetical Probe Sequence
cgaaatcgtacaacggagcc

SEQ ID NO: 5669 - DNA, 20 bp, Artificial Sequence
  Description of Artificial Sequence:  Hypothetical Probe Sequence
cgttcgaagaccgacccacg

SEQ ID NO: 5670 - DNA, 20 bp, Artificial Sequence
  Description of Artificial Sequence:  Hypothetical Probe Sequence
gcttgtctacggggacgacc

SEQ ID NO: 5671 - DNA, 20 bp, Artificial Sequence
  Description of Artificial Sequence:  Hypothetical Probe Sequence
gtctcgttatcggtcttgcg

SEQ ID NO: 5672 - DNA, 20 bp, Artificial Sequence
  Description of Artificial Sequence:  Hypothetical Probe Sequence
gagttcgtgcaaacgggcaa

SEQ ID NO: 5673 - DNA, 20 bp, Artificial Sequence
  Description of Artificial Sequence:  Hypothetical Probe Sequence
gagtcagccgaacgtttccc

SEQ ID NO: 5674 - DNA, 20 bp, Artificial Sequence
  Description of Artificial Sequence:  Hypothetical Probe Sequence
cgttgagtggacgatgcagc

SEQ ID NO: 5675 - DNA, 20 bp, Artificial Sequence
  Description of Artificial Sequence:  Hypothetical Probe Sequence
cgttgcaatgatgctttgcg

SEQ ID NO: 5676 - DNA, 20 bp, Artificial Sequence
  Description of Artificial Sequence:  Hypothetical Probe Sequence
gcaacgaacgaaaatcgacc

SEQ ID NO: 5677 - DNA, 20 bp, Artificial Sequence
  Description of Artificial Sequence:  Hypothetical Probe Sequence
gcaaggtagacctgcggacc

SEQ ID NO: 5678 - DNA, 20 bp, Artificial Sequence
  Description of Artificial Sequence:  Hypothetical Probe Sequence
gcaagagtaaagtgcgcgtt

SEQ ID NO: 5679 - DNA, 20 bp, Artificial Sequence
  Description of Artificial Sequence:  Hypothetical Probe Sequence
gcaaacctcctagcaaacgg

SEQ ID NO: 5680 - DNA, 20 bp, Artificial Sequence
  Description of Artificial Sequence:  Hypothetical Probe Sequence
cgttgcaacagcacctctgt

SEQ ID NO: 5681 - DNA, 20 bp, Artificial Sequence
  Description of Artificial Sequence:  Hypothetical Probe Sequence
cgttgcaaagccgctttaca

SEQ ID NO: 5682 - DNA, 20 bp, Artificial Sequence
  Description of Artificial Sequence:  Hypothetical Probe Sequence
agtgcacgggacaccttccc

SEQ ID NO: 5683 - DNA, 20 bp, Artificial Sequence
  Description of Artificial Sequence:  Hypothetical Probe Sequence
agtgcagccagcggacgctt

SEQ ID NO: 5684 - DNA, 20 bp, Artificial Sequence
  Description of Artificial Sequence:  Hypothetical Probe Sequence
agtggtgccacggacccgaa

SEQ ID NO: 5685 - DNA, 20 bp, Artificial Sequence
  Description of Artificial Sequence:  Hypothetical Probe Sequence
acctgacctgcgcgttgcaa

SEQ ID NO: 5686 - DNA, 20 bp, Artificial Sequence
  Description of Artificial Sequence:  Hypothetical Probe Sequence
atcgctgtcagcgtgcccat

SEQ ID NO: 5687 - DNA, 20 bp, Artificial Sequence
  Description of Artificial Sequence:  Hypothetical Probe Sequence
atcgggtatcgtgacccgaa

SEQ ID NO: 5688 - DNA, 20 bp, Artificial Sequence
  Description of Artificial Sequence:  Hypothetical Probe Sequence
atcggacctctgggacgctt

SEQ ID NO: 5689 - DNA, 20 bp, Artificial Sequence
  Description of Artificial Sequence:  Hypothetical Probe Sequence
aggatgcgtacagtgcgtgc

SEQ ID NO: 5690 - DNA, 20 bp, Artificial Sequence
  Description of Artificial Sequence:  Hypothetical Probe Sequence
aggaagccggtaggactgcg

SEQ ID NO: 5691 - DNA, 20 bp, Artificial Sequence
  Description of Artificial Sequence:  Hypothetical Probe Sequence
gatgcgttaatcggactccc

SEQ ID NO: 5692 - DNA, 20 bp, Artificial Sequence
  Description of Artificial Sequence:  Hypothetical Probe Sequence
cgttgatggaccgtgcccta

SEQ ID NO: 5693 - DNA, 20 bp, Artificial Sequence
  Description of Artificial Sequence:  Hypothetical Probe Sequence
cgttgatgggacgacccacg

SEQ ID NO: 5694 - DNA, 20 bp, Artificial Sequence
  Description of Artificial Sequence:  Hypothetical Probe Sequence
tcccagtgggtacacggtgc

SEQ ID NO: 5695 - DNA, 20 bp, Artificial Sequence
  Description of Artificial Sequence:  Hypothetical Probe Sequence
tccccctaaatcccatcagc

SEQ ID NO: 5696 - DNA, 20 bp, Artificial Sequence
  Description of Artificial Sequence:  Hypothetical Probe Sequence
cgtttccctccctcgtcgaa

SEQ ID NO: 5697 - DNA, 20 bp, Artificial Sequence
  Description of Artificial Sequence:  Hypothetical Probe Sequence
tccctgcgccatggtacgaa

SEQ ID NO: 5698 - DNA, 20 bp, Artificial Sequence
  Description of Artificial Sequence:  Hypothetical Probe Sequence
tgcgatacagcctcccctca

SEQ ID NO: 5699 - DNA, 20 bp, Artificial Sequence
  Description of Artificial Sequence:  Hypothetical Probe Sequence
tgcgcgaatgcgttagcttg

SEQ ID NO: 5700 - DNA, 20 bp, Artificial Sequence
  Description of Artificial Sequence:  Hypothetical Probe Sequence
cgtttgcggcttgtgcctca

SEQ ID NO: 5701 - DNA, 20 bp, Artificial Sequence
  Description of Artificial Sequence:  Hypothetical Probe Sequence
tgcggtcttacacacgcgaa

SEQ ID NO: 5702 - DNA, 20 bp, Artificial Sequence
  Description of Artificial Sequence:  Hypothetical Probe Sequence
tgcgaggaatcgttagcgaa

SEQ ID NO: 5703 - DNA, 20 bp, Artificial Sequence
  Description of Artificial Sequence:  Hypothetical Probe Sequence
cgtttgcggatgccatgctt

SEQ ID NO: 5704 - DNA, 20 bp, Artificial Sequence
  Description of Artificial Sequence:  Hypothetical Probe Sequence
tgcgtcccttgagcttcagc

SEQ ID NO: 5705 - DNA, 20 bp, Artificial Sequence
  Description of Artificial Sequence:  Hypothetical Probe Sequence
cgtttgcgcacgcgttgctt

SEQ ID NO: 5706 - DNA, 20 bp, Artificial Sequence
  Description of Artificial Sequence:  Hypothetical Probe Sequence
cacgtcgttgtccagcggta

SEQ ID NO: 5707 - DNA, 20 bp, Artificial Sequence
  Description of Artificial Sequence:  Hypothetical Probe Sequence
cacgcttgtgatccatcgaa

SEQ ID NO: 5708 - DNA, 20 bp, Artificial Sequence
  Description of Artificial Sequence:  Hypothetical Probe Sequence
cgttcacgctgtcttgtgcg

SEQ ID NO: 5709 - DNA, 20 bp, Artificial Sequence
  Description of Artificial Sequence:  Hypothetical Probe Sequence
cacggatgttagcgaatccc

SEQ ID NO: 5710 - DNA, 20 bp, Artificial Sequence
  Description of Artificial Sequence:  Hypothetical Probe Sequence
cgttcacgcagcgcaatcgt

SEQ ID NO: 5711 - DNA, 20 bp, Artificial Sequence
  Description of Artificial Sequence:  Hypothetical Probe Sequence
cacggaccaaagttagtgcg

SEQ ID NO: 5712 - DNA, 20 bp, Artificial Sequence
  Description of Artificial Sequence:  Hypothetical Probe Sequence
cgttcacgacgggtctgcaa

SEQ ID NO: 5713 - DNA, 20 bp, Artificial Sequence
  Description of Artificial Sequence:  Hypothetical Probe Sequence
cgttcacgagcctcgtcacg

SEQ ID NO: 5714 - DNA, 20 bp, Artificial Sequence
  Description of Artificial Sequence:  Hypothetical Probe Sequence
cagctctggaccaaagctca

SEQ ID NO: 5715 - DNA, 20 bp, Artificial Sequence
  Description of Artificial Sequence:  Hypothetical Probe Sequence
cgttcagcgcttcgtttctg

SEQ ID NO: 5716 - DNA, 20 bp, Artificial Sequence
  Description of Artificial Sequence:  Hypothetical Probe Sequence
cgttcagccacgcagcagga

SEQ ID NO: 5717 - DNA, 20 bp, Artificial Sequence
  Description of Artificial Sequence:  Hypothetical Probe Sequence
cagcgtgcttgaaatcgtgc

SEQ ID NO: 5718 - DNA, 20 bp, Artificial Sequence
  Description of Artificial Sequence:  Hypothetical Probe Sequence
cgttgacctctgtccccagc

SEQ ID NO: 5719 - DNA, 20 bp, Artificial Sequence
  Description of Artificial Sequence:  Hypothetical Probe Sequence
cgttgaccctgtcgaacgaa

SEQ ID NO: 5720 - DNA, 20 bp, Artificial Sequence
  Description of Artificial Sequence:  Hypothetical Probe Sequence
cgttgaccatcgttagcacg

SEQ ID NO: 5721 - DNA, 20 bp, Artificial Sequence
  Description of Artificial Sequence:  Hypothetical Probe Sequence
gacctgcgctcaggtaagcc

SEQ ID NO: 5722 - DNA, 20 bp, Artificial Sequence
  Description of Artificial Sequence:  Hypothetical Probe Sequence
cgttgacccagctcccgtct

SEQ ID NO: 5723 - DNA, 20 bp, Artificial Sequence
  Description of Artificial Sequence:  Hypothetical Probe Sequence
gtgctgtccttgcagctgcg

SEQ ID NO: 5724 - DNA, 20 bp, Artificial Sequence
  Description of Artificial Sequence:  Hypothetical Probe Sequence
gtgccttgtacacagcgacc

SEQ ID NO: 5725 - DNA, 20 bp, Artificial Sequence
  Description of Artificial Sequence:  Hypothetical Probe Sequence
gtgcctcaaaagtccccagc

SEQ ID NO: 5726 - DNA, 20 bp, Artificial Sequence
  Description of Artificial Sequence:  Hypothetical Probe Sequence
cgttgtgcgatgtgtcgctt

SEQ ID NO: 5727 - DNA, 20 bp, Artificial Sequence
  Description of Artificial Sequence:  Hypothetical Probe Sequence
gtgcgaccgtctatcgtgcg

SEQ ID NO: 5728 - DNA, 20 bp, Artificial Sequence
  Description of Artificial Sequence:  Hypothetical Probe Sequence
cgttggaccgttggaccgaa

SEQ ID NO: 5729 - DNA, 20 bp, Artificial Sequence
  Description of Artificial Sequence:  Hypothetical Probe Sequence
ggacggtacgaagcttcacg

SEQ ID NO: 5730 - DNA, 20 bp, Artificial Sequence
  Description of Artificial Sequence:  Hypothetical Probe Sequence
ggacaggatgtcacggcagc

SEQ ID NO: 5731 - DNA, 20 bp, Artificial Sequence
  Description of Artificial Sequence:  Hypothetical Probe Sequence
ggacggacttgaagtgtgcg

SEQ ID NO: 5732 - DNA, 20 bp, Artificial Sequence
  Description of Artificial Sequence:  Hypothetical Probe Sequence
ggacacggccatctgtgcaa

SEQ ID NO: 5733 - DNA, 20 bp, Artificial Sequence
  Description of Artificial Sequence:  Hypothetical Probe Sequence
acggttgaacctggacgtgc

SEQ ID NO: 5734 - DNA, 20 bp, Artificial Sequence
  Description of Artificial Sequence:  Hypothetical Probe Sequence
acggaatccttgcacgctca

SEQ ID NO: 5735 - DNA, 20 bp, Artificial Sequence
  Description of Artificial Sequence:  Hypothetical Probe Sequence
acggaaaggaccgaccatcg

SEQ ID NO: 5736 - DNA, 20 bp, Artificial Sequence
  Description of Artificial Sequence:  Hypothetical Probe Sequence
acggtctggaccgcaaggac

SEQ ID NO: 5737 - DNA, 20 bp, Artificial Sequence
  Description of Artificial Sequence:  Hypothetical Probe Sequence
acggctgtcttgtcccgacc

SEQ ID NO: 5738 - DNA, 20 bp, Artificial Sequence
  Description of Artificial Sequence:  Hypothetical Probe Sequence
acgggagtttgattgatgcg

SEQ ID NO: 5739 - DNA, 20 bp, Artificial Sequence
  Description of Artificial Sequence:  Hypothetical Probe Sequence
acgggatgcagcagtgcgaa

SEQ ID NO: 5740 - DNA, 20 bp, Artificial Sequence
  Description of Artificial Sequence:  Hypothetical Probe Sequence
agccttgagtgccttgcacg

SEQ ID NO: 5741 - DNA, 20 bp, Artificial Sequence
  Description of Artificial Sequence:  Hypothetical Probe Sequence
agcctgattgcgcagccttg

SEQ ID NO: 5742 - DNA, 20 bp, Artificial Sequence
  Description of Artificial Sequence:  Hypothetical Probe Sequence
agccgacctgtcatcgcttg

SEQ ID NO: 5743 - DNA, 20 bp, Artificial Sequence
  Description of Artificial Sequence:  Hypothetical Probe Sequence
agccacggctcaaatcgacc

SEQ ID NO: 5744 - DNA, 20 bp, Artificial Sequence
  Description of Artificial Sequence:  Hypothetical Probe Sequence
ttgaagcctcgtacggtgcg

SEQ ID NO: 5745 - DNA, 20 bp, Artificial Sequence
  Description of Artificial Sequence:  Hypothetical Probe Sequence
aatcgcttcagcagcctgcg

SEQ ID NO: 5746 - DNA, 20 bp, Artificial Sequence
  Description of Artificial Sequence:  Hypothetical Probe Sequence
aaagcgttgtgccagcagcc

SEQ ID NO: 5747 - DNA, 20 bp, Artificial Sequence
  Description of Artificial Sequence:  Hypothetical Probe Sequence
tgtctgcgcagctgcggtct

SEQ ID NO: 5748 - DNA, 20 bp, Artificial Sequence
  Description of Artificial Sequence:  Hypothetical Probe Sequence
tcgtcacgggactgcggcaa

SEQ ID NO: 5749 - DNA, 20 bp, Artificial Sequence
  Description of Artificial Sequence:  Hypothetical Probe Sequence
tcgtagccaggagtgccgaa

SEQ ID NO: 5750 - DNA, 20 bp, Artificial Sequence
  Description of Artificial Sequence:  Hypothetical Probe Sequence
cttgagtgcgttcgtttgcg

SEQ ID NO: 5751 - DNA, 20 bp, Artificial Sequence
  Description of Artificial Sequence:  Hypothetical Probe Sequence
cgtttcgtgacctgtctgcg

SEQ ID NO: 5752 - DNA, 20 bp, Artificial Sequence
  Description of Artificial Sequence:  Hypothetical Probe Sequence
cgttacggcgaaaggaacgg

SEQ ID NO: 5753 - DNA, 20 bp, Artificial Sequence
  Description of Artificial Sequence:  Hypothetical Probe Sequence
ctcaacggcgaatgcgccat

SEQ ID NO: 5754 - DNA, 20 bp, Artificial Sequence
  Description of Artificial Sequence:  Hypothetical Probe Sequence
ccatgcttggacggacacgg

SEQ ID NO: 5755 - DNA, 20 bp, Artificial Sequence
  Description of Artificial Sequence:  Hypothetical Probe Sequence
ccattgcgaaaggaccctgt

SEQ ID NO: 5756 - DNA, 20 bp, Artificial Sequence
  Description of Artificial Sequence:  Hypothetical Probe Sequence
cgaaatcgatcgcagctgcg

SEQ ID NO: 5757 - DNA, 20 bp, Artificial Sequence
  Description of Artificial Sequence:  Hypothetical Probe Sequence
cgaacacgaggaacggtccc

SEQ ID NO: 5758 - DNA, 20 bp, Artificial Sequence
  Description of Artificial Sequence:  Hypothetical Probe Sequence
cgaacagcacggcacggtgc

SEQ ID NO: 5759 - DNA, 20 bp, Artificial Sequence
  Description of Artificial Sequence:  Hypothetical Probe Sequence
gcaaacggacggaaagggac

SEQ ID NO: 5760 - DNA, 20 bp, Artificial Sequence
  Description of Artificial Sequence:  Hypothetical Probe Sequence
agtggtgccgaagtgctgcg

SEQ ID NO: 5761 - DNA, 20 bp, Artificial Sequence
  Description of Artificial Sequence:  Hypothetical Probe Sequence
acctacggtgcggaccgtgc

SEQ ID NO: 5762 - DNA, 20 bp, Artificial Sequence
  Description of Artificial Sequence:  Hypothetical Probe Sequence
ctcaatcgcttggcaaacgg

SEQ ID NO: 5763 - DNA, 20 bp, Artificial Sequence
  Description of Artificial Sequence:  Hypothetical Probe Sequence
ctcaatcgccatcacgcgtt

SEQ ID NO: 5764 - DNA, 20 bp, Artificial Sequence
  Description of Artificial Sequence:  Hypothetical Probe Sequence
atcgggtagcttcagcgtgc

SEQ ID NO: 5765 - DNA, 20 bp, Artificial Sequence
  Description of Artificial Sequence:  Hypothetical Probe Sequence
atcgacgggtctggacacgg

SEQ ID NO: 5766 - DNA, 20 bp, Artificial Sequence
  Description of Artificial Sequence:  Hypothetical Probe Sequence
aggagcttcagccagccgaa

SEQ ID NO: 5767 - DNA, 20 bp, Artificial Sequence
  Description of Artificial Sequence:  Hypothetical Probe Sequence
aggacacggtgccacgacgg

SEQ ID NO: 5768 - DNA, 20 bp, Artificial Sequence
  Description of Artificial Sequence:  Hypothetical Probe Sequence
tcccgcttgcaaccatgacc

SEQ ID NO: 5769 - DNA, 20 bp, Artificial Sequence
  Description of Artificial Sequence:  Hypothetical Probe Sequence
tgcgaatcatcgcagccacg

SEQ ID NO: 5770 - DNA, 20 bp, Artificial Sequence
  Description of Artificial Sequence:  Hypothetical Probe Sequence
tgcgtctgagcctgcggtct

SEQ ID NO: 5771 - DNA, 20 bp, Artificial Sequence
  Description of Artificial Sequence:  Hypothetical Probe Sequence
tgcgctcaggaccgtttgat

SEQ ID NO: 5772 - DNA, 20 bp, Artificial Sequence
  Description of Artificial Sequence:  Hypothetical Probe Sequence
tgcggtctagcccttgtcgt

SEQ ID NO: 5773 - DNA, 20 bp, Artificial Sequence
  Description of Artificial Sequence:  Hypothetical Probe Sequence
tgcgtccccctacctaacgg

SEQ ID NO: 5774 - DNA, 20 bp, Artificial Sequence
  Description of Artificial Sequence:  Hypothetical Probe Sequence
tgcggaccgcttgacctcgt

SEQ ID NO: 5775 - DNA, 20 bp, Artificial Sequence
  Description of Artificial Sequence:  Hypothetical Probe Sequence
cacgcctaggacacggcagc

SEQ ID NO: 5776 - DNA, 20 bp, Artificial Sequence
  Description of Artificial Sequence:  Hypothetical Probe Sequence
cacgcagcgtgcctcacacg

SEQ ID NO: 5777 - DNA, 20 bp, Artificial Sequence
  Description of Artificial Sequence:  Hypothetical Probe Sequence
cacggaccgtctgcaatgcg

SEQ ID NO: 5778 - DNA, 20 bp, Artificial Sequence
  Description of Artificial Sequence:  Hypothetical Probe Sequence
cagcatcgagccacggcgaa

SEQ ID NO: 5779 - DNA, 20 bp, Artificial Sequence
  Description of Artificial Sequence:  Hypothetical Probe Sequence
cagctgcgggacaggagcaa

SEQ ID NO: 5780 - DNA, 20 bp, Artificial Sequence
  Description of Artificial Sequence:  Hypothetical Probe Sequence
gaccgatggtctccattgcg

SEQ ID NO: 5781 - DNA, 20 bp, Artificial Sequence
  Description of Artificial Sequence:  Hypothetical Probe Sequence
gaccgtgcgagtagcctgcg

SEQ ID NO: 5782 - DNA, 20 bp, Artificial Sequence
  Description of Artificial Sequence:  Hypothetical Probe Sequence
ggacgatgcacgtcccggac

SEQ ID NO: 5783 - DNA, 20 bp, Artificial Sequence
  Description of Artificial Sequence:  Hypothetical Probe Sequence
ggacggacccatagccccat

SEQ ID NO: 5784 - DNA, 20 bp, Artificial Sequence
  Description of Artificial Sequence:  Hypothetical Probe Sequence
acggccataaaggcaagacc

SEQ ID NO: 5785 - DNA, 20 bp, Artificial Sequence
  Description of Artificial Sequence:  Hypothetical Probe Sequence
acgggtctccatttgaagcc

SEQ ID NO: 5786 - DNA, 20 bp, Artificial Sequence
  Description of Artificial Sequence:  Hypothetical Probe Sequence
acggatcggacctgtccacg

SEQ ID NO: 5787 - DNA, 20 bp, Artificial Sequence
  Description of Artificial Sequence:  Hypothetical Probe Sequence
acggaggaaaagtgcggcaa

SEQ ID NO: 5788 - DNA, 20 bp, Artificial Sequence
  Description of Artificial Sequence:  Hypothetical Probe Sequence
acggcctaggacgtgcgtct

SEQ ID NO: 5789 - DNA, 20 bp, Artificial Sequence
  Description of Artificial Sequence:  Hypothetical Probe Sequence
agccttgaaatcacggcgtt

SEQ ID NO: 5790 - DNA, 20 bp, Artificial Sequence
  Description of Artificial Sequence:  Hypothetical Probe Sequence
agcctctgagcccgttccat

SEQ ID NO: 5791 - DNA, 20 bp, Artificial Sequence
  Description of Artificial Sequence:  Hypothetical Probe Sequence
ctcaagcccgttggactccc

SEQ ID NO: 5792 - DNA, 20 bp, Artificial Sequence
  Description of Artificial Sequence:  Hypothetical Probe Sequence
agccggtacgaaccatagcc

SEQ ID NO: 5793 - DNA, 20 bp, Artificial Sequence
  Description of Artificial Sequence:  Hypothetical Probe Sequence
ctcaagccgatgtccctgcg

SEQ ID NO: 5794 - DNA, 20 bp, Artificial Sequence
  Description of Artificial Sequence:  Hypothetical Probe Sequence
cgttcgttacggcagcggac

SEQ ID NO: 5795 - DNA, 20 bp, Artificial Sequence
  Description of Artificial Sequence:  Hypothetical Probe Sequence
cgttccattccctgcgggac

SEQ ID NO: 5796 - DNA, 20 bp, Artificial Sequence
  Description of Artificial Sequence:  Hypothetical Probe Sequence
cgttcagccctatgcgcagc

SEQ ID NO: 5797 - DNA, 20 bp, Artificial Sequence
  Description of Artificial Sequence:  Hypothetical Probe Sequence
ctgtcgaacgtttgcgcagc

SEQ ID NO: 5798 - DNA, 20 bp, Artificial Sequence
  Description of Artificial Sequence:  Hypothetical Probe Sequence
cgaatccccgttgaccgagt

SEQ ID NO: 5799 - DNA, 20 bp, Artificial Sequence
  Description of Artificial Sequence:  Hypothetical Probe Sequence
gcttgtgcgagtccatcacg

SEQ ID NO: 5800 - DNA, 20 bp, Artificial Sequence
  Description of Artificial Sequence:  Hypothetical Probe Sequence
gcaaccatagccggacgcaa

SEQ ID NO: 5801 - DNA, 20 bp, Artificial Sequence
  Description of Artificial Sequence:  Hypothetical Probe Sequence
gcaacgaatgtcagccacgg

SEQ ID NO: 5802 - DNA, 20 bp, Artificial Sequence
  Description of Artificial Sequence:  Hypothetical Probe Sequence
gcaagcaatctgcagccttg

SEQ ID NO: 5803 - DNA, 20 bp, Artificial Sequence
  Description of Artificial Sequence:  Hypothetical Probe Sequence
gcaagaccgcaaatcgtgcg

SEQ ID NO: 5804 - DNA, 20 bp, Artificial Sequence
  Description of Artificial Sequence:  Hypothetical Probe Sequence
gatgtgcgaatcggacgcaa

SEQ ID NO: 5805 - DNA, 20 bp, Artificial Sequence
  Description of Artificial Sequence:  Hypothetical Probe Sequence
tccccttgaggaccatcacg

SEQ ID NO: 5806 - DNA, 20 bp, Artificial Sequence
  Description of Artificial Sequence:  Hypothetical Probe Sequence
tcccgcttcctagtgcgacc

SEQ ID NO: 5807 - DNA, 20 bp, Artificial Sequence
  Description of Artificial Sequence:  Hypothetical Probe Sequence
tcccagtgcgaatcccggac

SEQ ID NO: 5808 - DNA, 20 bp, Artificial Sequence
  Description of Artificial Sequence:  Hypothetical Probe Sequence
tgcgtgtccacgcctatgcg

SEQ ID NO: 5809 - DNA, 20 bp, Artificial Sequence
  Description of Artificial Sequence:  Hypothetical Probe Sequence
tgcgcgaacttgccatggta

SEQ ID NO: 5810 - DNA, 20 bp, Artificial Sequence
  Description of Artificial Sequence:  Hypothetical Probe Sequence
tgcggctttcgtgcttttga

SEQ ID NO: 5811 - DNA, 20 bp, Artificial Sequence
  Description of Artificial Sequence:  Hypothetical Probe Sequence
tgcggagtccatcagcgctt

SEQ ID NO: 5812 - DNA, 20 bp, Artificial Sequence
  Description of Artificial Sequence:  Hypothetical Probe Sequence
tgcgaggaaaagctgttgcg

SEQ ID NO: 5813 - DNA, 20 bp, Artificial Sequence
  Description of Artificial Sequence:  Hypothetical Probe Sequence
ctgttgcgcagcacggccta

SEQ ID NO: 5814 - DNA, 20 bp, Artificial Sequence
  Description of Artificial Sequence:  Hypothetical Probe Sequence
cacgctgttcccgaccagga

SEQ ID NO: 5815 - DNA, 20 bp, Artificial Sequence
  Description of Artificial Sequence:  Hypothetical Probe Sequence
cacgccataatcgtgccacg

SEQ ID NO: 5816 - DNA, 20 bp, Artificial Sequence
  Description of Artificial Sequence:  Hypothetical Probe Sequence
cacgcgaaatacgcaacgaa

SEQ ID NO: 5817 - DNA, 20 bp, Artificial Sequence
  Description of Artificial Sequence:  Hypothetical Probe Sequence
cacgggtaacggcgaagcaa

SEQ ID NO: 5818 - DNA, 20 bp, Artificial Sequence
  Description of Artificial Sequence:  Hypothetical Probe Sequence
cacggatgggacgcaacagc

SEQ ID NO: 5819 - DNA, 20 bp, Artificial Sequence
  Description of Artificial Sequence:  Hypothetical Probe Sequence
cagcatcgcgttgcaatgcg

SEQ ID NO: 5820 - DNA, 20 bp, Artificial Sequence
  Description of Artificial Sequence:  Hypothetical Probe Sequence
cagcgatgtgcggtgcccat

SEQ ID NO: 5821 - DNA, 20 bp, Artificial Sequence
  Description of Artificial Sequence:  Hypothetical Probe Sequence
cagctgcgagtgagccgtgc

SEQ ID NO: 5822 - DNA, 20 bp, Artificial Sequence
  Description of Artificial Sequence:  Hypothetical Probe Sequence
gaccgcaaatacgaccgtgc

SEQ ID NO: 5823 - DNA, 20 bp, Artificial Sequence
  Description of Artificial Sequence:  Hypothetical Probe Sequence
gacctccccagctgcgtcgt

SEQ ID NO: 5824 - DNA, 20 bp, Artificial Sequence
  Description of Artificial Sequence:  Hypothetical Probe Sequence
ctgtgacctgcgcacgccat

SEQ ID NO: 5825 - DNA, 20 bp, Artificial Sequence
  Description of Artificial Sequence:  Hypothetical Probe Sequence
gacccacgacctacggcttg

SEQ ID NO: 5826 - DNA, 20 bp, Artificial Sequence
  Description of Artificial Sequence:  Hypothetical Probe Sequence
gtgcgcttccatcttgggac

SEQ ID NO: 5827 - DNA, 20 bp, Artificial Sequence
  Description of Artificial Sequence:  Hypothetical Probe Sequence
gtgctgcggatgatcggcaa

SEQ ID NO: 5828 - DNA, 20 bp, Artificial Sequence
  Description of Artificial Sequence:  Hypothetical Probe Sequence
gtgcggactgatcacgtgcg

SEQ ID NO: 5829 - DNA, 20 bp, Artificial Sequence
  Description of Artificial Sequence:  Hypothetical Probe Sequence
ggacggacatacggacgctt

SEQ ID NO: 5830 - DNA, 20 bp, Artificial Sequence
  Description of Artificial Sequence:  Hypothetical Probe Sequence
ggacagccctcacacgtgcg

SEQ ID NO: 5831 - DNA, 20 bp, Artificial Sequence
  Description of Artificial Sequence:  Hypothetical Probe Sequence
acggcttggaccgtgcgatg

SEQ ID NO: 5832 - DNA, 20 bp, Artificial Sequence
  Description of Artificial Sequence:  Hypothetical Probe Sequence
acggacctacgggaccacgg

SEQ ID NO: 5833 - DNA, 20 bp, Artificial Sequence
  Description of Artificial Sequence:  Hypothetical Probe Sequence
agcctcgtgcttcacgcgaa

SEQ ID NO: 5834 - DNA, 20 bp, Artificial Sequence
  Description of Artificial Sequence:  Hypothetical Probe Sequence
agccgcttatcgtgtctgcg

SEQ ID NO: 5835 - DNA, 20 bp, Artificial Sequence
  Description of Artificial Sequence:  Hypothetical Probe Sequence
agccgtcttgcgggacgtgc

SEQ ID NO: 5836 - DNA, 20 bp, Artificial Sequence
  Description of Artificial Sequence:  Hypothetical Probe Sequence
agcctcccaaagctcaacgg

SEQ ID NO: 5837 - DNA, 20 bp, Artificial Sequence
  Description of Artificial Sequence:  Hypothetical Probe Sequence
agccgacctctgcttgcagc

SEQ ID NO: 5838 - DNA, 20 bp, Artificial Sequence
  Description of Artificial Sequence:  Hypothetical Probe Sequence
ttgaggaccgaacacgacgg

SEQ ID NO: 5839 - DNA, 20 bp, Artificial Sequence
  Description of Artificial Sequence:  Hypothetical Probe Sequence
tgatgaccggaccacggcaa

SEQ ID NO: 5840 - DNA, 20 bp, Artificial Sequence
  Description of Artificial Sequence:  Hypothetical Probe Sequence
ttaggaccaaagccattgcg

SEQ ID NO: 5841 - DNA, 20 bp, Artificial Sequence
  Description of Artificial Sequence:  Hypothetical Probe Sequence
aatccgttgcttgtgcccat

SEQ ID NO: 5842 - DNA, 20 bp, Artificial Sequence
  Description of Artificial Sequence:  Hypothetical Probe Sequence
aatctcccccatcacgcgaa

SEQ ID NO: 5843 - DNA, 20 bp, Artificial Sequence
  Description of Artificial Sequence:  Hypothetical Probe Sequence
aatcagcccgaatccctccc

SEQ ID NO: 5844 - DNA, 20 bp, Artificial Sequence
  Description of Artificial Sequence:  Hypothetical Probe Sequence
aaagcttgcagcatcggcaa

SEQ ID NO: 5845 - DNA, 20 bp, Artificial Sequence
  Description of Artificial Sequence:  Hypothetical Probe Sequence
aaagacggcgaagacccgtt

SEQ ID NO: 5846 - DNA, 20 bp, Artificial Sequence
  Description of Artificial Sequence:  Hypothetical Probe Sequence
tctgaggatgcgggacggac

SEQ ID NO: 5847 - DNA, 20 bp, Artificial Sequence
  Description of Artificial Sequence:  Hypothetical Probe Sequence
tctgagcctgtcatcgcgaa

SEQ ID NO: 5848 - DNA, 20 bp, Artificial Sequence
  Description of Artificial Sequence:  Hypothetical Probe Sequence
tgtcatcgccatgaccgtgc

SEQ ID NO: 5849 - DNA, 20 bp, Artificial Sequence
  Description of Artificial Sequence:  Hypothetical Probe Sequence
tgtctgcgccatcgttggac

SEQ ID NO: 5850 - DNA, 20 bp, Artificial Sequence
  Description of Artificial Sequence:  Hypothetical Probe Sequence
tgtcacggccatgatggacc

SEQ ID NO: 5851 - DNA, 20 bp, Artificial Sequence
  Description of Artificial Sequence:  Hypothetical Probe Sequence
tcgtgctttacaagccacgg

SEQ ID NO: 5852 - DNA, 20 bp, Artificial Sequence
  Description of Artificial Sequence:  Hypothetical Probe Sequence
cttgcgaattaggtgctccc

SEQ ID NO: 5853 - DNA, 20 bp, Artificial Sequence
  Description of Artificial Sequence:  Hypothetical Probe Sequence
cgttctcatccctgcgtgcg

SEQ ID NO: 5854 - DNA, 20 bp, Artificial Sequence
  Description of Artificial Sequence:  Hypothetical Probe Sequence
cgttgcaaatacatcgtgcg

SEQ ID NO: 5855 - DNA, 20 bp, Artificial Sequence
  Description of Artificial Sequence:  Hypothetical Probe Sequence
cgttacctagccaccttgcg

SEQ ID NO: 5856 - DNA, 20 bp, Artificial Sequence
  Description of Artificial Sequence:  Hypothetical Probe Sequence
cgttatcgtgcgaaagctca

SEQ ID NO: 5857 - DNA, 20 bp, Artificial Sequence
  Description of Artificial Sequence:  Hypothetical Probe Sequence
cgttgaccgcttaggatgcg

SEQ ID NO: 5858 - DNA, 20 bp, Artificial Sequence
  Description of Artificial Sequence:  Hypothetical Probe Sequence
cgttgtgccctaggacggac

SEQ ID NO: 5859 - DNA, 20 bp, Artificial Sequence
  Description of Artificial Sequence:  Hypothetical Probe Sequence
ccatctcaacggcacgagcc

SEQ ID NO: 5860 - DNA, 20 bp, Artificial Sequence
  Description of Artificial Sequence:  Hypothetical Probe Sequence
ctgttcgtgcaatcgttgcg

SEQ ID NO: 5861 - DNA, 20 bp, Artificial Sequence
  Description of Artificial Sequence:  Hypothetical Probe Sequence
ctgttcccggtacacgtccc

SEQ ID NO: 5862 - DNA, 20 bp, Artificial Sequence
  Description of Artificial Sequence:  Hypothetical Probe Sequence
ctgtgtgcgtgcgatgtgcg

SEQ ID NO: 5863 - DNA, 20 bp, Artificial Sequence
  Description of Artificial Sequence:  Hypothetical Probe Sequence
ccatcctacagctgcgcagc

SEQ ID NO: 5864 - DNA, 20 bp, Artificial Sequence
  Description of Artificial Sequence:  Hypothetical Probe Sequence
ccatccatggacgacctgcg

SEQ ID NO: 5865 - DNA, 20 bp, Artificial Sequence
  Description of Artificial Sequence:  Hypothetical Probe Sequence
cgaatcgtcgttgatggcaa

SEQ ID NO: 5866 - DNA, 20 bp, Artificial Sequence
  Description of Artificial Sequence:  Hypothetical Probe Sequence
cgaacgttcacgagtgcagc

SEQ ID NO: 5867 - DNA, 20 bp, Artificial Sequence
  Description of Artificial Sequence:  Hypothetical Probe Sequence
cgaacgaacctacgaatgcg

SEQ ID NO: 5868 - DNA, 20 bp, Artificial Sequence
  Description of Artificial Sequence:  Hypothetical Probe Sequence
cgaaaccttgtcgaccacgg

SEQ ID NO: 5869 - DNA, 20 bp, Artificial Sequence
  Description of Artificial Sequence:  Hypothetical Probe Sequence
cgaacagcccattcgtcacg

SEQ ID NO: 5870 - DNA, 20 bp, Artificial Sequence
  Description of Artificial Sequence:  Hypothetical Probe Sequence
gcttctcaacggcagcatcg

SEQ ID NO: 5871 - DNA, 20 bp, Artificial Sequence
  Description of Artificial Sequence:  Hypothetical Probe Sequence
gcttaggaaggaatcgcgtt

SEQ ID NO: 5872 - DNA, 20 bp, Artificial Sequence
  Description of Artificial Sequence:  Hypothetical Probe Sequence
gcttcagctacatcccgtgc

SEQ ID NO: 5873 - DNA, 20 bp, Artificial Sequence
  Description of Artificial Sequence:  Hypothetical Probe Sequence
ccatgcttgacccgaagctt

SEQ ID NO: 5874 - DNA, 20 bp, Artificial Sequence
  Description of Artificial Sequence:  Hypothetical Probe Sequence
ccatgcttgtgcgaccgacc

SEQ ID NO: 5875 - DNA, 20 bp, Artificial Sequence
  Description of Artificial Sequence:  Hypothetical Probe Sequence
ggtagcttgcaaatcgcgaa

SEQ ID NO: 5876 - DNA, 20 bp, Artificial Sequence
  Description of Artificial Sequence:  Hypothetical Probe Sequence
ccatggtacagctgcgacgg

SEQ ID NO: 5877 - DNA, 20 bp, Artificial Sequence
  Description of Artificial Sequence:  Hypothetical Probe Sequence
ggtagtgcacggagccgtgc

SEQ ID NO: 5878 - DNA, 20 bp, Artificial Sequence
  Description of Artificial Sequence:  Hypothetical Probe Sequence
gtctcacgtgcgcttgtccc

SEQ ID NO: 5879 - DNA, 20 bp, Artificial Sequence
  Description of Artificial Sequence:  Hypothetical Probe Sequence
ccatgcaatcgtgcaaatcg

SEQ ID NO: 5880 - DNA, 20 bp, Artificial Sequence
  Description of Artificial Sequence:  Hypothetical Probe Sequence
ccatgcaacgaatcccaatc

SEQ ID NO: 5881 - DNA, 20 bp, Artificial Sequence
  Description of Artificial Sequence:  Hypothetical Probe Sequence
gcaagtcttcccagccggac

SEQ ID NO: 5882 - DNA, 20 bp, Artificial Sequence
  Description of Artificial Sequence:  Hypothetical Probe Sequence
gcaagagttccccagccacg

SEQ ID NO: 5883 - DNA, 20 bp, Artificial Sequence
  Description of Artificial Sequence:  Hypothetical Probe Sequence
gcaaatcgttagggacgtgc

SEQ ID NO: 5884 - DNA, 20 bp, Artificial Sequence
  Description of Artificial Sequence:  Hypothetical Probe Sequence
ccatgcaacacgatcgatcg

SEQ ID NO: 5885 - DNA, 20 bp, Artificial Sequence
  Description of Artificial Sequence:  Hypothetical Probe Sequence
ccatgcaagacccgttagcc

SEQ ID NO: 5886 - DNA, 20 bp, Artificial Sequence
  Description of Artificial Sequence:  Hypothetical Probe Sequence
ccatgcaaggacgagttccc

SEQ ID NO: 5887 - DNA, 20 bp, Artificial Sequence
  Description of Artificial Sequence:  Hypothetical Probe Sequence
ccatgcaaagccctcagcaa

SEQ ID NO: 5888 - DNA, 20 bp, Artificial Sequence
  Description of Artificial Sequence:  Hypothetical Probe Sequence
agtggacccttgctgttgcg

SEQ ID NO: 5889 - DNA, 20 bp, Artificial Sequence
  Description of Artificial Sequence:  Hypothetical Probe Sequence
accttcccataccagctgcg

SEQ ID NO: 5890 - DNA, 20 bp, Artificial Sequence
  Description of Artificial Sequence:  Hypothetical Probe Sequence
atcgggtatctggaccacgg

SEQ ID NO: 5891 - DNA, 20 bp, Artificial Sequence
  Description of Artificial Sequence:  Hypothetical Probe Sequence
atcggagtgatgtgcgggac

SEQ ID NO: 5892 - DNA, 20 bp, Artificial Sequence
  Description of Artificial Sequence:  Hypothetical Probe Sequence
atcgtccccgttcacgagga

SEQ ID NO: 5893 - DNA, 20 bp, Artificial Sequence
  Description of Artificial Sequence:  Hypothetical Probe Sequence
aggaaggatccccacgcacg

SEQ ID NO: 5894 - DNA, 20 bp, Artificial Sequence
  Description of Artificial Sequence:  Hypothetical Probe Sequence
ccatgatgcgttcagcgtct

SEQ ID NO: 5895 - DNA, 20 bp, Artificial Sequence
  Description of Artificial Sequence:  Hypothetical Probe Sequence
gatgatcggatggtgcacgg

SEQ ID NO: 5896 - DNA, 20 bp, Artificial Sequence
  Description of Artificial Sequence:  Hypothetical Probe Sequence
ccatgatgcctaggacgacc

SEQ ID NO: 5897 - DNA, 20 bp, Artificial Sequence
  Description of Artificial Sequence:  Hypothetical Probe Sequence
ccatgatgtcccgatgcgaa

SEQ ID NO: 5898 - DNA, 20 bp, Artificial Sequence
  Description of Artificial Sequence:  Hypothetical Probe Sequence
ccatgatgcagccacgccat

SEQ ID NO: 5899 - DNA, 20 bp, Artificial Sequence
  Description of Artificial Sequence:  Hypothetical Probe Sequence
tcccttagcgttcagcccat

SEQ ID NO: 5900 - DNA, 20 bp, Artificial Sequence
  Description of Artificial Sequence:  Hypothetical Probe Sequence
ccattcccctcaacgggatg

SEQ ID NO: 5901 - DNA, 20 bp, Artificial Sequence
  Description of Artificial Sequence:  Hypothetical Probe Sequence
tcccacctagtgcacgccat

SEQ ID NO: 5902 - DNA, 20 bp, Artificial Sequence
  Description of Artificial Sequence:  Hypothetical Probe Sequence
tgcgtgataatccttggcaa

SEQ ID NO: 5903 - DNA, 20 bp, Artificial Sequence
  Description of Artificial Sequence:  Hypothetical Probe Sequence
tgcgttagcgtttcccggta

SEQ ID NO: 5904 - DNA, 20 bp, Artificial Sequence
  Description of Artificial Sequence:  Hypothetical Probe Sequence
tgcgtgtcggtaaaagtgcg

SEQ ID NO: 5905 - DNA, 20 bp, Artificial Sequence
  Description of Artificial Sequence:  Hypothetical Probe Sequence
tgcgtcgtaaagtcccatcg

SEQ ID NO: 5906 - DNA, 20 bp, Artificial Sequence
  Description of Artificial Sequence:  Hypothetical Probe Sequence
tgcgaggacacggagtgtgc

SEQ ID NO: 5907 - DNA, 20 bp, Artificial Sequence
  Description of Artificial Sequence:  Hypothetical Probe Sequence
ccattgcgtgcgaatccagc

SEQ ID NO: 5908 - DNA, 20 bp, Artificial Sequence
  Description of Artificial Sequence:  Hypothetical Probe Sequence
tgcgcacggcaagagtcgaa

SEQ ID NO: 5909 - DNA, 20 bp, Artificial Sequence
  Description of Artificial Sequence:  Hypothetical Probe Sequence
tgcggacccacgtctggatg

SEQ ID NO: 5910 - DNA, 20 bp, Artificial Sequence
  Description of Artificial Sequence:  Hypothetical Probe Sequence
ccattgcggtgcggaccgtt

SEQ ID NO: 5911 - DNA, 20 bp, Artificial Sequence
  Description of Artificial Sequence:  Hypothetical Probe Sequence
ccattgcgacggccatatcg

SEQ ID NO: 5912 - DNA, 20 bp, Artificial Sequence
  Description of Artificial Sequence:  Hypothetical Probe Sequence
cacgttgaagcctgcggctt

SEQ ID NO: 5913 - DNA, 20 bp, Artificial Sequence
  Description of Artificial Sequence:  Hypothetical Probe Sequence
cacgtctggcaatcccagcc

SEQ ID NO: 5914 - DNA, 20 bp, Artificial Sequence
  Description of Artificial Sequence:  Hypothetical Probe Sequence
cacgagtgaccttcccccat

SEQ ID NO: 5915 - DNA, 20 bp, Artificial Sequence
  Description of Artificial Sequence:  Hypothetical Probe Sequence
cacgatcggcttttgatgcg

SEQ ID NO: 5916 - DNA, 20 bp, Artificial Sequence
  Description of Artificial Sequence:  Hypothetical Probe Sequence
cacgtgcgaaagatcgagcc

SEQ ID NO: 5917 - DNA, 20 bp, Artificial Sequence
  Description of Artificial Sequence:  Hypothetical Probe Sequence
cacggaccgagtgctttgcg

SEQ ID NO: 5918 - DNA, 20 bp, Artificial Sequence
  Description of Artificial Sequence:  Hypothetical Probe Sequence
cacgagccgatgagtgcacg

SEQ ID NO: 5919 - DNA, 20 bp, Artificial Sequence
  Description of Artificial Sequence:  Hypothetical Probe Sequence
cagcttgatcccccatcagc

SEQ ID NO: 5920 - DNA, 20 bp, Artificial Sequence
  Description of Artificial Sequence:  Hypothetical Probe Sequence
ccatcagccttgggaccgtt

SEQ ID NO: 5921 - DNA, 20 bp, Artificial Sequence
  Description of Artificial Sequence:  Hypothetical Probe Sequence
cagccgttttagtcccccat

SEQ ID NO: 5922 - DNA, 20 bp, Artificial Sequence
  Description of Artificial Sequence:  Hypothetical Probe Sequence
cagcagtggcaagtgcagcc

SEQ ID NO: 5923 - DNA, 20 bp, Artificial Sequence
  Description of Artificial Sequence:  Hypothetical Probe Sequence
cagcacctttagtgcggacc

SEQ ID NO: 5924 - DNA, 20 bp, Artificial Sequence
  Description of Artificial Sequence:  Hypothetical Probe Sequence
ccatcagctcccaggagacc

SEQ ID NO: 5925 - DNA, 20 bp, Artificial Sequence
  Description of Artificial Sequence:  Hypothetical Probe Sequence
gaccgagtaggaacggtgcg

SEQ ID NO: 5926 - DNA, 20 bp, Artificial Sequence
  Description of Artificial Sequence:  Hypothetical Probe Sequence
gaccaggaaatctcccgacc

SEQ ID NO: 5927 - DNA, 20 bp, Artificial Sequence
  Description of Artificial Sequence:  Hypothetical Probe Sequence
gaccgatgcttggcttcgaa

SEQ ID NO: 5928 - DNA, 20 bp, Artificial Sequence
  Description of Artificial Sequence:  Hypothetical Probe Sequence
gacctcccggtagtcttgcg

SEQ ID NO: 5929 - DNA, 20 bp, Artificial Sequence
  Description of Artificial Sequence:  Hypothetical Probe Sequence
ccatgaccagccgagtgcaa

SEQ ID NO: 5930 - DNA, 20 bp, Artificial Sequence
  Description of Artificial Sequence:  Hypothetical Probe Sequence
gtgctgatacctgtgcgcaa

SEQ ID NO: 5931 - DNA, 20 bp, Artificial Sequence
  Description of Artificial Sequence:  Hypothetical Probe Sequence
gtgcaatctgcgacgggacc

SEQ ID NO: 5932 - DNA, 20 bp, Artificial Sequence
  Description of Artificial Sequence:  Hypothetical Probe Sequence
gtgctctgcgttggacgctt

SEQ ID NO: 5933 - DNA, 20 bp, Artificial Sequence
  Description of Artificial Sequence:  Hypothetical Probe Sequence
gtgcctgtcgtttgtcacgg

SEQ ID NO: 5934 - DNA, 20 bp, Artificial Sequence
  Description of Artificial Sequence:  Hypothetical Probe Sequence
gtgcgcttcgttaatcccat

SEQ ID NO: 5935 - DNA, 20 bp, Artificial Sequence
  Description of Artificial Sequence:  Hypothetical Probe Sequence
gtgcatcgggtaaccttccc

SEQ ID NO: 5936 - DNA, 20 bp, Artificial Sequence
  Description of Artificial Sequence:  Hypothetical Probe Sequence
gtgcaggaatactccccgtt

SEQ ID NO: 5937 - DNA, 20 bp, Artificial Sequence
  Description of Artificial Sequence:  Hypothetical Probe Sequence
gtgctgcgggactctggacc

SEQ ID NO: 5938 - DNA, 20 bp, Artificial Sequence
  Description of Artificial Sequence:  Hypothetical Probe Sequence
gtgcgacccctacctatgcg

SEQ ID NO: 5939 - DNA, 20 bp, Artificial Sequence
  Description of Artificial Sequence:  Hypothetical Probe Sequence
ccatgtgcagcccacgaaag

SEQ ID NO: 5940 - DNA, 20 bp, Artificial Sequence
  Description of Artificial Sequence:  Hypothetical Probe Sequence
ccatggacggtactcatgcg

SEQ ID NO: 5941 - DNA, 20 bp, Artificial Sequence
  Description of Artificial Sequence:  Hypothetical Probe Sequence
ccatggacaggacacgagga

SEQ ID NO: 5942 - DNA, 20 bp, Artificial Sequence
  Description of Artificial Sequence:  Hypothetical Probe Sequence
ggaccacggtctcacgggac

SEQ ID NO: 5943 - DNA, 20 bp, Artificial Sequence
  Description of Artificial Sequence:  Hypothetical Probe Sequence
ccatggacgtgccagcttga

SEQ ID NO: 5944 - DNA, 20 bp, Artificial Sequence
  Description of Artificial Sequence:  Hypothetical Probe Sequence
acggaatcgcaatgcgagcc

SEQ ID NO: 5945 - DNA, 20 bp, Artificial Sequence
  Description of Artificial Sequence:  Hypothetical Probe Sequence
acggtctggcaaagccgcaa

SEQ ID NO: 5946 - DNA, 20 bp, Artificial Sequence
  Description of Artificial Sequence:  Hypothetical Probe Sequence
acggcttgcctatcccggta

SEQ ID NO: 5947 - DNA, 20 bp, Artificial Sequence
  Description of Artificial Sequence:  Hypothetical Probe Sequence
acgggcaatctgagtgcacg

SEQ ID NO: 5948 - DNA, 20 bp, Artificial Sequence
  Description of Artificial Sequence:  Hypothetical Probe Sequence
acgggaccctgtagccggta

SEQ ID NO: 5949 - DNA, 20 bp, Artificial Sequence
  Description of Artificial Sequence:  Hypothetical Probe Sequence
acgggtgctcgtccatcgtt

SEQ ID NO: 5950 - DNA, 20 bp, Artificial Sequence
  Description of Artificial Sequence:  Hypothetical Probe Sequence
ccatagccgtgcgcaacgaa

SEQ ID NO: 5951 - DNA, 20 bp, Artificial Sequence
  Description of Artificial Sequence:  Hypothetical Probe Sequence
tgattgcgccattgatgcaa

SEQ ID NO: 5952 - DNA, 20 bp, Artificial Sequence
  Description of Artificial Sequence:  Hypothetical Probe Sequence
tgatcacgctgtacgggcaa

SEQ ID NO: 5953 - DNA, 20 bp, Artificial Sequence
  Description of Artificial Sequence:  Hypothetical Probe Sequence
cgaaaatccacgacggttga

SEQ ID NO: 5954 - DNA, 20 bp, Artificial Sequence
  Description of Artificial Sequence:  Hypothetical Probe Sequence
cgaaaatcgtgcctgttgcg

SEQ ID NO: 5955 - DNA, 20 bp, Artificial Sequence
  Description of Artificial Sequence:  Hypothetical Probe Sequence
cgaaaatcggacttgatgcg

SEQ ID NO: 5956 - DNA, 20 bp, Artificial Sequence
  Description of Artificial Sequence:  Hypothetical Probe Sequence
atacgctttcccgcaatgcg

SEQ ID NO: 5957 - DNA, 20 bp, Artificial Sequence
  Description of Artificial Sequence:  Hypothetical Probe Sequence
aaagcgaaatcgttgatgcg

SEQ ID NO: 5958 - DNA, 20 bp, Artificial Sequence
  Description of Artificial Sequence:  Hypothetical Probe Sequence
cgaaaaagtccctgcggagt

SEQ ID NO: 5959 - DNA, 20 bp, Artificial Sequence
  Description of Artificial Sequence:  Hypothetical Probe Sequence
cgaaaaagcacgaaagccat

SEQ ID NO: 5960 - DNA, 20 bp, Artificial Sequence
  Description of Artificial Sequence:  Hypothetical Probe Sequence
cgaaaaagcagcggacctca

SEQ ID NO: 5961 - DNA, 20 bp, Artificial Sequence
  Description of Artificial Sequence:  Hypothetical Probe Sequence
cgaaaaaggtgccacgcagc

SEQ ID NO: 5962 - DNA, 20 bp, Artificial Sequence
  Description of Artificial Sequence:  Hypothetical Probe Sequence
cgaaaaagagccgtgcctca

SEQ ID NO: 5963 - DNA, 20 bp, Artificial Sequence
  Description of Artificial Sequence:  Hypothetical Probe Sequence
tctgtcgttgcgcgaaagcc

SEQ ID NO: 5964 - DNA, 20 bp, Artificial Sequence
  Description of Artificial Sequence:  Hypothetical Probe Sequence
tctgccataggagaccacgg

SEQ ID NO: 5965 - DNA, 20 bp, Artificial Sequence
  Description of Artificial Sequence:  Hypothetical Probe Sequence
tctgcacgtacacagccacg

SEQ ID NO: 5966 - DNA, 20 bp, Artificial Sequence
  Description of Artificial Sequence:  Hypothetical Probe Sequence
tgtcctcaagccgtgcccat

SEQ ID NO: 5967 - DNA, 20 bp, Artificial Sequence
  Description of Artificial Sequence:  Hypothetical Probe Sequence
tgtcgtctctgttgcgagcc

SEQ ID NO: 5968 - DNA, 20 bp, Artificial Sequence
  Description of Artificial Sequence:  Hypothetical Probe Sequence
cgaatcgtctgtcagcgcaa

SEQ ID NO: 5969 - DNA, 20 bp, Artificial Sequence
  Description of Artificial Sequence:  Hypothetical Probe Sequence
tcgtgcttccatagccatcg

SEQ ID NO: 5970 - DNA, 20 bp, Artificial Sequence
  Description of Artificial Sequence:  Hypothetical Probe Sequence
cttgtcgtgacccagccacg

SEQ ID NO: 5971 - DNA, 20 bp, Artificial Sequence
  Description of Artificial Sequence:  Hypothetical Probe Sequence
cgaacttggcttgacccacg

SEQ ID NO: 5972 - DNA, 20 bp, Artificial Sequence
  Description of Artificial Sequence:  Hypothetical Probe Sequence
cttgcagcagtggatgcgaa

SEQ ID NO: 5973 - DNA, 20 bp, Artificial Sequence
  Description of Artificial Sequence:  Hypothetical Probe Sequence
cgaacttggacccttgtgcg

SEQ ID NO: 5974 - DNA, 20 bp, Artificial Sequence
  Description of Artificial Sequence:  Hypothetical Probe Sequence
cgaacttggtgccagccgtt

SEQ ID NO: 5975 - DNA, 20 bp, Artificial Sequence
  Description of Artificial Sequence:  Hypothetical Probe Sequence
cttgagccgatggagtcacg

SEQ ID NO: 5976 - DNA, 20 bp, Artificial Sequence
  Description of Artificial Sequence:  Hypothetical Probe Sequence
cgaacgttgagtcgaacacg

SEQ ID NO: 5977 - DNA, 20 bp, Artificial Sequence
  Description of Artificial Sequence:  Hypothetical Probe Sequence
cgaacgttgtgctctgcagc

SEQ ID NO: 5978 - DNA, 20 bp, Artificial Sequence
  Description of Artificial Sequence:  Hypothetical Probe Sequence
ctcaccatgcaaacggcgtt

SEQ ID NO: 5979 - DNA, 20 bp, Artificial Sequence
  Description of Artificial Sequence:  Hypothetical Probe Sequence
ctcagctttgcgaggatgcg

SEQ ID NO: 5980 - DNA, 20 bp, Artificial Sequence
  Description of Artificial Sequence:  Hypothetical Probe Sequence
ctcatcccatacgcaagcaa

SEQ ID NO: 5981 - DNA, 20 bp, Artificial Sequence
  Description of Artificial Sequence:  Hypothetical Probe Sequence
ctcacagccagcgcttgtgc

SEQ ID NO: 5982 - DNA, 20 bp, Artificial Sequence
  Description of Artificial Sequence:  Hypothetical Probe Sequence
ccatcgaaccatgaccggac

SEQ ID NO: 5983 - DNA, 20 bp, Artificial Sequence
  Description of Artificial Sequence:  Hypothetical Probe Sequence
ccatatcgagtgcagcggac

SEQ ID NO: 5984 - DNA, 20 bp, Artificial Sequence
  Description of Artificial Sequence:  Hypothetical Probe Sequence
ccatcctaaatccgtttgcg

SEQ ID NO: 5985 - DNA, 20 bp, Artificial Sequence
  Description of Artificial Sequence:  Hypothetical Probe Sequence
ccatcacgttaggcaagcaa

SEQ ID NO: 5986 - DNA, 20 bp, Artificial Sequence
  Description of Artificial Sequence:  Hypothetical Probe Sequence
ccatggacctcatccctccc

SEQ ID NO: 5987 - DNA, 20 bp, Artificial Sequence
  Description of Artificial Sequence:  Hypothetical Probe Sequence
cgaaaaagaccttgcggcaa

SEQ ID NO: 5988 - DNA, 20 bp, Artificial Sequence
  Description of Artificial Sequence:  Hypothetical Probe Sequence
cgaatcgtttagcgttgcaa

SEQ ID NO: 5989 - DNA, 20 bp, Artificial Sequence
  Description of Artificial Sequence:  Hypothetical Probe Sequence
cgaagctttgatcacgcgtt

SEQ ID NO: 5990 - DNA, 20 bp, Artificial Sequence
  Description of Artificial Sequence:  Hypothetical Probe Sequence
gctttacatgcgttgatgcg

SEQ ID NO: 5991 - DNA, 20 bp, Artificial Sequence
  Description of Artificial Sequence:  Hypothetical Probe Sequence
gcttcgttcgaaggacagga

SEQ ID NO: 5992 - DNA, 20 bp, Artificial Sequence
  Description of Artificial Sequence:  Hypothetical Probe Sequence
cgaagcttcgaatcgtgcaa

SEQ ID NO: 5993 - DNA, 20 bp, Artificial Sequence
  Description of Artificial Sequence:  Hypothetical Probe Sequence
cgaagcttgtgcggacaaag

SEQ ID NO: 5994 - DNA, 20 bp, Artificial Sequence
  Description of Artificial Sequence:  Hypothetical Probe Sequence
gagtccatacggtcccagcc

SEQ ID NO: 5995 - DNA, 20 bp, Artificial Sequence
  Description of Artificial Sequence:  Hypothetical Probe Sequence
gcaattgaaccttgcgggac

SEQ ID NO: 5996 - DNA, 20 bp, Artificial Sequence
  Description of Artificial Sequence:  Hypothetical Probe Sequence
gcaaaatcagccacctacgg

SEQ ID NO: 5997 - DNA, 20 bp, Artificial Sequence
  Description of Artificial Sequence:  Hypothetical Probe Sequence
gcaaaaagccatcgtttgcg

SEQ ID NO: 5998 - DNA, 20 bp, Artificial Sequence
  Description of Artificial Sequence:  Hypothetical Probe Sequence
cgaagcaaccatacggcgtt

SEQ ID NO: 5999 - DNA, 20 bp, Artificial Sequence
  Description of Artificial Sequence:  Hypothetical Probe Sequence
gcaagatgagcctgtccacg

SEQ ID NO: 6000 - DNA, 20 bp, Artificial Sequence
  Description of Artificial Sequence:  Hypothetical Probe Sequence
agtgcttggcaacgttcacg

SEQ ID NO: 6001 - DNA, 20 bp, Artificial Sequence
  Description of Artificial Sequence:  Hypothetical Probe Sequence
agtgcgtttgcgtctggtgc

SEQ ID NO: 6002 - DNA, 20 bp, Artificial Sequence
  Description of Artificial Sequence:  Hypothetical Probe Sequence
agtgcgaatgtcagtgcgaa

SEQ ID NO: 6003 - DNA, 20 bp, Artificial Sequence
  Description of Artificial Sequence:  Hypothetical Probe Sequence
agtggcttggactcgttccc

SEQ ID NO: 6004 - DNA, 20 bp, Artificial Sequence
  Description of Artificial Sequence:  Hypothetical Probe Sequence
agtggatggacccagctgcg

SEQ ID NO: 6005 - DNA, 20 bp, Artificial Sequence
  Description of Artificial Sequence:  Hypothetical Probe Sequence
acctgagtacggtgcgcgtt

SEQ ID NO: 6006 - DNA, 20 bp, Artificial Sequence
  Description of Artificial Sequence:  Hypothetical Probe Sequence
acctgcaactgtggtatgcg

SEQ ID NO: 6007 - DNA, 20 bp, Artificial Sequence
  Description of Artificial Sequence:  Hypothetical Probe Sequence
accttgcgggtaacctcgaa

SEQ ID NO: 6008 - DNA, 20 bp, Artificial Sequence
  Description of Artificial Sequence:  Hypothetical Probe Sequence
acctgaccttgatgcgcagc

SEQ ID NO: 6009 - DNA, 20 bp, Artificial Sequence
  Description of Artificial Sequence:  Hypothetical Probe Sequence
acctgtgcgtctgaccggac

SEQ ID NO: 6010 - DNA, 20 bp, Artificial Sequence
  Description of Artificial Sequence:  Hypothetical Probe Sequence
atcggagttctgccattgcg

SEQ ID NO: 6011 - DNA, 20 bp, Artificial Sequence
  Description of Artificial Sequence:  Hypothetical Probe Sequence
aggaagtgcacggatgagcc

SEQ ID NO: 6012 - DNA, 20 bp, Artificial Sequence
  Description of Artificial Sequence:  Hypothetical Probe Sequence
aggatcccggtaggacgacc

SEQ ID NO: 6013 - DNA, 20 bp, Artificial Sequence
  Description of Artificial Sequence:  Hypothetical Probe Sequence
aggaagccagcctgtcgatg

SEQ ID NO: 6014 - DNA, 20 bp, Artificial Sequence
  Description of Artificial Sequence:  Hypothetical Probe Sequence
cctagcaatgtcgcaagcaa

SEQ ID NO: 6015 - DNA, 20 bp, Artificial Sequence
  Description of Artificial Sequence:  Hypothetical Probe Sequence
cctagtgcaatcagccgctt

SEQ ID NO: 6016 - DNA, 20 bp, Artificial Sequence
  Description of Artificial Sequence:  Hypothetical Probe Sequence
gatgtcgttgcgacggtccc

SEQ ID NO: 6017 - DNA, 20 bp, Artificial Sequence
  Description of Artificial Sequence:  Hypothetical Probe Sequence
gatggtctatcgagcccgaa

SEQ ID NO: 6018 - DNA, 20 bp, Artificial Sequence
  Description of Artificial Sequence:  Hypothetical Probe Sequence
gatgtcccctcaagccatcg

SEQ ID NO: 6019 - DNA, 20 bp, Artificial Sequence
  Description of Artificial Sequence:  Hypothetical Probe Sequence
cgaagatgcacgctgtgcaa

SEQ ID NO: 6020 - DNA, 20 bp, Artificial Sequence
  Description of Artificial Sequence:  Hypothetical Probe Sequence
cgaagatgggactcccacgg

SEQ ID NO: 6021 - DNA, 20 bp, Artificial Sequence
  Description of Artificial Sequence:  Hypothetical Probe Sequence
gatgagcctgatgtgcgcaa

SEQ ID NO: 6022 - DNA, 20 bp, Artificial Sequence
  Description of Artificial Sequence:  Hypothetical Probe Sequence
tccctgtccagcaatcgctt

SEQ ID NO: 6023 - DNA, 20 bp, Artificial Sequence
  Description of Artificial Sequence:  Hypothetical Probe Sequence
tcccgatgatacgaccggac

SEQ ID NO: 6024 - DNA, 20 bp, Artificial Sequence
  Description of Artificial Sequence:  Hypothetical Probe Sequence
tccccacgaatcagtgtgcg

SEQ ID NO: 6025 - DNA, 20 bp, Artificial Sequence
  Description of Artificial Sequence:  Hypothetical Probe Sequence
tccccagcgtgctgatcgaa

SEQ ID NO: 6026 - DNA, 20 bp, Artificial Sequence
  Description of Artificial Sequence:  Hypothetical Probe Sequence
cgaatcccacggatcgtcgt

SEQ ID NO: 6027 - DNA, 20 bp, Artificial Sequence
  Description of Artificial Sequence:  Hypothetical Probe Sequence
tgcgtgatcagcaaaggctt

SEQ ID NO: 6028 - DNA, 20 bp, Artificial Sequence
  Description of Artificial Sequence:  Hypothetical Probe Sequence
tgcgtacacagcgtgccagc

SEQ ID NO: 6029 - DNA, 20 bp, Artificial Sequence
  Description of Artificial Sequence:  Hypothetical Probe Sequence
cgaatgcgcgaacagcagga

SEQ ID NO: 6030 - DNA, 20 bp, Artificial Sequence
  Description of Artificial Sequence:  Hypothetical Probe Sequence
tgcgcagctacagacccacg

SEQ ID NO: 6031 - DNA, 20 bp, Artificial Sequence
  Description of Artificial Sequence:  Hypothetical Probe Sequence
cacgtctgtctggtgccgaa

SEQ ID NO: 6032 - DNA, 20 bp, Artificial Sequence
  Description of Artificial Sequence:  Hypothetical Probe Sequence
cacgccattcccaatcccat

SEQ ID NO: 6033 - DNA, 20 bp, Artificial Sequence
  Description of Artificial Sequence:  Hypothetical Probe Sequence
cacggagtttagtccctgcg

SEQ ID NO: 6034 - DNA, 20 bp, Artificial Sequence
  Description of Artificial Sequence:  Hypothetical Probe Sequence
cacgtgcggatggtctgcaa

SEQ ID NO: 6035 - DNA, 20 bp, Artificial Sequence
  Description of Artificial Sequence:  Hypothetical Probe Sequence
cacgcacgcacgttagagcc

SEQ ID NO: 6036 - DNA, 20 bp, Artificial Sequence
  Description of Artificial Sequence:  Hypothetical Probe Sequence
cgaacagcaatcacggacgg

SEQ ID NO: 6037 - DNA, 20 bp, Artificial Sequence
  Description of Artificial Sequence:  Hypothetical Probe Sequence
cagctcgtagtgctgttgcg

SEQ ID NO: 6038 - DNA, 20 bp, Artificial Sequence
  Description of Artificial Sequence:  Hypothetical Probe Sequence
cagccttgccatgcaagcaa

SEQ ID NO: 6039 - DNA, 20 bp, Artificial Sequence
  Description of Artificial Sequence:  Hypothetical Probe Sequence
cgaacagcgagtttgatccc

SEQ ID NO: 6040 - DNA, 20 bp, Artificial Sequence
  Description of Artificial Sequence:  Hypothetical Probe Sequence
cagcagtgttagcagcagcc

SEQ ID NO: 6041 - DNA, 20 bp, Artificial Sequence
  Description of Artificial Sequence:  Hypothetical Probe Sequence
cagcgatgaaaggtgcgatg

SEQ ID NO: 6042 - DNA, 20 bp, Artificial Sequence
  Description of Artificial Sequence:  Hypothetical Probe Sequence
cgaacagccagcgaccggta

SEQ ID NO: 6043 - DNA, 20 bp, Artificial Sequence
  Description of Artificial Sequence:  Hypothetical Probe Sequence
gaccctgtctcagtgcgtgc

SEQ ID NO: 6044 - DNA, 20 bp, Artificial Sequence
  Description of Artificial Sequence:  Hypothetical Probe Sequence
gaccgtctaggatcccctca

SEQ ID NO: 6045 - DNA, 20 bp, Artificial Sequence
  Description of Artificial Sequence:  Hypothetical Probe Sequence
cgaagacctccccctaatcg

SEQ ID NO: 6046 - DNA, 20 bp, Artificial Sequence
  Description of Artificial Sequence:  Hypothetical Probe Sequence
gacctgcgttagctcaagcc

SEQ ID NO: 6047 - DNA, 20 bp, Artificial Sequence
  Description of Artificial Sequence:  Hypothetical Probe Sequence
gtgcggtaaatctcgttgcg

SEQ ID NO: 6048 - DNA, 20 bp, Artificial Sequence
  Description of Artificial Sequence:  Hypothetical Probe Sequence
cgaagtgcaggaagcctcgt

SEQ ID NO: 6049 - DNA, 20 bp, Artificial Sequence
  Description of Artificial Sequence:  Hypothetical Probe Sequence
gtgctccccctagatgcgaa

SEQ ID NO: 6050 - DNA, 20 bp, Artificial Sequence
  Description of Artificial Sequence:  Hypothetical Probe Sequence
cgaagtgcagccgatgggac

SEQ ID NO: 6051 - DNA, 20 bp, Artificial Sequence
  Description of Artificial Sequence:  Hypothetical Probe Sequence
ggacgcttgacctgatgcaa

SEQ ID NO: 6052 - DNA, 20 bp, Artificial Sequence
  Description of Artificial Sequence:  Hypothetical Probe Sequence
ggacaccttctgtcccacgg

SEQ ID NO: 6053 - DNA, 20 bp, Artificial Sequence
  Description of Artificial Sequence:  Hypothetical Probe Sequence
ggacgatggagtacgggctt

SEQ ID NO: 6054 - DNA, 20 bp, Artificial Sequence
  Description of Artificial Sequence:  Hypothetical Probe Sequence
acggtgattccctgtcgacc

SEQ ID NO: 6055 - DNA, 20 bp, Artificial Sequence
  Description of Artificial Sequence:  Hypothetical Probe Sequence
acggtctgcagcaaagtccc

SEQ ID NO: 6056 - DNA, 20 bp, Artificial Sequence
  Description of Artificial Sequence:  Hypothetical Probe Sequence
cgaaacgggagtggacggta

SEQ ID NO: 6057 - DNA, 20 bp, Artificial Sequence
  Description of Artificial Sequence:  Hypothetical Probe Sequence
cgaaacggacctaggacgtt

SEQ ID NO: 6058 - DNA, 20 bp, Artificial Sequence
  Description of Artificial Sequence:  Hypothetical Probe Sequence
acggaggacttgatcgagcc

SEQ ID NO: 6059 - DNA, 20 bp, Artificial Sequence
  Description of Artificial Sequence:  Hypothetical Probe Sequence
cgaaacggcctatcgtgcaa

SEQ ID NO: 6060 - DNA, 20 bp, Artificial Sequence
  Description of Artificial Sequence:  Hypothetical Probe Sequence
cgaaacggtgcgctgttcgt

SEQ ID NO: 6061 - DNA, 20 bp, Artificial Sequence
  Description of Artificial Sequence:  Hypothetical Probe Sequence
cgaaacggacggcacgatcg

SEQ ID NO: 6062 - DNA, 20 bp, Artificial Sequence
  Description of Artificial Sequence:  Hypothetical Probe Sequence
agcctgatcctatcccggac

SEQ ID NO: 6063 - DNA, 20 bp, Artificial Sequence
  Description of Artificial Sequence:  Hypothetical Probe Sequence
cgaaagcctctggcaacgaa

SEQ ID NO: 6064 - DNA, 20 bp, Artificial Sequence
  Description of Artificial Sequence:  Hypothetical Probe Sequence
agccctcaaatcgatgggac

SEQ ID NO: 6065 - DNA, 20 bp, Artificial Sequence
  Description of Artificial Sequence:  Hypothetical Probe Sequence
cgaaagccacctttagcagc

SEQ ID NO: 6066 - DNA, 20 bp, Artificial Sequence
  Description of Artificial Sequence:  Hypothetical Probe Sequence
agccatcggtctgatgcgaa

SEQ ID NO: 6067 - DNA, 20 bp, Artificial Sequence
  Description of Artificial Sequence:  Hypothetical Probe Sequence
agccaggaagtggatggctt

SEQ ID NO: 6068 - DNA, 20 bp, Artificial Sequence
  Description of Artificial Sequence:  Hypothetical Probe Sequence
cgaaagccgatgcgaatgat

SEQ ID NO: 6069 - DNA, 20 bp, Artificial Sequence
  Description of Artificial Sequence:  Hypothetical Probe Sequence
cgaaagccgtgcgatgggac

SEQ ID NO: 6070 - DNA, 20 bp, Artificial Sequence
  Description of Artificial Sequence:  Hypothetical Probe Sequence
tgatatcgcttgacgggacc

SEQ ID NO: 6071 - DNA, 20 bp, Artificial Sequence
  Description of Artificial Sequence:  Hypothetical Probe Sequence
tgatcagctcccgacctgcg

SEQ ID NO: 6072 - DNA, 20 bp, Artificial Sequence
  Description of Artificial Sequence:  Hypothetical Probe Sequence
tgatgaccccattcccgacc

SEQ ID NO: 6073 - DNA, 20 bp, Artificial Sequence
  Description of Artificial Sequence:  Hypothetical Probe Sequence
aatccagcggtatccccacg

SEQ ID NO: 6074 - DNA, 20 bp, Artificial Sequence
  Description of Artificial Sequence:  Hypothetical Probe Sequence
aaagcgtttgcgccatgtgc

SEQ ID NO: 6075 - DNA, 20 bp, Artificial Sequence
  Description of Artificial Sequence:  Hypothetical Probe Sequence
aaagcagcgaccgcttcgtt

SEQ ID NO: 6076 - DNA, 20 bp, Artificial Sequence
  Description of Artificial Sequence:  Hypothetical Probe Sequence
tctgcttgacggcttggcaa

SEQ ID NO: 6077 - DNA, 20 bp, Artificial Sequence
  Description of Artificial Sequence:  Hypothetical Probe Sequence
tctgctcaggacgctttcgt

SEQ ID NO: 6078 - DNA, 20 bp, Artificial Sequence
  Description of Artificial Sequence:  Hypothetical Probe Sequence
tctgctgttccccagcctca

SEQ ID NO: 6079 - DNA, 20 bp, Artificial Sequence
  Description of Artificial Sequence:  Hypothetical Probe Sequence
tctgcctaaggatgcgatcg

SEQ ID NO: 6080 - DNA, 20 bp, Artificial Sequence
  Description of Artificial Sequence:  Hypothetical Probe Sequence
tctgggacgcaaatcgccta

SEQ ID NO: 6081 - DNA, 20 bp, Artificial Sequence
  Description of Artificial Sequence:  Hypothetical Probe Sequence
tgtcgagtgtcttccctgcg

SEQ ID NO: 6082 - DNA, 20 bp, Artificial Sequence
  Description of Artificial Sequence:  Hypothetical Probe Sequence
tgtcgaccgcttcgaagcaa

SEQ ID NO: 6083 - DNA, 20 bp, Artificial Sequence
  Description of Artificial Sequence:  Hypothetical Probe Sequence
tcgttgtcgtgctgcgctca

SEQ ID NO: 6084 - DNA, 20 bp, Artificial Sequence
  Description of Artificial Sequence:  Hypothetical Probe Sequence
tcgtcgttgtgcaggagcaa

SEQ ID NO: 6085 - DNA, 20 bp, Artificial Sequence
  Description of Artificial Sequence:  Hypothetical Probe Sequence
tcgtgatgcctatccctgcg

SEQ ID NO: 6086 - DNA, 20 bp, Artificial Sequence
  Description of Artificial Sequence:  Hypothetical Probe Sequence
tcgtagccttagtcccgcaa

SEQ ID NO: 6087 - DNA, 20 bp, Artificial Sequence
  Description of Artificial Sequence:  Hypothetical Probe Sequence
cttgccatcttggatgtgcg

SEQ ID NO: 6088 - DNA, 20 bp, Artificial Sequence
  Description of Artificial Sequence:  Hypothetical Probe Sequence
cttggcaaagtgcgttacgg

SEQ ID NO: 6089 - DNA, 20 bp, Artificial Sequence
  Description of Artificial Sequence:  Hypothetical Probe Sequence
cttgatcgacggtcccacgg

SEQ ID NO: 6090 - DNA, 20 bp, Artificial Sequence
  Description of Artificial Sequence:  Hypothetical Probe Sequence
cgttcagccgttgaccagga

SEQ ID NO: 6091 - DNA, 20 bp, Artificial Sequence
  Description of Artificial Sequence:  Hypothetical Probe Sequence
gcttcgttgtgcagcccgaa

SEQ ID NO: 6092 - DNA, 20 bp, Artificial Sequence
  Description of Artificial Sequence:  Hypothetical Probe Sequence
ctcagtgcgctttgcgcgtt

SEQ ID NO: 6093 - DNA, 20 bp, Artificial Sequence
  Description of Artificial Sequence:  Hypothetical Probe Sequence
ctgtacgggaccgacctgcg

SEQ ID NO: 6094 - DNA, 20 bp, Artificial Sequence
  Description of Artificial Sequence:  Hypothetical Probe Sequence
ccattcccgatgtccctccc

SEQ ID NO: 6095 - DNA, 20 bp, Artificial Sequence
  Description of Artificial Sequence:  Hypothetical Probe Sequence
cgaacttggcaatcccgtgc

SEQ ID NO: 6096 - DNA, 20 bp, Artificial Sequence
  Description of Artificial Sequence:  Hypothetical Probe Sequence
cgaactgtgcaaagcccagc

SEQ ID NO: 6097 - DNA, 20 bp, Artificial Sequence
  Description of Artificial Sequence:  Hypothetical Probe Sequence
cgaaagtggcaaacgggatg

SEQ ID NO: 6098 - DNA, 20 bp, Artificial Sequence
  Description of Artificial Sequence:  Hypothetical Probe Sequence
gcttcgaaaggatgcgctgt

SEQ ID NO: 6099 - DNA, 20 bp, Artificial Sequence
  Description of Artificial Sequence:  Hypothetical Probe Sequence
gcttcttgatacagccgcaa

SEQ ID NO: 6100 - DNA, 20 bp, Artificial Sequence
  Description of Artificial Sequence:  Hypothetical Probe Sequence
gcttgctttccctctgagcc

SEQ ID NO: 6101 - DNA, 20 bp, Artificial Sequence
  Description of Artificial Sequence:  Hypothetical Probe Sequence
gcttggtagcaagtgcggac

SEQ ID NO: 6102 - DNA, 20 bp, Artificial Sequence
  Description of Artificial Sequence:  Hypothetical Probe Sequence
gagtcgtttcccgaccagcc

SEQ ID NO: 6103 - DNA, 20 bp, Artificial Sequence
  Description of Artificial Sequence:  Hypothetical Probe Sequence
gagtgtgctgcgcttgcacg

SEQ ID NO: 6104 - DNA, 20 bp, Artificial Sequence
  Description of Artificial Sequence:  Hypothetical Probe Sequence
gcttgcaaaaagcacgcgaa

SEQ ID NO: 6105 - DNA, 20 bp, Artificial Sequence
  Description of Artificial Sequence:  Hypothetical Probe Sequence
gcaatcgtctcagcaatgcg

SEQ ID NO: 6106 - DNA, 20 bp, Artificial Sequence
  Description of Artificial Sequence:  Hypothetical Probe Sequence
gcaacgaagtctcagcgcaa

SEQ ID NO: 6107 - DNA, 20 bp, Artificial Sequence
  Description of Artificial Sequence:  Hypothetical Probe Sequence
gcttgcaaacctcacgccat

SEQ ID NO: 6108 - DNA, 20 bp, Artificial Sequence
  Description of Artificial Sequence:  Hypothetical Probe Sequence
gcttgcaagatgcagctccc

SEQ ID NO: 6109 - DNA, 20 bp, Artificial Sequence
  Description of Artificial Sequence:  Hypothetical Probe Sequence
acctcagctcccagccagcc

SEQ ID NO: 6110 - DNA, 20 bp, Artificial Sequence
  Description of Artificial Sequence:  Hypothetical Probe Sequence
atcgcttgtctggtgctccc

SEQ ID NO: 6111 - DNA, 20 bp, Artificial Sequence
  Description of Artificial Sequence:  Hypothetical Probe Sequence
atcgcctattgaacggcgtt

SEQ ID NO: 6112 - DNA, 20 bp, Artificial Sequence
  Description of Artificial Sequence:  Hypothetical Probe Sequence
atcggaccgacccttgcgtt

SEQ ID NO: 6113 - DNA, 20 bp, Artificial Sequence
  Description of Artificial Sequence:  Hypothetical Probe Sequence
cctacgtttgcgcttgcgaa

SEQ ID NO: 6114 - DNA, 20 bp, Artificial Sequence
  Description of Artificial Sequence:  Hypothetical Probe Sequence
gatggcaaaggacacgacgg

SEQ ID NO: 6115 - DNA, 20 bp, Artificial Sequence
  Description of Artificial Sequence:  Hypothetical Probe Sequence
gcttgatgcacgaaagcgtt

SEQ ID NO: 6116 - DNA, 20 bp, Artificial Sequence
  Description of Artificial Sequence:  Hypothetical Probe Sequence
gatggtgcataccgtttccc

SEQ ID NO: 6117 - DNA, 20 bp, Artificial Sequence
  Description of Artificial Sequence:  Hypothetical Probe Sequence
tcccatcggtctgacctccc

SEQ ID NO: 6118 - DNA, 20 bp, Artificial Sequence
  Description of Artificial Sequence:  Hypothetical Probe Sequence
tcccgaccggtatgtcgcaa

SEQ ID NO: 6119 - DNA, 20 bp, Artificial Sequence
  Description of Artificial Sequence:  Hypothetical Probe Sequence
tgcgtacaacgggcaatccc

SEQ ID NO: 6120 - DNA, 20 bp, Artificial Sequence
  Description of Artificial Sequence:  Hypothetical Probe Sequence
tgcgcgaagagtatcggcaa

SEQ ID NO: 6121 - DNA, 20 bp, Artificial Sequence
  Description of Artificial Sequence:  Hypothetical Probe Sequence
tgcgggtaaatcgagtacgg

SEQ ID NO: 6122 - DNA, 20 bp, Artificial Sequence
  Description of Artificial Sequence:  Hypothetical Probe Sequence
tgcgagtgggaccttgagcc

SEQ ID NO: 6123 - DNA, 20 bp, Artificial Sequence
  Description of Artificial Sequence:  Hypothetical Probe Sequence
gctttgcgatcggcaatccc

SEQ ID NO: 6124 - DNA, 20 bp, Artificial Sequence
  Description of Artificial Sequence:  Hypothetical Probe Sequence
tgcgacggtgtcaaaggcaa

SEQ ID NO: 6125 - DNA, 20 bp, Artificial Sequence
  Description of Artificial Sequence:  Hypothetical Probe Sequence
cacgtgtccacgtccccacg

SEQ ID NO: 6126 - DNA, 20 bp, Artificial Sequence
  Description of Artificial Sequence:  Hypothetical Probe Sequence
cacgcttgaaagcagcgagt

SEQ ID NO: 6127 - DNA, 20 bp, Artificial Sequence
  Description of Artificial Sequence:  Hypothetical Probe Sequence
cacgctgttacaatcggcaa

SEQ ID NO: 6128 - DNA, 20 bp, Artificial Sequence
  Description of Artificial Sequence:  Hypothetical Probe Sequence
cacgtcccgatgcttggacc

SEQ ID NO: 6129 - DNA, 20 bp, Artificial Sequence
  Description of Artificial Sequence:  Hypothetical Probe Sequence
cacggacccacggagtcgaa

SEQ ID NO: 6130 - DNA, 20 bp, Artificial Sequence
  Description of Artificial Sequence:  Hypothetical Probe Sequence
cagcaatctccccgaaagcc

SEQ ID NO: 6131 - DNA, 20 bp, Artificial Sequence
  Description of Artificial Sequence:  Hypothetical Probe Sequence
cagctctgagcctccccacg

SEQ ID NO: 6132 - DNA, 20 bp, Artificial Sequence
  Description of Artificial Sequence:  Hypothetical Probe Sequence
cagctcgtaatctccccagc

SEQ ID NO: 6133 - DNA, 20 bp, Artificial Sequence
  Description of Artificial Sequence:  Hypothetical Probe Sequence
cagcgcaaaaagaatcgacc

SEQ ID NO: 6134 - DNA, 20 bp, Artificial Sequence
  Description of Artificial Sequence:  Hypothetical Probe Sequence
cagcacctggtaagccacgg

SEQ ID NO: 6135 - DNA, 20 bp, Artificial Sequence
  Description of Artificial Sequence:  Hypothetical Probe Sequence
cagccacggcaactcagcaa

SEQ ID NO: 6136 - DNA, 20 bp, Artificial Sequence
  Description of Artificial Sequence:  Hypothetical Probe Sequence
gaccaatccacgtgcgagcc

SEQ ID NO: 6137 - DNA, 20 bp, Artificial Sequence
  Description of Artificial Sequence:  Hypothetical Probe Sequence
gcttgaccccatgcttgctt

SEQ ID NO: 6138 - DNA, 20 bp, Artificial Sequence
  Description of Artificial Sequence:  Hypothetical Probe Sequence
gacccctaagcccacgctca

SEQ ID NO: 6139 - DNA, 20 bp, Artificial Sequence
  Description of Artificial Sequence:  Hypothetical Probe Sequence
gcttgacccagcgaccgtgc

SEQ ID NO: 6140 - DNA, 20 bp, Artificial Sequence
  Description of Artificial Sequence:  Hypothetical Probe Sequence
gcttgtgcatcggtgccttg

SEQ ID NO: 6141 - DNA, 20 bp, Artificial Sequence
  Description of Artificial Sequence:  Hypothetical Probe Sequence
gcttgtgctcccaatctgcg

SEQ ID NO: 6142 - DNA, 20 bp, Artificial Sequence
  Description of Artificial Sequence:  Hypothetical Probe Sequence
ggaccgtttctggtgcccat

SEQ ID NO: 6143 - DNA, 20 bp, Artificial Sequence
  Description of Artificial Sequence:  Hypothetical Probe Sequence
gcttggaccgaatctggcaa

SEQ ID NO: 6144 - DNA, 20 bp, Artificial Sequence
  Description of Artificial Sequence:  Hypothetical Probe Sequence
ggactccccttgtgtcgcaa

SEQ ID NO: 6145 - DNA, 20 bp, Artificial Sequence
  Description of Artificial Sequence:  Hypothetical Probe Sequence
ggaccacgtacatcccagcc

SEQ ID NO: 6146 - DNA, 20 bp, Artificial Sequence
  Description of Artificial Sequence:  Hypothetical Probe Sequence
acggtctgacggtgcgtcgt

SEQ ID NO: 6147 - DNA, 20 bp, Artificial Sequence
  Description of Artificial Sequence:  Hypothetical Probe Sequence
agccctgtaatcacgggcaa

SEQ ID NO: 6148 - DNA, 20 bp, Artificial Sequence
  Description of Artificial Sequence:  Hypothetical Probe Sequence
agccatcgctcaaaagcgaa

SEQ ID NO: 6149 - DNA, 20 bp, Artificial Sequence
  Description of Artificial Sequence:  Hypothetical Probe Sequence
tctggtgcaggacgaatgcg

SEQ ID NO: 6150 - DNA, 20 bp, Artificial Sequence
  Description of Artificial Sequence:  Hypothetical Probe Sequence
tgtcgctttgcgcagctccc

SEQ ID NO: 6151 - DNA, 20 bp, Artificial Sequence
  Description of Artificial Sequence:  Hypothetical Probe Sequence
cgaacagcggtaagccgcaa

SEQ ID NO: 6152 - DNA, 20 bp, Artificial Sequence
  Description of Artificial Sequence:  Hypothetical Probe Sequence
cgaaagcctacaagcccgaa

SEQ ID NO: 6153 - DNA, 20 bp, Artificial Sequence
  Description of Artificial Sequence:  Hypothetical Probe Sequence
gcaacagcgacccagccagc

SEQ ID NO: 6154 - DNA, 20 bp, Artificial Sequence
  Description of Artificial Sequence:  Hypothetical Probe Sequence
gcaaggactgcgtctgtgcg

SEQ ID NO: 6155 - DNA, 20 bp, Artificial Sequence
  Description of Artificial Sequence:  Hypothetical Probe Sequence
acctcacgtgcgctgttgcg

SEQ ID NO: 6156 - DNA, 20 bp, Artificial Sequence
  Description of Artificial Sequence:  Hypothetical Probe Sequence
atcggcaacgttcttgacgg

SEQ ID NO: 6157 - DNA, 20 bp, Artificial Sequence
  Description of Artificial Sequence:  Hypothetical Probe Sequence
gatggcttcgtttccccagc

SEQ ID NO: 6158 - DNA, 20 bp, Artificial Sequence
  Description of Artificial Sequence:  Hypothetical Probe Sequence
tgcggcaactgtatcggtgc

SEQ ID NO: 6159 - DNA, 20 bp, Artificial Sequence
  Description of Artificial Sequence:  Hypothetical Probe Sequence
tgcgagtggtgcggtagtgc

SEQ ID NO: 6160 - DNA, 20 bp, Artificial Sequence
  Description of Artificial Sequence:  Hypothetical Probe Sequence
cacggcaacgttccattcgt

SEQ ID NO: 6161 - DNA, 20 bp, Artificial Sequence
  Description of Artificial Sequence:  Hypothetical Probe Sequence
cacgatcggaccaggatgcg

SEQ ID NO: 6162 - DNA, 20 bp, Artificial Sequence
  Description of Artificial Sequence:  Hypothetical Probe Sequence
cacgagccgagtcagcgctt

SEQ ID NO: 6163 - DNA, 20 bp, Artificial Sequence
  Description of Artificial Sequence:  Hypothetical Probe Sequence
cagcgcttaggaggacgtgc

SEQ ID NO: 6164 - DNA, 20 bp, Artificial Sequence
  Description of Artificial Sequence:  Hypothetical Probe Sequence
cagcgaccctgttccctccc

SEQ ID NO: 6165 - DNA, 20 bp, Artificial Sequence
  Description of Artificial Sequence:  Hypothetical Probe Sequence
gaccggtacagcatcgcgaa

SEQ ID NO: 6166 - DNA, 20 bp, Artificial Sequence
  Description of Artificial Sequence:  Hypothetical Probe Sequence
gaccatcgcagcgtgcatcg

SEQ ID NO: 6167 - DNA, 20 bp, Artificial Sequence
  Description of Artificial Sequence:  Hypothetical Probe Sequence
gaccgtgcccatccattgcg

SEQ ID NO: 6168 - DNA, 20 bp, Artificial Sequence
  Description of Artificial Sequence:  Hypothetical Probe Sequence
gaccacggttagtgcgagcc

SEQ ID NO: 6169 - DNA, 20 bp, Artificial Sequence
  Description of Artificial Sequence:  Hypothetical Probe Sequence
acggtcgtttagacggtgcg

SEQ ID NO: 6170 - DNA, 20 bp, Artificial Sequence
  Description of Artificial Sequence:  Hypothetical Probe Sequence
acggctgtgtgcgatggatg

SEQ ID NO: 6171 - DNA, 20 bp, Artificial Sequence
  Description of Artificial Sequence:  Hypothetical Probe Sequence
agccgagtaccttgcgctgt

SEQ ID NO: 6172 - DNA, 20 bp, Artificial Sequence
  Description of Artificial Sequence:  Hypothetical Probe Sequence
ttgatgcgcgtttgcgaaag

SEQ ID NO: 6173 - DNA, 20 bp, Artificial Sequence
  Description of Artificial Sequence:  Hypothetical Probe Sequence
tctgcagctgcgcttgccat

SEQ ID NO: 6174 - DNA, 20 bp, Artificial Sequence
  Description of Artificial Sequence:  Hypothetical Probe Sequence
cttgcagcacggtccctgcg

SEQ ID NO: 6175 - DNA, 20 bp, Artificial Sequence
  Description of Artificial Sequence:  Hypothetical Probe Sequence
cgttcgaacagcagccgctt

SEQ ID NO: 6176 - DNA, 20 bp, Artificial Sequence
  Description of Artificial Sequence:  Hypothetical Probe Sequence
cgttgtgccacgtcgttgcg

SEQ ID NO: 6177 - DNA, 20 bp, Artificial Sequence
  Description of Artificial Sequence:  Hypothetical Probe Sequence
ccattcccacggctgtagcc

SEQ ID NO: 6178 - DNA, 20 bp, Artificial Sequence
  Description of Artificial Sequence:  Hypothetical Probe Sequence
cgaacgaacagcgcaacacg

SEQ ID NO: 6179 - DNA, 20 bp, Artificial Sequence
  Description of Artificial Sequence:  Hypothetical Probe Sequence
cgaaatcgcgaaacgggacc

SEQ ID NO: 6180 - DNA, 20 bp, Artificial Sequence
  Description of Artificial Sequence:  Hypothetical Probe Sequence
gcaaatcgaatctccccgtt

SEQ ID NO: 6181 - DNA, 20 bp, Artificial Sequence
  Description of Artificial Sequence:  Hypothetical Probe Sequence
gatgcagcatcgtgcggcaa

SEQ ID NO: 6182 - DNA, 20 bp, Artificial Sequence
  Description of Artificial Sequence:  Hypothetical Probe Sequence
tccccttgacggcgttgcaa

SEQ ID NO: 6183 - DNA, 20 bp, Artificial Sequence
  Description of Artificial Sequence:  Hypothetical Probe Sequence
tcccccattctgacggggta

SEQ ID NO: 6184 - DNA, 20 bp, Artificial Sequence
  Description of Artificial Sequence:  Hypothetical Probe Sequence
tcccacggagtgccatgtgc

SEQ ID NO: 6185 - DNA, 20 bp, Artificial Sequence
  Description of Artificial Sequence:  Hypothetical Probe Sequence
tgcgagtgatcgagccagcc

SEQ ID NO: 6186 - DNA, 20 bp, Artificial Sequence
  Description of Artificial Sequence:  Hypothetical Probe Sequence
tgcggacctccctacaacgg

SEQ ID NO: 6187 - DNA, 20 bp, Artificial Sequence
  Description of Artificial Sequence:  Hypothetical Probe Sequence
cacgctcaacggcttgccat

SEQ ID NO: 6188 - DNA, 20 bp, Artificial Sequence
  Description of Artificial Sequence:  Hypothetical Probe Sequence
cacggctttgtcagccgtgc

SEQ ID NO: 6189 - DNA, 20 bp, Artificial Sequence
  Description of Artificial Sequence:  Hypothetical Probe Sequence
cacgcctagacctgcggcaa

SEQ ID NO: 6190 - DNA, 20 bp, Artificial Sequence
  Description of Artificial Sequence:  Hypothetical Probe Sequence
cacgtcccctgtgctttgcg

SEQ ID NO: 6191 - DNA, 20 bp, Artificial Sequence
  Description of Artificial Sequence:  Hypothetical Probe Sequence
cacgacggcgttcgttgtgc

SEQ ID NO: 6192 - DNA, 20 bp, Artificial Sequence
  Description of Artificial Sequence:  Hypothetical Probe Sequence
cagccagctcgttcgtcgaa

SEQ ID NO: 6193 - DNA, 20 bp, Artificial Sequence
  Description of Artificial Sequence:  Hypothetical Probe Sequence
cagcggacggacggacccta

SEQ ID NO: 6194 - DNA, 20 bp, Artificial Sequence
  Description of Artificial Sequence:  Hypothetical Probe Sequence
gtgcgcttcacgttgatgcg

SEQ ID NO: 6195 - DNA, 20 bp, Artificial Sequence
  Description of Artificial Sequence:  Hypothetical Probe Sequence
gtgcgcaaggaccgttccat

SEQ ID NO: 6196 - DNA, 20 bp, Artificial Sequence
  Description of Artificial Sequence:  Hypothetical Probe Sequence
gtgcagccgctttcccagga

SEQ ID NO: 6197 - DNA, 20 bp, Artificial Sequence
  Description of Artificial Sequence:  Hypothetical Probe Sequence
gtctggacgcttacggcgaa

SEQ ID NO: 6198 - DNA, 20 bp, Artificial Sequence
  Description of Artificial Sequence:  Hypothetical Probe Sequence
ggactcccgcaacacgtgcg

SEQ ID NO: 6199 - DNA, 20 bp, Artificial Sequence
  Description of Artificial Sequence:  Hypothetical Probe Sequence
ggacagccatcgatcgtgcg

SEQ ID NO: 6200 - DNA, 20 bp, Artificial Sequence
  Description of Artificial Sequence:  Hypothetical Probe Sequence
agccggtacagctcccatcg

SEQ ID NO: 6201 - DNA, 20 bp, Artificial Sequence
  Description of Artificial Sequence:  Hypothetical Probe Sequence
tctgtgcgcacgcacggcaa

SEQ ID NO: 6202 - DNA, 20 bp, Artificial Sequence
  Description of Artificial Sequence:  Hypothetical Probe Sequence
tctgcacgacggcacgtccc

SEQ ID NO: 6203 - DNA, 20 bp, Artificial Sequence
  Description of Artificial Sequence:  Hypothetical Probe Sequence
cttgcacgccatagcccacg

SEQ ID NO: 6204 - DNA, 20 bp, Artificial Sequence
  Description of Artificial Sequence:  Hypothetical Probe Sequence
cgttcgttagccatcgtgcg

SEQ ID NO: 6205 - DNA, 20 bp, Artificial Sequence
  Description of Artificial Sequence:  Hypothetical Probe Sequence
ctgtcacgcagcagccagga

SEQ ID NO: 6206 - DNA, 20 bp, Artificial Sequence
  Description of Artificial Sequence:  Hypothetical Probe Sequence
cgaaagcctgcgtcgtccat

SEQ ID NO: 6207 - DNA, 20 bp, Artificial Sequence
  Description of Artificial Sequence:  Hypothetical Probe Sequence
gcttgcaacacgcacgacct

SEQ ID NO: 6208 - DNA, 20 bp, Artificial Sequence
  Description of Artificial Sequence:  Hypothetical Probe Sequence
gcttcacggtgcgtgcagcc

SEQ ID NO: 6209 - DNA, 20 bp, Artificial Sequence
  Description of Artificial Sequence:  Hypothetical Probe Sequence
atcgtgcgatcggaccctca

SEQ ID NO: 6210 - DNA, 20 bp, Artificial Sequence
  Description of Artificial Sequence:  Hypothetical Probe Sequence
cctacagctcccgctttgcg

SEQ ID NO: 6211 - DNA, 20 bp, Artificial Sequence
  Description of Artificial Sequence:  Hypothetical Probe Sequence
tcccgtgccctatcgtgtgc

SEQ ID NO: 6212 - DNA, 20 bp, Artificial Sequence
  Description of Artificial Sequence:  Hypothetical Probe Sequence
tgcgaaagcacgggacgtgc

SEQ ID NO: 6213 - DNA, 20 bp, Artificial Sequence
  Description of Artificial Sequence:  Hypothetical Probe Sequence
tgcgccattacatcccggta

SEQ ID NO: 6214 - DNA, 20 bp, Artificial Sequence
  Description of Artificial Sequence:  Hypothetical Probe Sequence
tgcgggtagcaatctgcacg

SEQ ID NO: 6215 - DNA, 20 bp, Artificial Sequence
  Description of Artificial Sequence:  Hypothetical Probe Sequence
tgcgacctagcctccctgcg

SEQ ID NO: 6216 - DNA, 20 bp, Artificial Sequence
  Description of Artificial Sequence:  Hypothetical Probe Sequence
cagcgatggtgcggacacgg

SEQ ID NO: 6217 - DNA, 20 bp, Artificial Sequence
  Description of Artificial Sequence:  Hypothetical Probe Sequence
cagctccctctggacccgtt

SEQ ID NO: 6218 - DNA, 20 bp, Artificial Sequence
  Description of Artificial Sequence:  Hypothetical Probe Sequence
cagcggacagccgagtcacg

SEQ ID NO: 6219 - DNA, 20 bp, Artificial Sequence
  Description of Artificial Sequence:  Hypothetical Probe Sequence
gagtgacccgtttccccgaa

SEQ ID NO: 6220 - DNA, 20 bp, Artificial Sequence
  Description of Artificial Sequence:  Hypothetical Probe Sequence
gaccgtgcgaccagcccttg

SEQ ID NO: 6221 - DNA, 20 bp, Artificial Sequence
  Description of Artificial Sequence:  Hypothetical Probe Sequence
gtgcttgaggactcccgtgc

SEQ ID NO: 6222 - DNA, 20 bp, Artificial Sequence
  Description of Artificial Sequence:  Hypothetical Probe Sequence
ggacccattgtcggacggac

SEQ ID NO: 6223 - DNA, 20 bp, Artificial Sequence
  Description of Artificial Sequence:  Hypothetical Probe Sequence
ggacggactgtcatcgcacg

SEQ ID NO: 6224 - DNA, 20 bp, Artificial Sequence
  Description of Artificial Sequence:  Hypothetical Probe Sequence
acggccatttagtgcggctt

SEQ ID NO: 6225 - DNA, 20 bp, Artificial Sequence
  Description of Artificial Sequence:  Hypothetical Probe Sequence
agccatcggaccagcccacg

SEQ ID NO: 6226 - DNA, 20 bp, Artificial Sequence
  Description of Artificial Sequence:  Hypothetical Probe Sequence
gcaattgagtgcggaccgaa

SEQ ID NO: 6227 - DNA, 20 bp, Artificial Sequence
  Description of Artificial Sequence:  Hypothetical Probe Sequence
tgattcgttccccttgcacg

SEQ ID NO: 6228 - DNA, 20 bp, Artificial Sequence
  Description of Artificial Sequence:  Hypothetical Probe Sequence
tgatcagcgctttcccagcc

SEQ ID NO: 6229 - DNA, 20 bp, Artificial Sequence
  Description of Artificial Sequence:  Hypothetical Probe Sequence
gcaaaatcatcggtgccgaa

SEQ ID NO: 6230 - DNA, 20 bp, Artificial Sequence
  Description of Artificial Sequence:  Hypothetical Probe Sequence
aatctcccatcgctcatccc

SEQ ID NO: 6231 - DNA, 20 bp, Artificial Sequence
  Description of Artificial Sequence:  Hypothetical Probe Sequence
gcaaaatccacgcagcctgt

SEQ ID NO: 6232 - DNA, 20 bp, Artificial Sequence
  Description of Artificial Sequence:  Hypothetical Probe Sequence
aaagacctaggaagccgcaa

SEQ ID NO: 6233 - DNA, 20 bp, Artificial Sequence
  Description of Artificial Sequence:  Hypothetical Probe Sequence
tctgcgttttagggacacgg

SEQ ID NO: 6234 - DNA, 20 bp, Artificial Sequence
  Description of Artificial Sequence:  Hypothetical Probe Sequence
tctggcaacgttatcgcgtt

SEQ ID NO: 6235 - DNA, 20 bp, Artificial Sequence
  Description of Artificial Sequence:  Hypothetical Probe Sequence
tctgtcccgcaactcaagcc

SEQ ID NO: 6236 - DNA, 20 bp, Artificial Sequence
  Description of Artificial Sequence:  Hypothetical Probe Sequence
tctgtgcgctgtggacgtgc

SEQ ID NO: 6237 - DNA, 20 bp, Artificial Sequence
  Description of Artificial Sequence:  Hypothetical Probe Sequence
tctggaccaatcagccccat

SEQ ID NO: 6238 - DNA, 20 bp, Artificial Sequence
  Description of Artificial Sequence:  Hypothetical Probe Sequence
tctgggacagccgtgccagc

SEQ ID NO: 6239 - DNA, 20 bp, Artificial Sequence
  Description of Artificial Sequence:  Hypothetical Probe Sequence
tgtctcgtgacctgcgcgaa

SEQ ID NO: 6240 - DNA, 20 bp, Artificial Sequence
  Description of Artificial Sequence:  Hypothetical Probe Sequence
tgtcgctttcgtgtgcctca

SEQ ID NO: 6241 - DNA, 20 bp, Artificial Sequence
  Description of Artificial Sequence:  Hypothetical Probe Sequence
tgtcggtagacctcccgctt

SEQ ID NO: 6242 - DNA, 20 bp, Artificial Sequence
  Description of Artificial Sequence:  Hypothetical Probe Sequence
tgtcatcgtccctccccacg

SEQ ID NO: 6243 - DNA, 20 bp, Artificial Sequence
  Description of Artificial Sequence:  Hypothetical Probe Sequence
gcaatgtctgcggatgcgaa

SEQ ID NO: 6244 - DNA, 20 bp, Artificial Sequence
  Description of Artificial Sequence:  Hypothetical Probe Sequence
gcaatgtccacgcgaaatcg

SEQ ID NO: 6245 - DNA, 20 bp, Artificial Sequence
  Description of Artificial Sequence:  Hypothetical Probe Sequence
tcgtctgttgcgaatccgaa

SEQ ID NO: 6246 - DNA, 20 bp, Artificial Sequence
  Description of Artificial Sequence:  Hypothetical Probe Sequence
tcgtacctgcttgtgccgaa

SEQ ID NO: 6247 - DNA, 20 bp, Artificial Sequence
  Description of Artificial Sequence:  Hypothetical Probe Sequence
tcgtagcctgattccccagc

SEQ ID NO: 6248 - DNA, 20 bp, Artificial Sequence
  Description of Artificial Sequence:  Hypothetical Probe Sequence
cttggatgagcccacgcgaa

SEQ ID NO: 6249 - DNA, 20 bp, Artificial Sequence
  Description of Artificial Sequence:  Hypothetical Probe Sequence
gcaacttgcagccgaagcaa

SEQ ID NO: 6250 - DNA, 20 bp, Artificial Sequence
  Description of Artificial Sequence:  Hypothetical Probe Sequence
cgttttgatcgtcacgagcc

SEQ ID NO: 6251 - DNA, 20 bp, Artificial Sequence
  Description of Artificial Sequence:  Hypothetical Probe Sequence
cgtttacaacggcagcgcaa

SEQ ID NO: 6252 - DNA, 20 bp, Artificial Sequence
  Description of Artificial Sequence:  Hypothetical Probe Sequence
cgttgatggtgctccctgcg

SEQ ID NO: 6253 - DNA, 20 bp, Artificial Sequence
  Description of Artificial Sequence:  Hypothetical Probe Sequence
cgtttcccacctttgaagcc

SEQ ID NO: 6254 - DNA, 20 bp, Artificial Sequence
  Description of Artificial Sequence:  Hypothetical Probe Sequence
ctcaatcgcgaagtgcccat

SEQ ID NO: 6255 - DNA, 20 bp, Artificial Sequence
  Description of Artificial Sequence:  Hypothetical Probe Sequence
ctcacacgacgggtgcagga

SEQ ID NO: 6256 - DNA, 20 bp, Artificial Sequence
  Description of Artificial Sequence:  Hypothetical Probe Sequence
ctcaacgggcttggacagga

SEQ ID NO: 6257 - DNA, 20 bp, Artificial Sequence
  Description of Artificial Sequence:  Hypothetical Probe Sequence
gcaactgttgcggcaagcaa

SEQ ID NO: 6258 - DNA, 20 bp, Artificial Sequence
  Description of Artificial Sequence:  Hypothetical Probe Sequence
ccatctcaggaccagcgcaa

SEQ ID NO: 6259 - DNA, 20 bp, Artificial Sequence
  Description of Artificial Sequence:  Hypothetical Probe Sequence
gcaaccatcgaatgtcacgg

SEQ ID NO: 6260 - DNA, 20 bp, Artificial Sequence
  Description of Artificial Sequence:  Hypothetical Probe Sequence
ccatgatgacggtcccagga

SEQ ID NO: 6261 - DNA, 20 bp, Artificial Sequence
  Description of Artificial Sequence:  Hypothetical Probe Sequence
gcaaccattgcgtcccttag

SEQ ID NO: 6262 - DNA, 20 bp, Artificial Sequence
  Description of Artificial Sequence:  Hypothetical Probe Sequence
gcaaccatggacgatgcgaa

SEQ ID NO: 6263 - DNA, 20 bp, Artificial Sequence
  Description of Artificial Sequence:  Hypothetical Probe Sequence
cgaagcttgacctgtcgctt

SEQ ID NO: 6264 - DNA, 20 bp, Artificial Sequence
  Description of Artificial Sequence:  Hypothetical Probe Sequence
gcttgctttgtccttggcaa

SEQ ID NO: 6265 - DNA, 20 bp, Artificial Sequence
  Description of Artificial Sequence:  Hypothetical Probe Sequence
gcaagcttcacggcttcagc

SEQ ID NO: 6266 - DNA, 20 bp, Artificial Sequence
  Description of Artificial Sequence:  Hypothetical Probe Sequence
gcttagccgatggtgcctca

SEQ ID NO: 6267 - DNA, 20 bp, Artificial Sequence
  Description of Artificial Sequence:  Hypothetical Probe Sequence
gtctgcttaatcgaccgcaa

SEQ ID NO: 6268 - DNA, 20 bp, Artificial Sequence
  Description of Artificial Sequence:  Hypothetical Probe Sequence
gcaaaatcgcaatcgttccc

SEQ ID NO: 6269 - DNA, 20 bp, Artificial Sequence
  Description of Artificial Sequence:  Hypothetical Probe Sequence
gcaacttgctcatgcgagcc

SEQ ID NO: 6270 - DNA, 20 bp, Artificial Sequence
  Description of Artificial Sequence:  Hypothetical Probe Sequence
gcaagcaactcagacccacg

SEQ ID NO: 6271 - DNA, 20 bp, Artificial Sequence
  Description of Artificial Sequence:  Hypothetical Probe Sequence
gcaagcaagctttcccgatg

SEQ ID NO: 6272 - DNA, 20 bp, Artificial Sequence
  Description of Artificial Sequence:  Hypothetical Probe Sequence
gcaacagcatacgaccgcaa

SEQ ID NO: 6273 - DNA, 20 bp, Artificial Sequence
  Description of Artificial Sequence:  Hypothetical Probe Sequence
gcaaagtgggtaccattgcg

SEQ ID NO: 6274 - DNA, 20 bp, Artificial Sequence
  Description of Artificial Sequence:  Hypothetical Probe Sequence
accttctgagcccttgcacg

SEQ ID NO: 6275 - DNA, 20 bp, Artificial Sequence
  Description of Artificial Sequence:  Hypothetical Probe Sequence
accttgtccagctcccggac

SEQ ID NO: 6276 - DNA, 20 bp, Artificial Sequence
  Description of Artificial Sequence:  Hypothetical Probe Sequence
gcaaacctccattgcgggac

SEQ ID NO: 6277 - DNA, 20 bp, Artificial Sequence
  Description of Artificial Sequence:  Hypothetical Probe Sequence
gcaaacctgcaagaccctca

SEQ ID NO: 6278 - DNA, 20 bp, Artificial Sequence
  Description of Artificial Sequence:  Hypothetical Probe Sequence
gcaaacctgaccgcaaagcc

SEQ ID NO: 6279 - DNA, 20 bp, Artificial Sequence
  Description of Artificial Sequence:  Hypothetical Probe Sequence
acctggacgcaagaccgacc

SEQ ID NO: 6280 - DNA, 20 bp, Artificial Sequence
  Description of Artificial Sequence:  Hypothetical Probe Sequence
gcaaatcgctcacctaagcc

SEQ ID NO: 6281 - DNA, 20 bp, Artificial Sequence
  Description of Artificial Sequence:  Hypothetical Probe Sequence
atcggagttgtccagcagcc

SEQ ID NO: 6282 - DNA, 20 bp, Artificial Sequence
  Description of Artificial Sequence:  Hypothetical Probe Sequence
atcgtccccagctgtcccat

SEQ ID NO: 6283 - DNA, 20 bp, Artificial Sequence
  Description of Artificial Sequence:  Hypothetical Probe Sequence
gcaaatcggaccatacgtgc

SEQ ID NO: 6284 - DNA, 20 bp, Artificial Sequence
  Description of Artificial Sequence:  Hypothetical Probe Sequence
gcaaaggatctgtgcggcaa

SEQ ID NO: 6285 - DNA, 20 bp, Artificial Sequence
  Description of Artificial Sequence:  Hypothetical Probe Sequence
aggacttgggacacggtgcg

SEQ ID NO: 6286 - DNA, 20 bp, Artificial Sequence
  Description of Artificial Sequence:  Hypothetical Probe Sequence
aggactcagtgcagccgcaa

SEQ ID NO: 6287 - DNA, 20 bp, Artificial Sequence
  Description of Artificial Sequence:  Hypothetical Probe Sequence
aggaacctatcggatgcgtt

SEQ ID NO: 6288 - DNA, 20 bp, Artificial Sequence
  Description of Artificial Sequence:  Hypothetical Probe Sequence
gcaaaggaatcgcacgggta

SEQ ID NO: 6289 - DNA, 20 bp, Artificial Sequence
  Description of Artificial Sequence:  Hypothetical Probe Sequence
cctagaccgctttcccacgg

SEQ ID NO: 6290 - DNA, 20 bp, Artificial Sequence
  Description of Artificial Sequence:  Hypothetical Probe Sequence
cctaagccaggatcgttccc

SEQ ID NO: 6291 - DNA, 20 bp, Artificial Sequence
  Description of Artificial Sequence:  Hypothetical Probe Sequence
gatgcgttagtgggacagcc

SEQ ID NO: 6292 - DNA, 20 bp, Artificial Sequence
  Description of Artificial Sequence:  Hypothetical Probe Sequence
gatgcctacacgcgaaagcc

SEQ ID NO: 6293 - DNA, 20 bp, Artificial Sequence
  Description of Artificial Sequence:  Hypothetical Probe Sequence
gatgtgcgttgagacccagc

SEQ ID NO: 6294 - DNA, 20 bp, Artificial Sequence
  Description of Artificial Sequence:  Hypothetical Probe Sequence
gcaatcccaatcacggcgaa

SEQ ID NO: 6295 - DNA, 20 bp, Artificial Sequence
  Description of Artificial Sequence:  Hypothetical Probe Sequence
tccctctgcagcgagtgctt

SEQ ID NO: 6296 - DNA, 20 bp, Artificial Sequence
  Description of Artificial Sequence:  Hypothetical Probe Sequence
tcccacggggacaatcgtgc

SEQ ID NO: 6297 - DNA, 20 bp, Artificial Sequence
  Description of Artificial Sequence:  Hypothetical Probe Sequence
tgcgttaggatgccattgcg

SEQ ID NO: 6298 - DNA, 20 bp, Artificial Sequence
  Description of Artificial Sequence:  Hypothetical Probe Sequence
tgcgaaaggatgcgttcgaa

SEQ ID NO: 6299 - DNA, 20 bp, Artificial Sequence
  Description of Artificial Sequence:  Hypothetical Probe Sequence
gcaatgcgtcgtcgaatcgt

SEQ ID NO: 6300 - DNA, 20 bp, Artificial Sequence
  Description of Artificial Sequence:  Hypothetical Probe Sequence
gcaatgcgcgttgtgcctgt

SEQ ID NO: 6301 - DNA, 20 bp, Artificial Sequence
  Description of Artificial Sequence:  Hypothetical Probe Sequence
tgcgctcaacctcgttgtgc

SEQ ID NO: 6302 - DNA, 20 bp, Artificial Sequence
  Description of Artificial Sequence:  Hypothetical Probe Sequence
tgcgcgaatctggatgatcg

SEQ ID NO: 6303 - DNA, 20 bp, Artificial Sequence
  Description of Artificial Sequence:  Hypothetical Probe Sequence
tgcgcagcgctttctgatcg

SEQ ID NO: 6304 - DNA, 20 bp, Artificial Sequence
  Description of Artificial Sequence:  Hypothetical Probe Sequence
tgcgggacttagaccttccc

SEQ ID NO: 6305 - DNA, 20 bp, Artificial Sequence
  Description of Artificial Sequence:  Hypothetical Probe Sequence
cacgaatcgatgcagcggac

SEQ ID NO: 6306 - DNA, 20 bp, Artificial Sequence
  Description of Artificial Sequence:  Hypothetical Probe Sequence
cacgtctgcctatgcgccat

SEQ ID NO: 6307 - DNA, 20 bp, Artificial Sequence
  Description of Artificial Sequence:  Hypothetical Probe Sequence
cacgcgttctgtggtaacgg

SEQ ID NO: 6308 - DNA, 20 bp, Artificial Sequence
  Description of Artificial Sequence:  Hypothetical Probe Sequence
cacgctcagcaaaaagcgtt

SEQ ID NO: 6309 - DNA, 20 bp, Artificial Sequence
  Description of Artificial Sequence:  Hypothetical Probe Sequence
gcaacacgtcccgtcttccc

SEQ ID NO: 6310 - DNA, 20 bp, Artificial Sequence
  Description of Artificial Sequence:  Hypothetical Probe Sequence
gcaacacgggaccacgatcg

SEQ ID NO: 6311 - DNA, 20 bp, Artificial Sequence
  Description of Artificial Sequence:  Hypothetical Probe Sequence
cagcttgatgcgccatcacg

SEQ ID NO: 6312 - DNA, 20 bp, Artificial Sequence
  Description of Artificial Sequence:  Hypothetical Probe Sequence
cagctcgtaggaatcggctt

SEQ ID NO: 6313 - DNA, 20 bp, Artificial Sequence
  Description of Artificial Sequence:  Hypothetical Probe Sequence
cagcccatagtgatcgcacg

SEQ ID NO: 6314 - DNA, 20 bp, Artificial Sequence
  Description of Artificial Sequence:  Hypothetical Probe Sequence
cagcggtaaaaggcttcagc

SEQ ID NO: 6315 - DNA, 20 bp, Artificial Sequence
  Description of Artificial Sequence:  Hypothetical Probe Sequence
cagcgagtaggagtgccacg

SEQ ID NO: 6316 - DNA, 20 bp, Artificial Sequence
  Description of Artificial Sequence:  Hypothetical Probe Sequence
cagccctaatacagcccgtt

SEQ ID NO: 6317 - DNA, 20 bp, Artificial Sequence
  Description of Artificial Sequence:  Hypothetical Probe Sequence
gcaacagccacgcttgcagc

SEQ ID NO: 6318 - DNA, 20 bp, Artificial Sequence
  Description of Artificial Sequence:  Hypothetical Probe Sequence
gcaagaccccattcgtcgtt

SEQ ID NO: 6319 - DNA, 20 bp, Artificial Sequence
  Description of Artificial Sequence:  Hypothetical Probe Sequence
gaccacctaatcggacacgg

SEQ ID NO: 6320 - DNA, 20 bp, Artificial Sequence
  Description of Artificial Sequence:  Hypothetical Probe Sequence
gcaagaccggacggaccacg

SEQ ID NO: 6321 - DNA, 20 bp, Artificial Sequence
  Description of Artificial Sequence:  Hypothetical Probe Sequence
gtgccttgaatctgcgggac

SEQ ID NO: 6322 - DNA, 20 bp, Artificial Sequence
  Description of Artificial Sequence:  Hypothetical Probe Sequence
gtgcctgtctgttcccacgg

SEQ ID NO: 6323 - DNA, 20 bp, Artificial Sequence
  Description of Artificial Sequence:  Hypothetical Probe Sequence
gcaagtgcggtatcccgagt

SEQ ID NO: 6324 - DNA, 20 bp, Artificial Sequence
  Description of Artificial Sequence:  Hypothetical Probe Sequence
gtgcgcaattagatcgtgcg

SEQ ID NO: 6325 - DNA, 20 bp, Artificial Sequence
  Description of Artificial Sequence:  Hypothetical Probe Sequence
gtgcacctgacctccccacg

SEQ ID NO: 6326 - DNA, 20 bp, Artificial Sequence
  Description of Artificial Sequence:  Hypothetical Probe Sequence
gtgcatcgcctagtgctccc

SEQ ID NO: 6327 - DNA, 20 bp, Artificial Sequence
  Description of Artificial Sequence:  Hypothetical Probe Sequence
gcaagtgccctagtgcgtgc

SEQ ID NO: 6328 - DNA, 20 bp, Artificial Sequence
  Description of Artificial Sequence:  Hypothetical Probe Sequence
gtgctcccgtctgtgcccat

SEQ ID NO: 6329 - DNA, 20 bp, Artificial Sequence
  Description of Artificial Sequence:  Hypothetical Probe Sequence
gcaagtgcgtgcaaaggctt

SEQ ID NO: 6330 - DNA, 20 bp, Artificial Sequence
  Description of Artificial Sequence:  Hypothetical Probe Sequence
gcaagtgcacggaccttcgt

SEQ ID NO: 6331 - DNA, 20 bp, Artificial Sequence
  Description of Artificial Sequence:  Hypothetical Probe Sequence
ggacaatccgaatgcggcaa

SEQ ID NO: 6332 - DNA, 20 bp, Artificial Sequence
  Description of Artificial Sequence:  Hypothetical Probe Sequence
ggactcgtggacgtgcgtgc

SEQ ID NO: 6333 - DNA, 20 bp, Artificial Sequence
  Description of Artificial Sequence:  Hypothetical Probe Sequence
ggacctgttctggcaaacgg

SEQ ID NO: 6334 - DNA, 20 bp, Artificial Sequence
  Description of Artificial Sequence:  Hypothetical Probe Sequence
gcaaggacatcgccattccc

SEQ ID NO: 6335 - DNA, 20 bp, Artificial Sequence
  Description of Artificial Sequence:  Hypothetical Probe Sequence
ggaccagcttagggactgcg

SEQ ID NO: 6336 - DNA, 20 bp, Artificial Sequence
  Description of Artificial Sequence:  Hypothetical Probe Sequence
gcaaggacggacaggagctt

SEQ ID NO: 6337 - DNA, 20 bp, Artificial Sequence
  Description of Artificial Sequence:  Hypothetical Probe Sequence
acggctgtcacgtgatcgaa

SEQ ID NO: 6338 - DNA, 20 bp, Artificial Sequence
  Description of Artificial Sequence:  Hypothetical Probe Sequence
gcaaacgggcttgtgcccta

SEQ ID NO: 6339 - DNA, 20 bp, Artificial Sequence
  Description of Artificial Sequence:  Hypothetical Probe Sequence
acgggtctgagtcacgcacg

SEQ ID NO: 6340 - DNA, 20 bp, Artificial Sequence
  Description of Artificial Sequence:  Hypothetical Probe Sequence
acggagtgctcacagccgtt

SEQ ID NO: 6341 - DNA, 20 bp, Artificial Sequence
  Description of Artificial Sequence:  Hypothetical Probe Sequence
acggtgcgcgaagtctgtgc

SEQ ID NO: 6342 - DNA, 20 bp, Artificial Sequence
  Description of Artificial Sequence:  Hypothetical Probe Sequence
acggggacgatgtctgcgaa

SEQ ID NO: 6343 - DNA, 20 bp, Artificial Sequence
  Description of Artificial Sequence:  Hypothetical Probe Sequence
gcaaagccgtctgtctgcaa

SEQ ID NO: 6344 - DNA, 20 bp, Artificial Sequence
  Description of Artificial Sequence:  Hypothetical Probe Sequence
gcaaagccacctccatcgaa

SEQ ID NO: 6345 - DNA, 20 bp, Artificial Sequence
  Description of Artificial Sequence:  Hypothetical Probe Sequence
agccaggaacctaaaggcaa

SEQ ID NO: 6346 - DNA, 20 bp, Artificial Sequence
  Description of Artificial Sequence:  Hypothetical Probe Sequence
gcaaagcccctagtgccgaa

SEQ ID NO: 6347 - DNA, 20 bp, Artificial Sequence
  Description of Artificial Sequence:  Hypothetical Probe Sequence
agcctcccctgtggtaagcc

SEQ ID NO: 6348 - DNA, 20 bp, Artificial Sequence
  Description of Artificial Sequence:  Hypothetical Probe Sequence
aatccgaaaggagtgctgcg

SEQ ID NO: 6349 - DNA, 20 bp, Artificial Sequence
  Description of Artificial Sequence:  Hypothetical Probe Sequence
aatcacggcagcagccacgg

SEQ ID NO: 6350 - DNA, 20 bp, Artificial Sequence
  Description of Artificial Sequence:  Hypothetical Probe Sequence
tctgcacgcagccacggacc

SEQ ID NO: 6351 - DNA, 20 bp, Artificial Sequence
  Description of Artificial Sequence:  Hypothetical Probe Sequence
tcgtacggaccttgcgtgcg

SEQ ID NO: 6352 - DNA, 20 bp, Artificial Sequence
  Description of Artificial Sequence:  Hypothetical Probe Sequence
agtgcttgccatagccagcc

SEQ ID NO: 6353 - DNA, 20 bp, Artificial Sequence
  Description of Artificial Sequence:  Hypothetical Probe Sequence
cttgggtaggacgtgcgatg

SEQ ID NO: 6354 - DNA, 20 bp, Artificial Sequence
  Description of Artificial Sequence:  Hypothetical Probe Sequence
cttgcctaccatagcccgaa

SEQ ID NO: 6355 - DNA, 20 bp, Artificial Sequence
  Description of Artificial Sequence:  Hypothetical Probe Sequence
agtgcttgggactgcgggta

SEQ ID NO: 6356 - DNA, 20 bp, Artificial Sequence
  Description of Artificial Sequence:  Hypothetical Probe Sequence
cgtttcgtagtgggactgcg

SEQ ID NO: 6357 - DNA, 20 bp, Artificial Sequence
  Description of Artificial Sequence:  Hypothetical Probe Sequence
cgttgtctgatgcgtttgcg

SEQ ID NO: 6358 - DNA, 20 bp, Artificial Sequence
  Description of Artificial Sequence:  Hypothetical Probe Sequence
ctcatccccgaaggacgacc

SEQ ID NO: 6359 - DNA, 20 bp, Artificial Sequence
  Description of Artificial Sequence:  Hypothetical Probe Sequence
ctgttcccatcggtgccagc

SEQ ID NO: 6360 - DNA, 20 bp, Artificial Sequence
  Description of Artificial Sequence:  Hypothetical Probe Sequence
ccatcttgacggctcaacgg

SEQ ID NO: 6361 - DNA, 20 bp, Artificial Sequence
  Description of Artificial Sequence:  Hypothetical Probe Sequence
cgaatgcgaaagttgaagcc

SEQ ID NO: 6362 - DNA, 20 bp, Artificial Sequence
  Description of Artificial Sequence:  Hypothetical Probe Sequence
gcttcgttcttgcacgtccc

SEQ ID NO: 6363 - DNA, 20 bp, Artificial Sequence
  Description of Artificial Sequence:  Hypothetical Probe Sequence
gctttcccggaccctacacg

SEQ ID NO: 6364 - DNA, 20 bp, Artificial Sequence
  Description of Artificial Sequence:  Hypothetical Probe Sequence
gctttgcgcctagatggctt

SEQ ID NO: 6365 - DNA, 20 bp, Artificial Sequence
  Description of Artificial Sequence:  Hypothetical Probe Sequence
gcttgaccctgtacggcagc

SEQ ID NO: 6366 - DNA, 20 bp, Artificial Sequence
  Description of Artificial Sequence:  Hypothetical Probe Sequence
gcttagcctcgtgacccacg

SEQ ID NO: 6367 - DNA, 20 bp, Artificial Sequence
  Description of Artificial Sequence:  Hypothetical Probe Sequence
ggtacgttacgggtgcccat

SEQ ID NO: 6368 - DNA, 20 bp, Artificial Sequence
  Description of Artificial Sequence:  Hypothetical Probe Sequence
ggtatgcggcttgaccctca

SEQ ID NO: 6369 - DNA, 20 bp, Artificial Sequence
  Description of Artificial Sequence:  Hypothetical Probe Sequence
gcaaaaagtctgctgttgcg

SEQ ID NO: 6370 - DNA, 20 bp, Artificial Sequence
  Description of Artificial Sequence:  Hypothetical Probe Sequence
gcaaagtgagcctgcgcagc

SEQ ID NO: 6371 - DNA, 20 bp, Artificial Sequence
  Description of Artificial Sequence:  Hypothetical Probe Sequence
gcaagacctcgtgtgcgtgc

SEQ ID NO: 6372 - DNA, 20 bp, Artificial Sequence
  Description of Artificial Sequence:  Hypothetical Probe Sequence
atcgctcaacggagccggta

SEQ ID NO: 6373 - DNA, 20 bp, Artificial Sequence
  Description of Artificial Sequence:  Hypothetical Probe Sequence
atcgtgcgaccttgtcacgg

SEQ ID NO: 6374 - DNA, 20 bp, Artificial Sequence
  Description of Artificial Sequence:  Hypothetical Probe Sequence
atcgcagcaccttgcggagt

SEQ ID NO: 6375 - DNA, 20 bp, Artificial Sequence
  Description of Artificial Sequence:  Hypothetical Probe Sequence
atcggtgcatcggcttgcaa

SEQ ID NO: 6376 - DNA, 20 bp, Artificial Sequence
  Description of Artificial Sequence:  Hypothetical Probe Sequence
atcgacggggtatcccacgg

SEQ ID NO: 6377 - DNA, 20 bp, Artificial Sequence
  Description of Artificial Sequence:  Hypothetical Probe Sequence
cctatccccttggcttcgtt

SEQ ID NO: 6378 - DNA, 20 bp, Artificial Sequence
  Description of Artificial Sequence:  Hypothetical Probe Sequence
cctacagcgcaatgcgcacg

SEQ ID NO: 6379 - DNA, 20 bp, Artificial Sequence
  Description of Artificial Sequence:  Hypothetical Probe Sequence
cctagtgcgcttacgggcaa

SEQ ID NO: 6380 - DNA, 20 bp, Artificial Sequence
  Description of Artificial Sequence:  Hypothetical Probe Sequence
gatgagccggacacggccta

SEQ ID NO: 6381 - DNA, 20 bp, Artificial Sequence
  Description of Artificial Sequence:  Hypothetical Probe Sequence
tccctcgtagccagccagga

SEQ ID NO: 6382 - DNA, 20 bp, Artificial Sequence
  Description of Artificial Sequence:  Hypothetical Probe Sequence
tcccctgttcccgatgcagc

SEQ ID NO: 6383 - DNA, 20 bp, Artificial Sequence
  Description of Artificial Sequence:  Hypothetical Probe Sequence
tcccgtgcataccgaaatcg

SEQ ID NO: 6384 - DNA, 20 bp, Artificial Sequence
  Description of Artificial Sequence:  Hypothetical Probe Sequence
tgcgaatctgcgcagcagga

SEQ ID NO: 6385 - DNA, 20 bp, Artificial Sequence
  Description of Artificial Sequence:  Hypothetical Probe Sequence
tgcgcttggtctgaccacgg

SEQ ID NO: 6386 - DNA, 20 bp, Artificial Sequence
  Description of Artificial Sequence:  Hypothetical Probe Sequence
tgcgcgaactgtgatgccat

SEQ ID NO: 6387 - DNA, 20 bp, Artificial Sequence
  Description of Artificial Sequence:  Hypothetical Probe Sequence
tgcgcctagagtagccgctt

SEQ ID NO: 6388 - DNA, 20 bp, Artificial Sequence
  Description of Artificial Sequence:  Hypothetical Probe Sequence
tgcgtgcgtacacacgccat

SEQ ID NO: 6389 - DNA, 20 bp, Artificial Sequence
  Description of Artificial Sequence:  Hypothetical Probe Sequence
agtgcacgcgttaaagagcc

SEQ ID NO: 6390 - DNA, 20 bp, Artificial Sequence
  Description of Artificial Sequence:  Hypothetical Probe Sequence
cacgcgaatacacagcacgg

SEQ ID NO: 6391 - DNA, 20 bp, Artificial Sequence
  Description of Artificial Sequence:  Hypothetical Probe Sequence
cacgtgcgcgtttacaagcc

SEQ ID NO: 6392 - DNA, 20 bp, Artificial Sequence
  Description of Artificial Sequence:  Hypothetical Probe Sequence
cacggaccttagagccccat

SEQ ID NO: 6393 - DNA, 20 bp, Artificial Sequence
  Description of Artificial Sequence:  Hypothetical Probe Sequence
cagcgcttcctaaaaggtgc

SEQ ID NO: 6394 - DNA, 20 bp, Artificial Sequence
  Description of Artificial Sequence:  Hypothetical Probe Sequence
gaccgcaacctagtgcatcg

SEQ ID NO: 6395 - DNA, 20 bp, Artificial Sequence
  Description of Artificial Sequence:  Hypothetical Probe Sequence
gaccggactctgtcccgacc

SEQ ID NO: 6396 - DNA, 20 bp, Artificial Sequence
  Description of Artificial Sequence:  Hypothetical Probe Sequence
gtgcaatcctcagtgctccc

SEQ ID NO: 6397 - DNA, 20 bp, Artificial Sequence
  Description of Artificial Sequence:  Hypothetical Probe Sequence
gtgcccatcgaagcttggac

SEQ ID NO: 6398 - DNA, 20 bp, Artificial Sequence
  Description of Artificial Sequence:  Hypothetical Probe Sequence
gtgcgtctatactgcgcagc

SEQ ID NO: 6399 - DNA, 20 bp, Artificial Sequence
  Description of Artificial Sequence:  Hypothetical Probe Sequence
gtgcgagtcctatgcggacc

SEQ ID NO: 6400 - DNA, 20 bp, Artificial Sequence
  Description of Artificial Sequence:  Hypothetical Probe Sequence
ggactcgtcttgatcgtgcg

SEQ ID NO: 6401 - DNA, 20 bp, Artificial Sequence
  Description of Artificial Sequence:  Hypothetical Probe Sequence
ggacccataatccttgtgcg

SEQ ID NO: 6402 - DNA, 20 bp, Artificial Sequence
  Description of Artificial Sequence:  Hypothetical Probe Sequence
acggctcagtgctgcgccat

SEQ ID NO: 6403 - DNA, 20 bp, Artificial Sequence
  Description of Artificial Sequence:  Hypothetical Probe Sequence
acggggtacttgggacgtgc

SEQ ID NO: 6404 - DNA, 20 bp, Artificial Sequence
  Description of Artificial Sequence:  Hypothetical Probe Sequence
acgggatgtgattccccgtt

SEQ ID NO: 6405 - DNA, 20 bp, Artificial Sequence
  Description of Artificial Sequence:  Hypothetical Probe Sequence
acggggacgtcttcccagga

SEQ ID NO: 6406 - DNA, 20 bp, Artificial Sequence
  Description of Artificial Sequence:  Hypothetical Probe Sequence
agcccttgataccagcgcaa

SEQ ID NO: 6407 - DNA, 20 bp, Artificial Sequence
  Description of Artificial Sequence:  Hypothetical Probe Sequence
agccatcgaaagcgttcgaa

SEQ ID NO: 6408 - DNA, 20 bp, Artificial Sequence
  Description of Artificial Sequence:  Hypothetical Probe Sequence
agccggacgtctagccacgg

SEQ ID NO: 6409 - DNA, 20 bp, Artificial Sequence
  Description of Artificial Sequence:  Hypothetical Probe Sequence
ttgacgaatgcgacggtcgt

SEQ ID NO: 6410 - DNA, 20 bp, Artificial Sequence
  Description of Artificial Sequence:  Hypothetical Probe Sequence
accttgattgcgtgcggtct

SEQ ID NO: 6411 - DNA, 20 bp, Artificial Sequence
  Description of Artificial Sequence:  Hypothetical Probe Sequence
accttctgcttgtgcggctt

SEQ ID NO: 6412 - DNA, 20 bp, Artificial Sequence
  Description of Artificial Sequence:  Hypothetical Probe Sequence
tctgtgcgcagcgtcttccc

SEQ ID NO: 6413 - DNA, 20 bp, Artificial Sequence
  Description of Artificial Sequence:  Hypothetical Probe Sequence
tgtcccatgtgcccatcacg

SEQ ID NO: 6414 - DNA, 20 bp, Artificial Sequence
  Description of Artificial Sequence:  Hypothetical Probe Sequence
tcgttcgtatcgtgcgagcc

SEQ ID NO: 6415 - DNA, 20 bp, Artificial Sequence
  Description of Artificial Sequence:  Hypothetical Probe Sequence
tcgtcgttacggccatacgg

SEQ ID NO: 6416 - DNA, 20 bp, Artificial Sequence
  Description of Artificial Sequence:  Hypothetical Probe Sequence
tcgttcccttaggatgtgcg

SEQ ID NO: 6417 - DNA, 20 bp, Artificial Sequence
  Description of Artificial Sequence:  Hypothetical Probe Sequence
tcgtcagcacggtgcgctca

SEQ ID NO: 6418 - DNA, 20 bp, Artificial Sequence
  Description of Artificial Sequence:  Hypothetical Probe Sequence
cttggcttcctatgcgtgcg

SEQ ID NO: 6419 - DNA, 20 bp, Artificial Sequence
  Description of Artificial Sequence:  Hypothetical Probe Sequence
cgttcttgccatacggcgaa

SEQ ID NO: 6420 - DNA, 20 bp, Artificial Sequence
  Description of Artificial Sequence:  Hypothetical Probe Sequence
cgttccatagccctgtgtgc

SEQ ID NO: 6421 - DNA, 20 bp, Artificial Sequence
  Description of Artificial Sequence:  Hypothetical Probe Sequence
ccatcacggcttgagttgcg

SEQ ID NO: 6422 - DNA, 20 bp, Artificial Sequence
  Description of Artificial Sequence:  Hypothetical Probe Sequence
ccatacgggatgcacgccta

SEQ ID NO: 6423 - DNA, 20 bp, Artificial Sequence
  Description of Artificial Sequence:  Hypothetical Probe Sequence
cgaacgttagcccagcgagt

SEQ ID NO: 6424 - DNA, 20 bp, Artificial Sequence
  Description of Artificial Sequence:  Hypothetical Probe Sequence
cgaaggtatgcgctcatgcg

SEQ ID NO: 6425 - DNA, 20 bp, Artificial Sequence
  Description of Artificial Sequence:  Hypothetical Probe Sequence
acctgcttcttgtccccacg

SEQ ID NO: 6426 - DNA, 20 bp, Artificial Sequence
  Description of Artificial Sequence:  Hypothetical Probe Sequence
acctgctttgcggagtcgaa

SEQ ID NO: 6427 - DNA, 20 bp, Artificial Sequence
  Description of Artificial Sequence:  Hypothetical Probe Sequence
gcttcagccttgcacgtgcg

SEQ ID NO: 6428 - DNA, 20 bp, Artificial Sequence
  Description of Artificial Sequence:  Hypothetical Probe Sequence
gcaatgatgcaatgcgtgcg

SEQ ID NO: 6429 - DNA, 20 bp, Artificial Sequence
  Description of Artificial Sequence:  Hypothetical Probe Sequence
gcaagagtcttggtgcagcc

SEQ ID NO: 6430 - DNA, 20 bp, Artificial Sequence
  Description of Artificial Sequence:  Hypothetical Probe Sequence
agtgccattctgcagcgctt

SEQ ID NO: 6431 - DNA, 20 bp, Artificial Sequence
  Description of Artificial Sequence:  Hypothetical Probe Sequence
tcccaatcgatggtgcatcg

SEQ ID NO: 6432 - DNA, 20 bp, Artificial Sequence
  Description of Artificial Sequence:  Hypothetical Probe Sequence
tcccaaagtgattgcggtgc

SEQ ID NO: 6433 - DNA, 20 bp, Artificial Sequence
  Description of Artificial Sequence:  Hypothetical Probe Sequence
tcccctgtcagcgagttcgt

SEQ ID NO: 6434 - DNA, 20 bp, Artificial Sequence
  Description of Artificial Sequence:  Hypothetical Probe Sequence
tcccacctcgaacacgccta

SEQ ID NO: 6435 - DNA, 20 bp, Artificial Sequence
  Description of Artificial Sequence:  Hypothetical Probe Sequence
tcccatcgtcgtcacgtcgt

SEQ ID NO: 6436 - DNA, 20 bp, Artificial Sequence
  Description of Artificial Sequence:  Hypothetical Probe Sequence
accttccccctaagcctccc

SEQ ID NO: 6437 - DNA, 20 bp, Artificial Sequence
  Description of Artificial Sequence:  Hypothetical Probe Sequence
tcccacggctcagatgacgg

SEQ ID NO: 6438 - DNA, 20 bp, Artificial Sequence
  Description of Artificial Sequence:  Hypothetical Probe Sequence
tgcgttgatgattgcgtcgt

SEQ ID NO: 6439 - DNA, 20 bp, Artificial Sequence
  Description of Artificial Sequence:  Hypothetical Probe Sequence
tgcgcgaaaaagtcgtcgtt

SEQ ID NO: 6440 - DNA, 20 bp, Artificial Sequence
  Description of Artificial Sequence:  Hypothetical Probe Sequence
tgcggcttgctttcgtctca

SEQ ID NO: 6441 - DNA, 20 bp, Artificial Sequence
  Description of Artificial Sequence:  Hypothetical Probe Sequence
tgcgacggcagcacctctca

SEQ ID NO: 6442 - DNA, 20 bp, Artificial Sequence
  Description of Artificial Sequence:  Hypothetical Probe Sequence
cacgaaagtcccagccacgg

SEQ ID NO: 6443 - DNA, 20 bp, Artificial Sequence
  Description of Artificial Sequence:  Hypothetical Probe Sequence
acctcacggtcttccccgaa

SEQ ID NO: 6444 - DNA, 20 bp, Artificial Sequence
  Description of Artificial Sequence:  Hypothetical Probe Sequence
cacggagtctgtacggtgcg

SEQ ID NO: 6445 - DNA, 20 bp, Artificial Sequence
  Description of Artificial Sequence:  Hypothetical Probe Sequence
cacgtcccccatacggctca

SEQ ID NO: 6446 - DNA, 20 bp, Artificial Sequence
  Description of Artificial Sequence:  Hypothetical Probe Sequence
gacccgaactgtggaccagc

SEQ ID NO: 6447 - DNA, 20 bp, Artificial Sequence
  Description of Artificial Sequence:  Hypothetical Probe Sequence
acctgacccacgaaaggcaa

SEQ ID NO: 6448 - DNA, 20 bp, Artificial Sequence
  Description of Artificial Sequence:  Hypothetical Probe Sequence
acctgaccacggttgatgcg

SEQ ID NO: 6449 - DNA, 20 bp, Artificial Sequence
  Description of Artificial Sequence:  Hypothetical Probe Sequence
gtgcctcagcaagatgacgg

SEQ ID NO: 6450 - DNA, 20 bp, Artificial Sequence
  Description of Artificial Sequence:  Hypothetical Probe Sequence
gtgcgagtcgaaacgggtgc

SEQ ID NO: 6451 - DNA, 20 bp, Artificial Sequence
  Description of Artificial Sequence:  Hypothetical Probe Sequence
gtgcacctcagcgatgcagc

SEQ ID NO: 6452 - DNA, 20 bp, Artificial Sequence
  Description of Artificial Sequence:  Hypothetical Probe Sequence
acctgtgcaggatcccacgg

SEQ ID NO: 6453 - DNA, 20 bp, Artificial Sequence
  Description of Artificial Sequence:  Hypothetical Probe Sequence
gtgccctacacgggacatcg

SEQ ID NO: 6454 - DNA, 20 bp, Artificial Sequence
  Description of Artificial Sequence:  Hypothetical Probe Sequence
ggaccttgtgcgaatcgctt

SEQ ID NO: 6455 - DNA, 20 bp, Artificial Sequence
  Description of Artificial Sequence:  Hypothetical Probe Sequence
acctggacgatgtgcgctgt

SEQ ID NO: 6456 - DNA, 20 bp, Artificial Sequence
  Description of Artificial Sequence:  Hypothetical Probe Sequence
ggactccctcgtcagcgatg

SEQ ID NO: 6457 - DNA, 20 bp, Artificial Sequence
  Description of Artificial Sequence:  Hypothetical Probe Sequence
ggacagccaatccacgagcc

SEQ ID NO: 6458 - DNA, 20 bp, Artificial Sequence
  Description of Artificial Sequence:  Hypothetical Probe Sequence
acggttgacgaagcaatgcg

SEQ ID NO: 6459 - DNA, 20 bp, Artificial Sequence
  Description of Artificial Sequence:  Hypothetical Probe Sequence
acggcgttcgaagcttggta

SEQ ID NO: 6460 - DNA, 20 bp, Artificial Sequence
  Description of Artificial Sequence:  Hypothetical Probe Sequence
ttgacgaaagccagccgcaa

SEQ ID NO: 6461 - DNA, 20 bp, Artificial Sequence
  Description of Artificial Sequence:  Hypothetical Probe Sequence
ttgaaggatgcggaccatcg

SEQ ID NO: 6462 - DNA, 20 bp, Artificial Sequence
  Description of Artificial Sequence:  Hypothetical Probe Sequence
ttgaacggtgcgtctggatg

SEQ ID NO: 6463 - DNA, 20 bp, Artificial Sequence
  Description of Artificial Sequence:  Hypothetical Probe Sequence
tgatcacggtgcacggcgaa

SEQ ID NO: 6464 - DNA, 20 bp, Artificial Sequence
  Description of Artificial Sequence:  Hypothetical Probe Sequence
ttaggtgcaccttgcgccta

SEQ ID NO: 6465 - DNA, 20 bp, Artificial Sequence
  Description of Artificial Sequence:  Hypothetical Probe Sequence
atcgaatccgttacggtgcg

SEQ ID NO: 6466 - DNA, 20 bp, Artificial Sequence
  Description of Artificial Sequence:  Hypothetical Probe Sequence
aatcctcaatcggcaacacg

SEQ ID NO: 6467 - DNA, 20 bp, Artificial Sequence
  Description of Artificial Sequence:  Hypothetical Probe Sequence
aatcatcgggacagccacgg

SEQ ID NO: 6468 - DNA, 20 bp, Artificial Sequence
  Description of Artificial Sequence:  Hypothetical Probe Sequence
aatcgacctgcgtcccatcg

SEQ ID NO: 6469 - DNA, 20 bp, Artificial Sequence
  Description of Artificial Sequence:  Hypothetical Probe Sequence
aatcggaccttgatcggtgc

SEQ ID NO: 6470 - DNA, 20 bp, Artificial Sequence
  Description of Artificial Sequence:  Hypothetical Probe Sequence
atcgatacgctttgcgctgt

SEQ ID NO: 6471 - DNA, 20 bp, Artificial Sequence
  Description of Artificial Sequence:  Hypothetical Probe Sequence
ataccagcccattgcggcaa

SEQ ID NO: 6472 - DNA, 20 bp, Artificial Sequence
  Description of Artificial Sequence:  Hypothetical Probe Sequence
atacacggttgaacggcgaa

SEQ ID NO: 6473 - DNA, 20 bp, Artificial Sequence
  Description of Artificial Sequence:  Hypothetical Probe Sequence
tctgccatgcttcacgacgg

SEQ ID NO: 6474 - DNA, 20 bp, Artificial Sequence
  Description of Artificial Sequence:  Hypothetical Probe Sequence
tctgcctaagccgatgacgg

SEQ ID NO: 6475 - DNA, 20 bp, Artificial Sequence
  Description of Artificial Sequence:  Hypothetical Probe Sequence
tctgcagcggacagtggcaa

SEQ ID NO: 6476 - DNA, 20 bp, Artificial Sequence
  Description of Artificial Sequence:  Hypothetical Probe Sequence
tgtcccattcgtgcaacacg

SEQ ID NO: 6477 - DNA, 20 bp, Artificial Sequence
  Description of Artificial Sequence:  Hypothetical Probe Sequence
tgtcgtgcgatgacggtgcg

SEQ ID NO: 6478 - DNA, 20 bp, Artificial Sequence
  Description of Artificial Sequence:  Hypothetical Probe Sequence
tcgtttgacacgggacgcaa

SEQ ID NO: 6479 - DNA, 20 bp, Artificial Sequence
  Description of Artificial Sequence:  Hypothetical Probe Sequence
tcgtgatgggacgctttccc

SEQ ID NO: 6480 - DNA, 20 bp, Artificial Sequence
  Description of Artificial Sequence:  Hypothetical Probe Sequence
tcgtgtgcttgactgttgcg

SEQ ID NO: 6481 - DNA, 20 bp, Artificial Sequence
  Description of Artificial Sequence:  Hypothetical Probe Sequence
tcgtagcccagctctgcgaa

SEQ ID NO: 6482 - DNA, 20 bp, Artificial Sequence
  Description of Artificial Sequence:  Hypothetical Probe Sequence
atcgcttgcttgcgaagcaa

SEQ ID NO: 6483 - DNA, 20 bp, Artificial Sequence
  Description of Artificial Sequence:  Hypothetical Probe Sequence
atcgcttgggtatcgttgcg

SEQ ID NO: 6484 - DNA, 20 bp, Artificial Sequence
  Description of Artificial Sequence:  Hypothetical Probe Sequence
atcgcttgaccttgtcgctt

SEQ ID NO: 6485 - DNA, 20 bp, Artificial Sequence
  Description of Artificial Sequence:  Hypothetical Probe Sequence
cttgcctatgatcagcagcc

SEQ ID NO: 6486 - DNA, 20 bp, Artificial Sequence
  Description of Artificial Sequence:  Hypothetical Probe Sequence
atcgcttgcacggagttccc

SEQ ID NO: 6487 - DNA, 20 bp, Artificial Sequence
  Description of Artificial Sequence:  Hypothetical Probe Sequence
cgtttgatacggtctggtgc

SEQ ID NO: 6488 - DNA, 20 bp, Artificial Sequence
  Description of Artificial Sequence:  Hypothetical Probe Sequence
cgttttaggcttagccgctt

SEQ ID NO: 6489 - DNA, 20 bp, Artificial Sequence
  Description of Artificial Sequence:  Hypothetical Probe Sequence
atcgcgttaaagcacggtct

SEQ ID NO: 6490 - DNA, 20 bp, Artificial Sequence
  Description of Artificial Sequence:  Hypothetical Probe Sequence
atcgcgttcttgggtaagcc

SEQ ID NO: 6491 - DNA, 20 bp, Artificial Sequence
  Description of Artificial Sequence:  Hypothetical Probe Sequence
atcgcgttcgttcagcatcg

SEQ ID NO: 6492 - DNA, 20 bp, Artificial Sequence
  Description of Artificial Sequence:  Hypothetical Probe Sequence
atcgcgttctgttccccgaa

SEQ ID NO: 6493 - DNA, 20 bp, Artificial Sequence
  Description of Artificial Sequence:  Hypothetical Probe Sequence
atcgcgttggtatgtccagc

SEQ ID NO: 6494 - DNA, 20 bp, Artificial Sequence
  Description of Artificial Sequence:  Hypothetical Probe Sequence
cgttagtgtctgacggcacg

SEQ ID NO: 6495 - DNA, 20 bp, Artificial Sequence
  Description of Artificial Sequence:  Hypothetical Probe Sequence
cgttatcggcttagtgcacg

SEQ ID NO: 6496 - DNA, 20 bp, Artificial Sequence
  Description of Artificial Sequence:  Hypothetical Probe Sequence
cgttgatgtacaccattgcg

SEQ ID NO: 6497 - DNA, 20 bp, Artificial Sequence
  Description of Artificial Sequence:  Hypothetical Probe Sequence
atcgcgttggactacaagcc

SEQ ID NO: 6498 - DNA, 20 bp, Artificial Sequence
  Description of Artificial Sequence:  Hypothetical Probe Sequence
ctcatgatacggtccccacg

SEQ ID NO: 6499 - DNA, 20 bp, Artificial Sequence
  Description of Artificial Sequence:  Hypothetical Probe Sequence
atcgctcacgtttgcgacct

SEQ ID NO: 6500 - DNA, 20 bp, Artificial Sequence
  Description of Artificial Sequence:  Hypothetical Probe Sequence
ctcagatggcaagacctgcg

SEQ ID NO: 6501 - DNA, 20 bp, Artificial Sequence
  Description of Artificial Sequence:  Hypothetical Probe Sequence
ctgttgattcccagcctgcg

SEQ ID NO: 6502 - DNA, 20 bp, Artificial Sequence
  Description of Artificial Sequence:  Hypothetical Probe Sequence
atcgctgttgtccacgcacg

SEQ ID NO: 6503 - DNA, 20 bp, Artificial Sequence
  Description of Artificial Sequence:  Hypothetical Probe Sequence
ctgtcttgccattgcgcagc

SEQ ID NO: 6504 - DNA, 20 bp, Artificial Sequence
  Description of Artificial Sequence:  Hypothetical Probe Sequence
atcgctgtgcaatgcgtgtc

SEQ ID NO: 6505 - DNA, 20 bp, Artificial Sequence
  Description of Artificial Sequence:  Hypothetical Probe Sequence
atcgctgttgcgcgtttgat

SEQ ID NO: 6506 - DNA, 20 bp, Artificial Sequence
  Description of Artificial Sequence:  Hypothetical Probe Sequence
atcgctgtcacgaatctgcg

SEQ ID NO: 6507 - DNA, 20 bp, Artificial Sequence
  Description of Artificial Sequence:  Hypothetical Probe Sequence
ctgtgaccgaccctcatgcg

SEQ ID NO: 6508 - DNA, 20 bp, Artificial Sequence
  Description of Artificial Sequence:  Hypothetical Probe Sequence
atcgccatttgatgcgtgat

SEQ ID NO: 6509 - DNA, 20 bp, Artificial Sequence
  Description of Artificial Sequence:  Hypothetical Probe Sequence
ccattgatcgaacttgcgaa

SEQ ID NO: 6510 - DNA, 20 bp, Artificial Sequence
  Description of Artificial Sequence:  Hypothetical Probe Sequence
atcgccattcgtaatccgtt

SEQ ID NO: 6511 - DNA, 20 bp, Artificial Sequence
  Description of Artificial Sequence:  Hypothetical Probe Sequence
atcgccatcttgaaagcttg

SEQ ID NO: 6512 - DNA, 20 bp, Artificial Sequence
  Description of Artificial Sequence:  Hypothetical Probe Sequence
atcgccatctcacttgcgaa

SEQ ID NO: 6513 - DNA, 20 bp, Artificial Sequence
  Description of Artificial Sequence:  Hypothetical Probe Sequence
atcgccatgcttctgtgtgc

SEQ ID NO: 6514 - DNA, 20 bp, Artificial Sequence
  Description of Artificial Sequence:  Hypothetical Probe Sequence
atcgccataggaagcccgtt

SEQ ID NO: 6515 - DNA, 20 bp, Artificial Sequence
  Description of Artificial Sequence:  Hypothetical Probe Sequence
atcgccatcctaaggaacgg

SEQ ID NO: 6516 - DNA, 20 bp, Artificial Sequence
  Description of Artificial Sequence:  Hypothetical Probe Sequence
atcgccatgtgcttaggcaa

SEQ ID NO: 6517 - DNA, 20 bp, Artificial Sequence
  Description of Artificial Sequence:  Hypothetical Probe Sequence
cgaaatacctcatcccacgg

SEQ ID NO: 6518 - DNA, 20 bp, Artificial Sequence
  Description of Artificial Sequence:  Hypothetical Probe Sequence
atcgcgaatctgctcatgcg

SEQ ID NO: 6519 - DNA, 20 bp, Artificial Sequence
  Description of Artificial Sequence:  Hypothetical Probe Sequence
cgaatcgtggtaaatcgtgc

SEQ ID NO: 6520 - DNA, 20 bp, Artificial Sequence
  Description of Artificial Sequence:  Hypothetical Probe Sequence
atcgcgaactgtcttgcacg

SEQ ID NO: 6521 - DNA, 20 bp, Artificial Sequence
  Description of Artificial Sequence:  Hypothetical Probe Sequence
cgaaggtattgagaccagcc

SEQ ID NO: 6522 - DNA, 20 bp, Artificial Sequence
  Description of Artificial Sequence:  Hypothetical Probe Sequence
atcgcgaagtctcgaagcaa

SEQ ID NO: 6523 - DNA, 20 bp, Artificial Sequence
  Description of Artificial Sequence:  Hypothetical Probe Sequence
atcgcgaaacctccatggta

SEQ ID NO: 6524 - DNA, 20 bp, Artificial Sequence
  Description of Artificial Sequence:  Hypothetical Probe Sequence
atcgcgaacctacagctcgt

SEQ ID NO: 6525 - DNA, 20 bp, Artificial Sequence
  Description of Artificial Sequence:  Hypothetical Probe Sequence
atcgcgaatgcgtgtcgcaa

SEQ ID NO: 6526 - DNA, 20 bp, Artificial Sequence
  Description of Artificial Sequence:  Hypothetical Probe Sequence
cgaagaccataccacgacgg

SEQ ID NO: 6527 - DNA, 20 bp, Artificial Sequence
  Description of Artificial Sequence:  Hypothetical Probe Sequence
gcttttagccatcagctgcg

SEQ ID NO: 6528 - DNA, 20 bp, Artificial Sequence
  Description of Artificial Sequence:  Hypothetical Probe Sequence
gctttacaccatgtgcggac

SEQ ID NO: 6529 - DNA, 20 bp, Artificial Sequence
  Description of Artificial Sequence:  Hypothetical Probe Sequence
gctttctgttgacagcgacc

SEQ ID NO: 6530 - DNA, 20 bp, Artificial Sequence
  Description of Artificial Sequence:  Hypothetical Probe Sequence
atcggcttcgttgaccacct

SEQ ID NO: 6531 - DNA, 20 bp, Artificial Sequence
  Description of Artificial Sequence:  Hypothetical Probe Sequence
gcttctgtatcggacccagc

SEQ ID NO: 6532 - DNA, 20 bp, Artificial Sequence
  Description of Artificial Sequence:  Hypothetical Probe Sequence
atcggcttgtgcttagcagc

SEQ ID NO: 6533 - DNA, 20 bp, Artificial Sequence
  Description of Artificial Sequence:  Hypothetical Probe Sequence
ggtacgttaggacacgcgtt

SEQ ID NO: 6534 - DNA, 20 bp, Artificial Sequence
  Description of Artificial Sequence:  Hypothetical Probe Sequence
ggtagcaagtctcagcgtgc

SEQ ID NO: 6535 - DNA, 20 bp, Artificial Sequence
  Description of Artificial Sequence:  Hypothetical Probe Sequence
atcgggtaaggaacctgcaa

SEQ ID NO: 6536 - DNA, 20 bp, Artificial Sequence
  Description of Artificial Sequence:  Hypothetical Probe Sequence
atcgggtatcccaggaccat

SEQ ID NO: 6537 - DNA, 20 bp, Artificial Sequence
  Description of Artificial Sequence:  Hypothetical Probe Sequence
atcgggtaacggtacagcaa

SEQ ID NO: 6538 - DNA, 20 bp, Artificial Sequence
  Description of Artificial Sequence:  Hypothetical Probe Sequence
atcgggtaagcctgatacgg

SEQ ID NO: 6539 - DNA, 20 bp, Artificial Sequence
  Description of Artificial Sequence:  Hypothetical Probe Sequence
atcggtctcgaaaatcgcaa

SEQ ID NO: 6540 - DNA, 20 bp, Artificial Sequence
  Description of Artificial Sequence:  Hypothetical Probe Sequence
atcggtctgcttagccggta

SEQ ID NO: 6541 - DNA, 20 bp, Artificial Sequence
  Description of Artificial Sequence:  Hypothetical Probe Sequence
gtctatcgcacgggaccagc

SEQ ID NO: 6542 - DNA, 20 bp, Artificial Sequence
  Description of Artificial Sequence:  Hypothetical Probe Sequence
atcggtctacggccatggac

SEQ ID NO: 6543 - DNA, 20 bp, Artificial Sequence
  Description of Artificial Sequence:  Hypothetical Probe Sequence
gagtgcaagcttgaccggac

SEQ ID NO: 6544 - DNA, 20 bp, Artificial Sequence
  Description of Artificial Sequence:  Hypothetical Probe Sequence
gagtatcgcttgcagcgcaa

SEQ ID NO: 6545 - DNA, 20 bp, Artificial Sequence
  Description of Artificial Sequence:  Hypothetical Probe Sequence
gagtcagcttagacggcacg

SEQ ID NO: 6546 - DNA, 20 bp, Artificial Sequence
  Description of Artificial Sequence:  Hypothetical Probe Sequence
atcggcaatgattgcgacct

SEQ ID NO: 6547 - DNA, 20 bp, Artificial Sequence
  Description of Artificial Sequence:  Hypothetical Probe Sequence
atcggcaatacaaatcgcaa

SEQ ID NO: 6548 - DNA, 20 bp, Artificial Sequence
  Description of Artificial Sequence:  Hypothetical Probe Sequence
gcaatgtctccctctgcacg

SEQ ID NO: 6549 - DNA, 20 bp, Artificial Sequence
  Description of Artificial Sequence:  Hypothetical Probe Sequence
gcaactcaaaagggaccacg

SEQ ID NO: 6550 - DNA, 20 bp, Artificial Sequence
  Description of Artificial Sequence:  Hypothetical Probe Sequence
gcaaccataccttctggcaa

SEQ ID NO: 6551 - DNA, 20 bp, Artificial Sequence
  Description of Artificial Sequence:  Hypothetical Probe Sequence
gcaagcttttagatcgcgaa

SEQ ID NO: 6552 - DNA, 20 bp, Artificial Sequence
  Description of Artificial Sequence:  Hypothetical Probe Sequence
atcggcaagagtagccgtct

SEQ ID NO: 6553 - DNA, 20 bp, Artificial Sequence
  Description of Artificial Sequence:  Hypothetical Probe Sequence
gcaagcaatcgtagtggcaa

SEQ ID NO: 6554 - DNA, 20 bp, Artificial Sequence
  Description of Artificial Sequence:  Hypothetical Probe Sequence
atcggcaaagtgcttgatcg

SEQ ID NO: 6555 - DNA, 20 bp, Artificial Sequence
  Description of Artificial Sequence:  Hypothetical Probe Sequence
atcggcaaaggaagtggtgc

SEQ ID NO: 6556 - DNA, 20 bp, Artificial Sequence
  Description of Artificial Sequence:  Hypothetical Probe Sequence
atcggcaacagcagtgctgt

SEQ ID NO: 6557 - DNA, 20 bp, Artificial Sequence
  Description of Artificial Sequence:  Hypothetical Probe Sequence
atcggcaaggactgtcggta

SEQ ID NO: 6558 - DNA, 20 bp, Artificial Sequence
  Description of Artificial Sequence:  Hypothetical Probe Sequence
agtgcgaatgatggaccacg

SEQ ID NO: 6559 - DNA, 20 bp, Artificial Sequence
  Description of Artificial Sequence:  Hypothetical Probe Sequence
atcgagtgcctatgcgctca

SEQ ID NO: 6560 - DNA, 20 bp, Artificial Sequence
  Description of Artificial Sequence:  Hypothetical Probe Sequence
agtggtgcttgaacggagcc

SEQ ID NO: 6561 - DNA, 20 bp, Artificial Sequence
  Description of Artificial Sequence:  Hypothetical Probe Sequence
acctggtaacggcacggacc

SEQ ID NO: 6562 - DNA, 20 bp, Artificial Sequence
  Description of Artificial Sequence:  Hypothetical Probe Sequence
acctgcaatctgaggaacgg

SEQ ID NO: 6563 - DNA, 20 bp, Artificial Sequence
  Description of Artificial Sequence:  Hypothetical Probe Sequence
atcgacctggaccacgtgcg

SEQ ID NO: 6564 - DNA, 20 bp, Artificial Sequence
  Description of Artificial Sequence:  Hypothetical Probe Sequence
atcgctgtatcgcagccgaa

SEQ ID NO: 6565 - DNA, 20 bp, Artificial Sequence
  Description of Artificial Sequence:  Hypothetical Probe Sequence
atcggcttaggagacccgtt

SEQ ID NO: 6566 - DNA, 20 bp, Artificial Sequence
  Description of Artificial Sequence:  Hypothetical Probe Sequence
atcgatcgaggaagccggac

SEQ ID NO: 6567 - DNA, 20 bp, Artificial Sequence
  Description of Artificial Sequence:  Hypothetical Probe Sequence
atcggtgccgtttgtcagcc

SEQ ID NO: 6568 - DNA, 20 bp, Artificial Sequence
  Description of Artificial Sequence:  Hypothetical Probe Sequence
aggaacctgcttagcccacg

SEQ ID NO: 6569 - DNA, 20 bp, Artificial Sequence
  Description of Artificial Sequence:  Hypothetical Probe Sequence
aggaatcggtgcctgtgcaa

SEQ ID NO: 6570 - DNA, 20 bp, Artificial Sequence
  Description of Artificial Sequence:  Hypothetical Probe Sequence
atcgcctatgatacggcagc

SEQ ID NO: 6571 - DNA, 20 bp, Artificial Sequence
  Description of Artificial Sequence:  Hypothetical Probe Sequence
cctaaaagctcaagccacgg

SEQ ID NO: 6572 - DNA, 20 bp, Artificial Sequence
  Description of Artificial Sequence:  Hypothetical Probe Sequence
atcgcctatgtcccattgcg

SEQ ID NO: 6573 - DNA, 20 bp, Artificial Sequence
  Description of Artificial Sequence:  Hypothetical Probe Sequence
atcgcctacgtttcgtccat

SEQ ID NO: 6574 - DNA, 20 bp, Artificial Sequence
  Description of Artificial Sequence:  Hypothetical Probe Sequence
atcgcctagctttcccctca

SEQ ID NO: 6575 - DNA, 20 bp, Artificial Sequence
  Description of Artificial Sequence:  Hypothetical Probe Sequence
cctaaggaatacacggcacg

SEQ ID NO: 6576 - DNA, 20 bp, Artificial Sequence
  Description of Artificial Sequence:  Hypothetical Probe Sequence
atcgcctatgcgggtatcgt

SEQ ID NO: 6577 - DNA, 20 bp, Artificial Sequence
  Description of Artificial Sequence:  Hypothetical Probe Sequence
atcgcctacacggcttcgtt

SEQ ID NO: 6578 - DNA, 20 bp, Artificial Sequence
  Description of Artificial Sequence:  Hypothetical Probe Sequence
gatgttgagcaaagcctgcg

SEQ ID NO: 6579 - DNA, 20 bp, Artificial Sequence
  Description of Artificial Sequence:  Hypothetical Probe Sequence
gatgtcgtggacgaccagcc

SEQ ID NO: 6580 - DNA, 20 bp, Artificial Sequence
  Description of Artificial Sequence:  Hypothetical Probe Sequence
gatgctcaacggaatccgtt

SEQ ID NO: 6581 - DNA, 20 bp, Artificial Sequence
  Description of Artificial Sequence:  Hypothetical Probe Sequence
atcggatgctgtcgttacgg

SEQ ID NO: 6582 - DNA, 20 bp, Artificial Sequence
  Description of Artificial Sequence:  Hypothetical Probe Sequence
gatggtctgtgccagcggac

SEQ ID NO: 6583 - DNA, 20 bp, Artificial Sequence
  Description of Artificial Sequence:  Hypothetical Probe Sequence
atcggatgatcgaggaacgg

SEQ ID NO: 6584 - DNA, 20 bp, Artificial Sequence
  Description of Artificial Sequence:  Hypothetical Probe Sequence
gatgcctagtcttccccacg

SEQ ID NO: 6585 - DNA, 20 bp, Artificial Sequence
  Description of Artificial Sequence:  Hypothetical Probe Sequence
gatgtgcgcttgtgattgcg

SEQ ID NO: 6586 - DNA, 20 bp, Artificial Sequence
  Description of Artificial Sequence:  Hypothetical Probe Sequence
atcggatgcacgcttggctt

SEQ ID NO: 6587 - DNA, 20 bp, Artificial Sequence
  Description of Artificial Sequence:  Hypothetical Probe Sequence
atcggatgcagcttagtgcg

SEQ ID NO: 6588 - DNA, 20 bp, Artificial Sequence
  Description of Artificial Sequence:  Hypothetical Probe Sequence
atcggatgggacagcctgat

SEQ ID NO: 6589 - DNA, 20 bp, Artificial Sequence
  Description of Artificial Sequence:  Hypothetical Probe Sequence
atcggatgacggcttgtccc

SEQ ID NO: 6590 - DNA, 20 bp, Artificial Sequence
  Description of Artificial Sequence:  Hypothetical Probe Sequence
tccctgtccgaatgcgcacg

SEQ ID NO: 6591 - DNA, 20 bp, Artificial Sequence
  Description of Artificial Sequence:  Hypothetical Probe Sequence
tcccaggatcgtgcttagcc

SEQ ID NO: 6592 - DNA, 20 bp, Artificial Sequence
  Description of Artificial Sequence:  Hypothetical Probe Sequence
tcccgatgcctacgtttccc

SEQ ID NO: 6593 - DNA, 20 bp, Artificial Sequence
  Description of Artificial Sequence:  Hypothetical Probe Sequence
tgcgttgatgtccgttagcc

SEQ ID NO: 6594 - DNA, 20 bp, Artificial Sequence
  Description of Artificial Sequence:  Hypothetical Probe Sequence
tgcgttagtccctccccgtt

SEQ ID NO: 6595 - DNA, 20 bp, Artificial Sequence
  Description of Artificial Sequence:  Hypothetical Probe Sequence
atcgtgcgcttgcttgcacg

SEQ ID NO: 6596 - DNA, 20 bp, Artificial Sequence
  Description of Artificial Sequence:  Hypothetical Probe Sequence
atcgtgcgctcatgtctccc

SEQ ID NO: 6597 - DNA, 20 bp, Artificial Sequence
  Description of Artificial Sequence:  Hypothetical Probe Sequence
tgcgccatcctagcaaatcg

SEQ ID NO: 6598 - DNA, 20 bp, Artificial Sequence
  Description of Artificial Sequence:  Hypothetical Probe Sequence
tgcggcttccataatcgacc

SEQ ID NO: 6599 - DNA, 20 bp, Artificial Sequence
  Description of Artificial Sequence:  Hypothetical Probe Sequence
tgcggagtgctttcgtgacc

SEQ ID NO: 6600 - DNA, 20 bp, Artificial Sequence
  Description of Artificial Sequence:  Hypothetical Probe Sequence
tgcgtccccagcaaagagga

SEQ ID NO: 6601 - DNA, 20 bp, Artificial Sequence
  Description of Artificial Sequence:  Hypothetical Probe Sequence
tgcgcacgtacaagccacct

SEQ ID NO: 6602 - DNA, 20 bp, Artificial Sequence
  Description of Artificial Sequence:  Hypothetical Probe Sequence
tgcggtgcggtaccattcgt

SEQ ID NO: 6603 - DNA, 20 bp, Artificial Sequence
  Description of Artificial Sequence:  Hypothetical Probe Sequence
atcgcacgaaaggaccgctt

SEQ ID NO: 6604 - DNA, 20 bp, Artificial Sequence
  Description of Artificial Sequence:  Hypothetical Probe Sequence
cacgcttggtctacggacgg

SEQ ID NO: 6605 - DNA, 20 bp, Artificial Sequence
  Description of Artificial Sequence:  Hypothetical Probe Sequence
atcgcacgcgaagagtcgtt

SEQ ID NO: 6606 - DNA, 20 bp, Artificial Sequence
  Description of Artificial Sequence:  Hypothetical Probe Sequence
atcgcacggcttacctcacg

SEQ ID NO: 6607 - DNA, 20 bp, Artificial Sequence
  Description of Artificial Sequence:  Hypothetical Probe Sequence
cacgagtgttagtgcgcgtt

SEQ ID NO: 6608 - DNA, 20 bp, Artificial Sequence
  Description of Artificial Sequence:  Hypothetical Probe Sequence
atcgcacgacctgcaaagga

SEQ ID NO: 6609 - DNA, 20 bp, Artificial Sequence
  Description of Artificial Sequence:  Hypothetical Probe Sequence
atcgcacgtcccctcacgaa

SEQ ID NO: 6610 - DNA, 20 bp, Artificial Sequence
  Description of Artificial Sequence:  Hypothetical Probe Sequence
atcgcacgtgcgctcagtgc

SEQ ID NO: 6611 - DNA, 20 bp, Artificial Sequence
  Description of Artificial Sequence:  Hypothetical Probe Sequence
atcgcacgacggctgtgcaa

SEQ ID NO: 6612 - DNA, 20 bp, Artificial Sequence
  Description of Artificial Sequence:  Hypothetical Probe Sequence
atcgcacgagccatacgacc

SEQ ID NO: 6613 - DNA, 20 bp, Artificial Sequence
  Description of Artificial Sequence:  Hypothetical Probe Sequence
atcgcagcttagcgaagcaa

SEQ ID NO: 6614 - DNA, 20 bp, Artificial Sequence
  Description of Artificial Sequence:  Hypothetical Probe Sequence
cagctctgttgaggactgcg

SEQ ID NO: 6615 - DNA, 20 bp, Artificial Sequence
  Description of Artificial Sequence:  Hypothetical Probe Sequence
cagctgtcgagtgtgcgcaa

SEQ ID NO: 6616 - DNA, 20 bp, Artificial Sequence
  Description of Artificial Sequence:  Hypothetical Probe Sequence
cagctcgtcctacagcggac

SEQ ID NO: 6617 - DNA, 20 bp, Artificial Sequence
  Description of Artificial Sequence:  Hypothetical Probe Sequence
atcgcagcgtctcttgggac

SEQ ID NO: 6618 - DNA, 20 bp, Artificial Sequence
  Description of Artificial Sequence:  Hypothetical Probe Sequence
atcgcagcagtgtgtccgtt

SEQ ID NO: 6619 - DNA, 20 bp, Artificial Sequence
  Description of Artificial Sequence:  Hypothetical Probe Sequence
atcgcagcatcgatacgtgc

SEQ ID NO: 6620 - DNA, 20 bp, Artificial Sequence
  Description of Artificial Sequence:  Hypothetical Probe Sequence
atcgcagcggacatactgcg

SEQ ID NO: 6621 - DNA, 20 bp, Artificial Sequence
  Description of Artificial Sequence:  Hypothetical Probe Sequence
atcgcagcacggctcacgaa

SEQ ID NO: 6622 - DNA, 20 bp, Artificial Sequence
  Description of Artificial Sequence:  Hypothetical Probe Sequence
atcggacctacaagccgacc

SEQ ID NO: 6623 - DNA, 20 bp, Artificial Sequence
  Description of Artificial Sequence:  Hypothetical Probe Sequence
gacccgttccattctggtgc

SEQ ID NO: 6624 - DNA, 20 bp, Artificial Sequence
  Description of Artificial Sequence:  Hypothetical Probe Sequence
gaccgcaagatgtgtcgtgc

SEQ ID NO: 6625 - DNA, 20 bp, Artificial Sequence
  Description of Artificial Sequence:  Hypothetical Probe Sequence
atcggaccatcgagtggctt

SEQ ID NO: 6626 - DNA, 20 bp, Artificial Sequence
  Description of Artificial Sequence:  Hypothetical Probe Sequence
atcggacctgcgtgtcaatc

SEQ ID NO: 6627 - DNA, 20 bp, Artificial Sequence
  Description of Artificial Sequence:  Hypothetical Probe Sequence
atcggaccggacttgacgtt

SEQ ID NO: 6628 - DNA, 20 bp, Artificial Sequence
  Description of Artificial Sequence:  Hypothetical Probe Sequence
atcggaccacggccatagga

SEQ ID NO: 6629 - DNA, 20 bp, Artificial Sequence
  Description of Artificial Sequence:  Hypothetical Probe Sequence
gtgcttgatgatcagccgaa

SEQ ID NO: 6630 - DNA, 20 bp, Artificial Sequence
  Description of Artificial Sequence:  Hypothetical Probe Sequence
gtgctgtcacctacgggcaa

SEQ ID NO: 6631 - DNA, 20 bp, Artificial Sequence
  Description of Artificial Sequence:  Hypothetical Probe Sequence
atcggtgcctcacgaaccta

SEQ ID NO: 6632 - DNA, 20 bp, Artificial Sequence
  Description of Artificial Sequence:  Hypothetical Probe Sequence
atcggtgcggtagtctgacc

SEQ ID NO: 6633 - DNA, 20 bp, Artificial Sequence
  Description of Artificial Sequence:  Hypothetical Probe Sequence
atcggtgcgatgttaggcaa

SEQ ID NO: 6634 - DNA, 20 bp, Artificial Sequence
  Description of Artificial Sequence:  Hypothetical Probe Sequence
gtgccacgctgtggacgctt

SEQ ID NO: 6635 - DNA, 20 bp, Artificial Sequence
  Description of Artificial Sequence:  Hypothetical Probe Sequence
atcggtgcggacagtgcacg

SEQ ID NO: 6636 - DNA, 20 bp, Artificial Sequence
  Description of Artificial Sequence:  Hypothetical Probe Sequence
atcggtgcagccgagtcgtt

SEQ ID NO: 6637 - DNA, 20 bp, Artificial Sequence
  Description of Artificial Sequence:  Hypothetical Probe Sequence
atcgggacaaagacggctgt

SEQ ID NO: 6638 - DNA, 20 bp, Artificial Sequence
  Description of Artificial Sequence:  Hypothetical Probe Sequence
atcgggaccgttcctatccc

SEQ ID NO: 6639 - DNA, 20 bp, Artificial Sequence
  Description of Artificial Sequence:  Hypothetical Probe Sequence
atcgggaccgaagagtacgg

SEQ ID NO: 6640 - DNA, 20 bp, Artificial Sequence
  Description of Artificial Sequence:  Hypothetical Probe Sequence
atcgggacgcttgatgtcgt

SEQ ID NO: 6641 - DNA, 20 bp, Artificial Sequence
  Description of Artificial Sequence:  Hypothetical Probe Sequence
ggacggtaggtaaaagcacg

SEQ ID NO: 6642 - DNA, 20 bp, Artificial Sequence
  Description of Artificial Sequence:  Hypothetical Probe Sequence
ggacgagtaaagtccccacg

SEQ ID NO: 6643 - DNA, 20 bp, Artificial Sequence
  Description of Artificial Sequence:  Hypothetical Probe Sequence
ggacacctggtatccccgtt

SEQ ID NO: 6644 - DNA, 20 bp, Artificial Sequence
  Description of Artificial Sequence:  Hypothetical Probe Sequence
ggactcccttgacttggcaa

SEQ ID NO: 6645 - DNA, 20 bp, Artificial Sequence
  Description of Artificial Sequence:  Hypothetical Probe Sequence
atcgggacacggaggacgtt

SEQ ID NO: 6646 - DNA, 20 bp, Artificial Sequence
  Description of Artificial Sequence:  Hypothetical Probe Sequence
acggttgatctggtgctgcg

SEQ ID NO: 6647 - DNA, 20 bp, Artificial Sequence
  Description of Artificial Sequence:  Hypothetical Probe Sequence
acggatacacggagccgcaa

SEQ ID NO: 6648 - DNA, 20 bp, Artificial Sequence
  Description of Artificial Sequence:  Hypothetical Probe Sequence
acggtacaacgggaccggac

SEQ ID NO: 6649 - DNA, 20 bp, Artificial Sequence
  Description of Artificial Sequence:  Hypothetical Probe Sequence
acggcttgttagcttgcacg

SEQ ID NO: 6650 - DNA, 20 bp, Artificial Sequence
  Description of Artificial Sequence:  Hypothetical Probe Sequence
acggctgttgatcgttgcaa

SEQ ID NO: 6651 - DNA, 20 bp, Artificial Sequence
  Description of Artificial Sequence:  Hypothetical Probe Sequence
acggccattacaggtatgcg

SEQ ID NO: 6652 - DNA, 20 bp, Artificial Sequence
  Description of Artificial Sequence:  Hypothetical Probe Sequence
atcgacggatcgggtacgaa

SEQ ID NO: 6653 - DNA, 20 bp, Artificial Sequence
  Description of Artificial Sequence:  Hypothetical Probe Sequence
atcgacggaggacgaacgaa

SEQ ID NO: 6654 - DNA, 20 bp, Artificial Sequence
  Description of Artificial Sequence:  Hypothetical Probe Sequence
acgggatgagtgtcccggac

SEQ ID NO: 6655 - DNA, 20 bp, Artificial Sequence
  Description of Artificial Sequence:  Hypothetical Probe Sequence
acggacggaatccagccgaa

SEQ ID NO: 6656 - DNA, 20 bp, Artificial Sequence
  Description of Artificial Sequence:  Hypothetical Probe Sequence
acggagccccatacctcacg

SEQ ID NO: 6657 - DNA, 20 bp, Artificial Sequence
  Description of Artificial Sequence:  Hypothetical Probe Sequence
agcctgatggtaagcccgtt

SEQ ID NO: 6658 - DNA, 20 bp, Artificial Sequence
  Description of Artificial Sequence:  Hypothetical Probe Sequence
agccttaggaccgcttcacg

SEQ ID NO: 6659 - DNA, 20 bp, Artificial Sequence
  Description of Artificial Sequence:  Hypothetical Probe Sequence
agcctgtctcccatcgtccc

SEQ ID NO: 6660 - DNA, 20 bp, Artificial Sequence
  Description of Artificial Sequence:  Hypothetical Probe Sequence
agcccttgatcgacctcgtt

SEQ ID NO: 6661 - DNA, 20 bp, Artificial Sequence
  Description of Artificial Sequence:  Hypothetical Probe Sequence
agccctgtgtctacggcgtt

SEQ ID NO: 6662 - DNA, 20 bp, Artificial Sequence
  Description of Artificial Sequence:  Hypothetical Probe Sequence
atcgagccggtaacctgcaa

SEQ ID NO: 6663 - DNA, 20 bp, Artificial Sequence
  Description of Artificial Sequence:  Hypothetical Probe Sequence
agccgcaatgtcctgtcacg

SEQ ID NO: 6664 - DNA, 20 bp, Artificial Sequence
  Description of Artificial Sequence:  Hypothetical Probe Sequence
agccaggaggtatctgcgaa

SEQ ID NO: 6665 - DNA, 20 bp, Artificial Sequence
  Description of Artificial Sequence:  Hypothetical Probe Sequence
agcctccccgttttagtgcg

SEQ ID NO: 6666 - DNA, 20 bp, Artificial Sequence
  Description of Artificial Sequence:  Hypothetical Probe Sequence
atcgagccgaccttaggacc

SEQ ID NO: 6667 - DNA, 20 bp, Artificial Sequence
  Description of Artificial Sequence:  Hypothetical Probe Sequence
tgatcgaaccattcccgctt

SEQ ID NO: 6668 - DNA, 20 bp, Artificial Sequence
  Description of Artificial Sequence:  Hypothetical Probe Sequence
aggattaggcaatcccgcaa

SEQ ID NO: 6669 - DNA, 20 bp, Artificial Sequence
  Description of Artificial Sequence:  Hypothetical Probe Sequence
aatcgcaatctgacgggctt

SEQ ID NO: 6670 - DNA, 20 bp, Artificial Sequence
  Description of Artificial Sequence:  Hypothetical Probe Sequence
aatcggactcgtcagcgctt

SEQ ID NO: 6671 - DNA, 20 bp, Artificial Sequence
  Description of Artificial Sequence:  Hypothetical Probe Sequence
aaagccatccatgatgcacg

SEQ ID NO: 6672 - DNA, 20 bp, Artificial Sequence
  Description of Artificial Sequence:  Hypothetical Probe Sequence
aggaaaaggctttgcgcttg

SEQ ID NO: 6673 - DNA, 20 bp, Artificial Sequence
  Description of Artificial Sequence:  Hypothetical Probe Sequence
aaagtccctgatgtgcgtgc

SEQ ID NO: 6674 - DNA, 20 bp, Artificial Sequence
  Description of Artificial Sequence:  Hypothetical Probe Sequence
aaagcacgatcgaaaggcaa

SEQ ID NO: 6675 - DNA, 20 bp, Artificial Sequence
  Description of Artificial Sequence:  Hypothetical Probe Sequence
tctgcgttctgtcgtttgcg

SEQ ID NO: 6676 - DNA, 20 bp, Artificial Sequence
  Description of Artificial Sequence:  Hypothetical Probe Sequence
tctgcgaaacctcacgacgg

SEQ ID NO: 6677 - DNA, 20 bp, Artificial Sequence
  Description of Artificial Sequence:  Hypothetical Probe Sequence
tctgagccacggccatcgtt

SEQ ID NO: 6678 - DNA, 20 bp, Artificial Sequence
  Description of Artificial Sequence:  Hypothetical Probe Sequence
tgtccagctcgttgcgtgcg

SEQ ID NO: 6679 - DNA, 20 bp, Artificial Sequence
  Description of Artificial Sequence:  Hypothetical Probe Sequence
tcgtcgaaagcccttgcttg

SEQ ID NO: 6680 - DNA, 20 bp, Artificial Sequence
  Description of Artificial Sequence:  Hypothetical Probe Sequence
tcgtacggcagcgaccgatg

SEQ ID NO: 6681 - DNA, 20 bp, Artificial Sequence
  Description of Artificial Sequence:  Hypothetical Probe Sequence
aggacttggcttagccggac

SEQ ID NO: 6682 - DNA, 20 bp, Artificial Sequence
  Description of Artificial Sequence:  Hypothetical Probe Sequence
cttgggtatgtcgtgccgtt

SEQ ID NO: 6683 - DNA, 20 bp, Artificial Sequence
  Description of Artificial Sequence:  Hypothetical Probe Sequence
cttggcaatgattcccggac

SEQ ID NO: 6684 - DNA, 20 bp, Artificial Sequence
  Description of Artificial Sequence:  Hypothetical Probe Sequence
cgttatcgatcgtcccgtgc

SEQ ID NO: 6685 - DNA, 20 bp, Artificial Sequence
  Description of Artificial Sequence:  Hypothetical Probe Sequence
cgttcagcgagttgcgccta

SEQ ID NO: 6686 - DNA, 20 bp, Artificial Sequence
  Description of Artificial Sequence:  Hypothetical Probe Sequence
cgttgtgcatcgcgttgacc

SEQ ID NO: 6687 - DNA, 20 bp, Artificial Sequence
  Description of Artificial Sequence:  Hypothetical Probe Sequence
cgttggacgtgctccctccc

SEQ ID NO: 6688 - DNA, 20 bp, Artificial Sequence
  Description of Artificial Sequence:  Hypothetical Probe Sequence
ccatgcaatgtcagccggac

SEQ ID NO: 6689 - DNA, 20 bp, Artificial Sequence
  Description of Artificial Sequence:  Hypothetical Probe Sequence
ccatagtggcaaggacacgg

SEQ ID NO: 6690 - DNA, 20 bp, Artificial Sequence
  Description of Artificial Sequence:  Hypothetical Probe Sequence
ccatcagcaaagccatgcaa

SEQ ID NO: 6691 - DNA, 20 bp, Artificial Sequence
  Description of Artificial Sequence:  Hypothetical Probe Sequence
ccatgtgctcccacggcgtt

SEQ ID NO: 6692 - DNA, 20 bp, Artificial Sequence
  Description of Artificial Sequence:  Hypothetical Probe Sequence
cgaacgttttagcagcgacc

SEQ ID NO: 6693 - DNA, 20 bp, Artificial Sequence
  Description of Artificial Sequence:  Hypothetical Probe Sequence
cgaaaccttctgccatgcaa

SEQ ID NO: 6694 - DNA, 20 bp, Artificial Sequence
  Description of Artificial Sequence:  Hypothetical Probe Sequence
cgaaacggggtaaaagccat

SEQ ID NO: 6695 - DNA, 20 bp, Artificial Sequence
  Description of Artificial Sequence:  Hypothetical Probe Sequence
gctttctgagcccacgatcg

SEQ ID NO: 6696 - DNA, 20 bp, Artificial Sequence
  Description of Artificial Sequence:  Hypothetical Probe Sequence
gcaaggaccgaaccattgcg

SEQ ID NO: 6697 - DNA, 20 bp, Artificial Sequence
  Description of Artificial Sequence:  Hypothetical Probe Sequence
gcaaacggacctcagcggta

SEQ ID NO: 6698 - DNA, 20 bp, Artificial Sequence
  Description of Artificial Sequence:  Hypothetical Probe Sequence
agtgccatcgtttcccatcg

SEQ ID NO: 6699 - DNA, 20 bp, Artificial Sequence
  Description of Artificial Sequence:  Hypothetical Probe Sequence
agtgcctacacgcacgagcc

SEQ ID NO: 6700 - DNA, 20 bp, Artificial Sequence
  Description of Artificial Sequence:  Hypothetical Probe Sequence
agtgcagcatcgctcagcaa

SEQ ID NO: 6701 - DNA, 20 bp, Artificial Sequence
  Description of Artificial Sequence:  Hypothetical Probe Sequence
agtgagcccctaagccacgg

SEQ ID NO: 6702 - DNA, 20 bp, Artificial Sequence
  Description of Artificial Sequence:  Hypothetical Probe Sequence
acctcagcccatagccgctt

SEQ ID NO: 6703 - DNA, 20 bp, Artificial Sequence
  Description of Artificial Sequence:  Hypothetical Probe Sequence
acctgaccgcttggacgtgc

SEQ ID NO: 6704 - DNA, 20 bp, Artificial Sequence
  Description of Artificial Sequence:  Hypothetical Probe Sequence
atcgccatctgtgcttcgaa

SEQ ID NO: 6705 - DNA, 20 bp, Artificial Sequence
  Description of Artificial Sequence:  Hypothetical Probe Sequence
atcgaccttcccgtgcgctt

SEQ ID NO: 6706 - DNA, 20 bp, Artificial Sequence
  Description of Artificial Sequence:  Hypothetical Probe Sequence
atcgcagcggtagtgcccat

SEQ ID NO: 6707 - DNA, 20 bp, Artificial Sequence
  Description of Artificial Sequence:  Hypothetical Probe Sequence
aggacacgatcgacggcagc

SEQ ID NO: 6708 - DNA, 20 bp, Artificial Sequence
  Description of Artificial Sequence:  Hypothetical Probe Sequence
gatggcaaatcgcacgccat

SEQ ID NO: 6709 - DNA, 20 bp, Artificial Sequence
  Description of Artificial Sequence:  Hypothetical Probe Sequence
tccccttggtctagccgcaa

SEQ ID NO: 6710 - DNA, 20 bp, Artificial Sequence
  Description of Artificial Sequence:  Hypothetical Probe Sequence
tcccgagttcgtgatggctt

SEQ ID NO: 6711 - DNA, 20 bp, Artificial Sequence
  Description of Artificial Sequence:  Hypothetical Probe Sequence
tgcgcgttcttgctgtggac

SEQ ID NO: 6712 - DNA, 20 bp, Artificial Sequence
  Description of Artificial Sequence:  Hypothetical Probe Sequence
tgcgagtgcgttgcaacacg

SEQ ID NO: 6713 - DNA, 20 bp, Artificial Sequence
  Description of Artificial Sequence:  Hypothetical Probe Sequence
tgcgtgcgacggtacacgtt

SEQ ID NO: 6714 - DNA, 20 bp, Artificial Sequence
  Description of Artificial Sequence:  Hypothetical Probe Sequence
tgcggtgctacacagcgctt

SEQ ID NO: 6715 - DNA, 20 bp, Artificial Sequence
  Description of Artificial Sequence:  Hypothetical Probe Sequence
cacgatacgatgcagctgcg

SEQ ID NO: 6716 - DNA, 20 bp, Artificial Sequence
  Description of Artificial Sequence:  Hypothetical Probe Sequence
cacgggtattgaacggacgg

SEQ ID NO: 6717 - DNA, 20 bp, Artificial Sequence
  Description of Artificial Sequence:  Hypothetical Probe Sequence
cacgacctagcctctgtgcg

SEQ ID NO: 6718 - DNA, 20 bp, Artificial Sequence
  Description of Artificial Sequence:  Hypothetical Probe Sequence
cacgcctaaaagggacgctt

SEQ ID NO: 6719 - DNA, 20 bp, Artificial Sequence
  Description of Artificial Sequence:  Hypothetical Probe Sequence
cacgggacgtcttgcgtcgt

SEQ ID NO: 6720 - DNA, 20 bp, Artificial Sequence
  Description of Artificial Sequence:  Hypothetical Probe Sequence
cagcatcggtgcagtgcacg

SEQ ID NO: 6721 - DNA, 20 bp, Artificial Sequence
  Description of Artificial Sequence:  Hypothetical Probe Sequence
cagcaggatgcggatgtccc

SEQ ID NO: 6722 - DNA, 20 bp, Artificial Sequence
  Description of Artificial Sequence:  Hypothetical Probe Sequence
cagccctatgtccagccgaa

SEQ ID NO: 6723 - DNA, 20 bp, Artificial Sequence
  Description of Artificial Sequence:  Hypothetical Probe Sequence
cagccacgttagtccccgaa

SEQ ID NO: 6724 - DNA, 20 bp, Artificial Sequence
  Description of Artificial Sequence:  Hypothetical Probe Sequence
gtgcatacgaccatcggcaa

SEQ ID NO: 6725 - DNA, 20 bp, Artificial Sequence
  Description of Artificial Sequence:  Hypothetical Probe Sequence
gtgcaaagtgcggtgcgacc

SEQ ID NO: 6726 - DNA, 20 bp, Artificial Sequence
  Description of Artificial Sequence:  Hypothetical Probe Sequence
gtgcgtctaaagcagcgtgc

SEQ ID NO: 6727 - DNA, 20 bp, Artificial Sequence
  Description of Artificial Sequence:  Hypothetical Probe Sequence
gtgccctacagcagtggtgc

SEQ ID NO: 6728 - DNA, 20 bp, Artificial Sequence
  Description of Artificial Sequence:  Hypothetical Probe Sequence
gtgcgacctcgttgtcggac

SEQ ID NO: 6729 - DNA, 20 bp, Artificial Sequence
  Description of Artificial Sequence:  Hypothetical Probe Sequence
ggaccttgtcccgcaaacgg

SEQ ID NO: 6730 - DNA, 20 bp, Artificial Sequence
  Description of Artificial Sequence:  Hypothetical Probe Sequence
ggacccatggactcccctca

SEQ ID NO: 6731 - DNA, 20 bp, Artificial Sequence
  Description of Artificial Sequence:  Hypothetical Probe Sequence
ggacgatgacctcacgcgtt

SEQ ID NO: 6732 - DNA, 20 bp, Artificial Sequence
  Description of Artificial Sequence:  Hypothetical Probe Sequence
acggatcgcctaccatgcaa

SEQ ID NO: 6733 - DNA, 20 bp, Artificial Sequence
  Description of Artificial Sequence:  Hypothetical Probe Sequence
acggaggacacgctgtgacc

SEQ ID NO: 6734 - DNA, 20 bp, Artificial Sequence
  Description of Artificial Sequence:  Hypothetical Probe Sequence
acgggatggtctcagctccc

SEQ ID NO: 6735 - DNA, 20 bp, Artificial Sequence
  Description of Artificial Sequence:  Hypothetical Probe Sequence
agccaaaggagttcccccat

SEQ ID NO: 6736 - DNA, 20 bp, Artificial Sequence
  Description of Artificial Sequence:  Hypothetical Probe Sequence
agccctcaataccacgccat

SEQ ID NO: 6737 - DNA, 20 bp, Artificial Sequence
  Description of Artificial Sequence:  Hypothetical Probe Sequence
agccagtgcagcccatccat

SEQ ID NO: 6738 - DNA, 20 bp, Artificial Sequence
  Description of Artificial Sequence:  Hypothetical Probe Sequence
agcccacggcttttgacagc

SEQ ID NO: 6739 - DNA, 20 bp, Artificial Sequence
  Description of Artificial Sequence:  Hypothetical Probe Sequence
aggaagcccagccacgctgt

SEQ ID NO: 6740 - DNA, 20 bp, Artificial Sequence
  Description of Artificial Sequence:  Hypothetical Probe Sequence
agccgtgctgtcctcacacg

SEQ ID NO: 6741 - DNA, 20 bp, Artificial Sequence
  Description of Artificial Sequence:  Hypothetical Probe Sequence
ttgatgcggcaatcgtcgtt

SEQ ID NO: 6742 - DNA, 20 bp, Artificial Sequence
  Description of Artificial Sequence:  Hypothetical Probe Sequence
tgtcgcaatgtcgtgcgctt

SEQ ID NO: 6743 - DNA, 20 bp, Artificial Sequence
  Description of Artificial Sequence:  Hypothetical Probe Sequence
tgtcacgggaccgcaatgcg

SEQ ID NO: 6744 - DNA, 20 bp, Artificial Sequence
  Description of Artificial Sequence:  Hypothetical Probe Sequence
tcgttcgttgtctgcgcacg

SEQ ID NO: 6745 - DNA, 20 bp, Artificial Sequence
  Description of Artificial Sequence:  Hypothetical Probe Sequence
tcgtcacggtgccagctgcg

SEQ ID NO: 6746 - DNA, 20 bp, Artificial Sequence
  Description of Artificial Sequence:  Hypothetical Probe Sequence
cgttgaccgaccggactgcg

SEQ ID NO: 6747 - DNA, 20 bp, Artificial Sequence
  Description of Artificial Sequence:  Hypothetical Probe Sequence
ctgttgcgcacgacgggacc

SEQ ID NO: 6748 - DNA, 20 bp, Artificial Sequence
  Description of Artificial Sequence:  Hypothetical Probe Sequence
gcttgacctcccgtgccacg

SEQ ID NO: 6749 - DNA, 20 bp, Artificial Sequence
  Description of Artificial Sequence:  Hypothetical Probe Sequence
gcaagcaacacgcctacacg

SEQ ID NO: 6750 - DNA, 20 bp, Artificial Sequence
  Description of Artificial Sequence:  Hypothetical Probe Sequence
atcgccatagtgtccccacg

SEQ ID NO: 6751 - DNA, 20 bp, Artificial Sequence
  Description of Artificial Sequence:  Hypothetical Probe Sequence
tcccttgaagccacggctgt

SEQ ID NO: 6752 - DNA, 20 bp, Artificial Sequence
  Description of Artificial Sequence:  Hypothetical Probe Sequence
tcccctcagaccacggcgaa

SEQ ID NO: 6753 - DNA, 20 bp, Artificial Sequence
  Description of Artificial Sequence:  Hypothetical Probe Sequence
tccccacgtgatagccggta

SEQ ID NO: 6754 - DNA, 20 bp, Artificial Sequence
  Description of Artificial Sequence:  Hypothetical Probe Sequence
cacgtcgtagcccacgcgtt

SEQ ID NO: 6755 - DNA, 20 bp, Artificial Sequence
  Description of Artificial Sequence:  Hypothetical Probe Sequence
cacgctgtcgttgtgcgtgc

SEQ ID NO: 6756 - DNA, 20 bp, Artificial Sequence
  Description of Artificial Sequence:  Hypothetical Probe Sequence
cacgcagcagtgtgcgacct

SEQ ID NO: 6757 - DNA, 20 bp, Artificial Sequence
  Description of Artificial Sequence:  Hypothetical Probe Sequence
cagcgtcttcgtcagctgcg

SEQ ID NO: 6758 - DNA, 20 bp, Artificial Sequence
  Description of Artificial Sequence:  Hypothetical Probe Sequence
cagcgagtcacggcaaagcc

SEQ ID NO: 6759 - DNA, 20 bp, Artificial Sequence
  Description of Artificial Sequence:  Hypothetical Probe Sequence
gacccgaaccatccatacgg

SEQ ID NO: 6760 - DNA, 20 bp, Artificial Sequence
  Description of Artificial Sequence:  Hypothetical Probe Sequence
gtgcgtctcgttacgggacc

SEQ ID NO: 6761 - DNA, 20 bp, Artificial Sequence
  Description of Artificial Sequence:  Hypothetical Probe Sequence
gtgcacggttgagcaaatcg

SEQ ID NO: 6762 - DNA, 20 bp, Artificial Sequence
  Description of Artificial Sequence:  Hypothetical Probe Sequence
ggaccacgcagctcgtgcaa

SEQ ID NO: 6763 - DNA, 20 bp, Artificial Sequence
  Description of Artificial Sequence:  Hypothetical Probe Sequence
agccgagtagtggtgcgacc

SEQ ID NO: 6764 - DNA, 20 bp, Artificial Sequence
  Description of Artificial Sequence:  Hypothetical Probe Sequence
agccacctcttgtccctgcg

SEQ ID NO: 6765 - DNA, 20 bp, Artificial Sequence
  Description of Artificial Sequence:  Hypothetical Probe Sequence
ttgaagccgtgcgtgcggta

SEQ ID NO: 6766 - DNA, 20 bp, Artificial Sequence
  Description of Artificial Sequence:  Hypothetical Probe Sequence
aatcgtgcacggcgtttccc

SEQ ID NO: 6767 - DNA, 20 bp, Artificial Sequence
  Description of Artificial Sequence:  Hypothetical Probe Sequence
aatcacggtcgttccccacg

SEQ ID NO: 6768 - DNA, 20 bp, Artificial Sequence
  Description of Artificial Sequence:  Hypothetical Probe Sequence
aaagccatcagcggacgtgc

SEQ ID NO: 6769 - DNA, 20 bp, Artificial Sequence
  Description of Artificial Sequence:  Hypothetical Probe Sequence
aaagcgaaagccccatcgtt

SEQ ID NO: 6770 - DNA, 20 bp, Artificial Sequence
  Description of Artificial Sequence:  Hypothetical Probe Sequence
aaagcacgcagctgcgtgcg

SEQ ID NO: 6771 - DNA, 20 bp, Artificial Sequence
  Description of Artificial Sequence:  Hypothetical Probe Sequence
gatgcttgcgttccatgtgc

SEQ ID NO: 6772 - DNA, 20 bp, Artificial Sequence
  Description of Artificial Sequence:  Hypothetical Probe Sequence
cgtttgtccgaaagccacgg

SEQ ID NO: 6773 - DNA, 20 bp, Artificial Sequence
  Description of Artificial Sequence:  Hypothetical Probe Sequence
gatgcgttggacagccccta

SEQ ID NO: 6774 - DNA, 20 bp, Artificial Sequence
  Description of Artificial Sequence:  Hypothetical Probe Sequence
ctcacacgcgaacacggtgc

SEQ ID NO: 6775 - DNA, 20 bp, Artificial Sequence
  Description of Artificial Sequence:  Hypothetical Probe Sequence
ctgtcgaacctatgcggtgc

SEQ ID NO: 6776 - DNA, 20 bp, Artificial Sequence
  Description of Artificial Sequence:  Hypothetical Probe Sequence
ctgtcagccacggcttgtgc

SEQ ID NO: 6777 - DNA, 20 bp, Artificial Sequence
  Description of Artificial Sequence:  Hypothetical Probe Sequence
ctgtagccacgggcaacacg

SEQ ID NO: 6778 - DNA, 20 bp, Artificial Sequence
  Description of Artificial Sequence:  Hypothetical Probe Sequence
ccatcgtttcgtgcttggac

SEQ ID NO: 6779 - DNA, 20 bp, Artificial Sequence
  Description of Artificial Sequence:  Hypothetical Probe Sequence
gatgccatccatcagccgaa

SEQ ID NO: 6780 - DNA, 20 bp, Artificial Sequence
  Description of Artificial Sequence:  Hypothetical Probe Sequence
ccataggaggaccagccgaa

SEQ ID NO: 6781 - DNA, 20 bp, Artificial Sequence
  Description of Artificial Sequence:  Hypothetical Probe Sequence
ccatcctacgaaagccgacc

SEQ ID NO: 6782 - DNA, 20 bp, Artificial Sequence
  Description of Artificial Sequence:  Hypothetical Probe Sequence
ccattcccggtacagcccat

SEQ ID NO: 6783 - DNA, 20 bp, Artificial Sequence
  Description of Artificial Sequence:  Hypothetical Probe Sequence
cgaactcatgcgggactccc

SEQ ID NO: 6784 - DNA, 20 bp, Artificial Sequence
  Description of Artificial Sequence:  Hypothetical Probe Sequence
cgaaatcgcctacagcgctt

SEQ ID NO: 6785 - DNA, 20 bp, Artificial Sequence
  Description of Artificial Sequence:  Hypothetical Probe Sequence
cgaaacgggcaatgtccttg

SEQ ID NO: 6786 - DNA, 20 bp, Artificial Sequence
  Description of Artificial Sequence:  Hypothetical Probe Sequence
gatgcgaaagccgcttgcaa

SEQ ID NO: 6787 - DNA, 20 bp, Artificial Sequence
  Description of Artificial Sequence:  Hypothetical Probe Sequence
gcttcttgcacggaccgtgc

SEQ ID NO: 6788 - DNA, 20 bp, Artificial Sequence
  Description of Artificial Sequence:  Hypothetical Probe Sequence
gcttgcaaaggatcgtgcaa

SEQ ID NO: 6789 - DNA, 20 bp, Artificial Sequence
  Description of Artificial Sequence:  Hypothetical Probe Sequence
gcttgaccgtctcagctgcg

SEQ ID NO: 6790 - DNA, 20 bp, Artificial Sequence
  Description of Artificial Sequence:  Hypothetical Probe Sequence
gatgggtatgcgatcgcacg

SEQ ID NO: 6791 - DNA, 20 bp, Artificial Sequence
  Description of Artificial Sequence:  Hypothetical Probe Sequence
ggtagtgccacgtgcgcacg

SEQ ID NO: 6792 - DNA, 20 bp, Artificial Sequence
  Description of Artificial Sequence:  Hypothetical Probe Sequence
gagttcccggtagtgcgcaa

SEQ ID NO: 6793 - DNA, 20 bp, Artificial Sequence
  Description of Artificial Sequence:  Hypothetical Probe Sequence
gcaatctgcgaatcccagcc

SEQ ID NO: 6794 - DNA, 20 bp, Artificial Sequence
  Description of Artificial Sequence:  Hypothetical Probe Sequence
gcaacgttatacgcaatgcg

SEQ ID NO: 6795 - DNA, 20 bp, Artificial Sequence
  Description of Artificial Sequence:  Hypothetical Probe Sequence
gatggcaagcttcagcccta

SEQ ID NO: 6796 - DNA, 20 bp, Artificial Sequence
  Description of Artificial Sequence:  Hypothetical Probe Sequence
gcaaacctaaagcagccgaa

SEQ ID NO: 6797 - DNA, 20 bp, Artificial Sequence
  Description of Artificial Sequence:  Hypothetical Probe Sequence
gcaagatggaccagcccgaa

SEQ ID NO: 6798 - DNA, 20 bp, Artificial Sequence
  Description of Artificial Sequence:  Hypothetical Probe Sequence
agtggcaacgttcgtttccc

SEQ ID NO: 6799 - DNA, 20 bp, Artificial Sequence
  Description of Artificial Sequence:  Hypothetical Probe Sequence
accttgcgcgttgcttcgtt

SEQ ID NO: 6800 - DNA, 20 bp, Artificial Sequence
  Description of Artificial Sequence:  Hypothetical Probe Sequence
atcgcgttccatgcttacgg

SEQ ID NO: 6801 - DNA, 20 bp, Artificial Sequence
  Description of Artificial Sequence:  Hypothetical Probe Sequence
atcgccattgtccacgctca

SEQ ID NO: 6802 - DNA, 20 bp, Artificial Sequence
  Description of Artificial Sequence:  Hypothetical Probe Sequence
atcggcttccatggactgcg

SEQ ID NO: 6803 - DNA, 20 bp, Artificial Sequence
  Description of Artificial Sequence:  Hypothetical Probe Sequence
atcgcacggatgcgttcacg

SEQ ID NO: 6804 - DNA, 20 bp, Artificial Sequence
  Description of Artificial Sequence:  Hypothetical Probe Sequence
cctaagccggtagtgcggac

SEQ ID NO: 6805 - DNA, 20 bp, Artificial Sequence
  Description of Artificial Sequence:  Hypothetical Probe Sequence
gatgctcagacccgttcgaa

SEQ ID NO: 6806 - DNA, 20 bp, Artificial Sequence
  Description of Artificial Sequence:  Hypothetical Probe Sequence
gatgcctatgcgagcctgcg

SEQ ID NO: 6807 - DNA, 20 bp, Artificial Sequence
  Description of Artificial Sequence:  Hypothetical Probe Sequence
gatggtgctgatcacgcgaa

SEQ ID NO: 6808 - DNA, 20 bp, Artificial Sequence
  Description of Artificial Sequence:  Hypothetical Probe Sequence
gatgagccaatccagctccc

SEQ ID NO: 6809 - DNA, 20 bp, Artificial Sequence
  Description of Artificial Sequence:  Hypothetical Probe Sequence
tcccgcttaatccttgcgtt

SEQ ID NO: 6810 - DNA, 20 bp, Artificial Sequence
  Description of Artificial Sequence:  Hypothetical Probe Sequence
tcccgtctcgttgaccccat

SEQ ID NO: 6811 - DNA, 20 bp, Artificial Sequence
  Description of Artificial Sequence:  Hypothetical Probe Sequence
tccccagcgcttcacggtct

SEQ ID NO: 6812 - DNA, 20 bp, Artificial Sequence
  Description of Artificial Sequence:  Hypothetical Probe Sequence
tcccgaccatactcccgcaa

SEQ ID NO: 6813 - DNA, 20 bp, Artificial Sequence
  Description of Artificial Sequence:  Hypothetical Probe Sequence
tgcgttagcagcgatgatcg

SEQ ID NO: 6814 - DNA, 20 bp, Artificial Sequence
  Description of Artificial Sequence:  Hypothetical Probe Sequence
tgcgggtaatcggcttgatg

SEQ ID NO: 6815 - DNA, 20 bp, Artificial Sequence
  Description of Artificial Sequence:  Hypothetical Probe Sequence
tgcgcacgcgaatcgtagga

SEQ ID NO: 6816 - DNA, 20 bp, Artificial Sequence
  Description of Artificial Sequence:  Hypothetical Probe Sequence
tgcgcagcgcaaatcgacct

SEQ ID NO: 6817 - DNA, 20 bp, Artificial Sequence
  Description of Artificial Sequence:  Hypothetical Probe Sequence
cacgtgtcgtgcagccggac

SEQ ID NO: 6818 - DNA, 20 bp, Artificial Sequence
  Description of Artificial Sequence:  Hypothetical Probe Sequence
gatgcacgccatcgttcgtt

SEQ ID NO: 6819 - DNA, 20 bp, Artificial Sequence
  Description of Artificial Sequence:  Hypothetical Probe Sequence
cacgagtgacggatcggtgc

SEQ ID NO: 6820 - DNA, 20 bp, Artificial Sequence
  Description of Artificial Sequence:  Hypothetical Probe Sequence
cacgtgcggtctgacccagc

SEQ ID NO: 6821 - DNA, 20 bp, Artificial Sequence
  Description of Artificial Sequence:  Hypothetical Probe Sequence
gatgcacgcacgcttgatcg

SEQ ID NO: 6822 - DNA, 20 bp, Artificial Sequence
  Description of Artificial Sequence:  Hypothetical Probe Sequence
cacgagccgaccaatcacgg

SEQ ID NO: 6823 - DNA, 20 bp, Artificial Sequence
  Description of Artificial Sequence:  Hypothetical Probe Sequence
cagctgattgcgatcgggac

SEQ ID NO: 6824 - DNA, 20 bp, Artificial Sequence
  Description of Artificial Sequence:  Hypothetical Probe Sequence
cagctcgtcacgtcccatcg

SEQ ID NO: 6825 - DNA, 20 bp, Artificial Sequence
  Description of Artificial Sequence:  Hypothetical Probe Sequence
gatgcagccttgatcgcgaa

SEQ ID NO: 6826 - DNA, 20 bp, Artificial Sequence
  Description of Artificial Sequence:  Hypothetical Probe Sequence
cagcctcatgatgaccgctt

SEQ ID NO: 6827 - DNA, 20 bp, Artificial Sequence
  Description of Artificial Sequence:  Hypothetical Probe Sequence
gatgcagcggtaggtaacgg

SEQ ID NO: 6828 - DNA, 20 bp, Artificial Sequence
  Description of Artificial Sequence:  Hypothetical Probe Sequence
cagcgtgcgcttgtctcacg

SEQ ID NO: 6829 - DNA, 20 bp, Artificial Sequence
  Description of Artificial Sequence:  Hypothetical Probe Sequence
gatgcagcagccctcatccc

SEQ ID NO: 6830 - DNA, 20 bp, Artificial Sequence
  Description of Artificial Sequence:  Hypothetical Probe Sequence
gacccgttggacaaagcgaa

SEQ ID NO: 6831 - DNA, 20 bp, Artificial Sequence
  Description of Artificial Sequence:  Hypothetical Probe Sequence
gatggacccacgacggggta

SEQ ID NO: 6832 - DNA, 20 bp, Artificial Sequence
  Description of Artificial Sequence:  Hypothetical Probe Sequence
acggttgagctttgcggcaa

SEQ ID NO: 6833 - DNA, 20 bp, Artificial Sequence
  Description of Artificial Sequence:  Hypothetical Probe Sequence
acggggtagacccgaagcaa

SEQ ID NO: 6834 - DNA, 20 bp, Artificial Sequence
  Description of Artificial Sequence:  Hypothetical Probe Sequence
agccctcactcaagcctgcg

SEQ ID NO: 6835 - DNA, 20 bp, Artificial Sequence
  Description of Artificial Sequence:  Hypothetical Probe Sequence
gatgagccgtctacggcagc

SEQ ID NO: 6836 - DNA, 20 bp, Artificial Sequence
  Description of Artificial Sequence:  Hypothetical Probe Sequence
agccatcgtcgtccatgcaa

SEQ ID NO: 6837 - DNA, 20 bp, Artificial Sequence
  Description of Artificial Sequence:  Hypothetical Probe Sequence
agcccagcatacgcaacgtt

SEQ ID NO: 6838 - DNA, 20 bp, Artificial Sequence
  Description of Artificial Sequence:  Hypothetical Probe Sequence
ttgaaatctgcgagcccgtt

SEQ ID NO: 6839 - DNA, 20 bp, Artificial Sequence
  Description of Artificial Sequence:  Hypothetical Probe Sequence
tcccttgaaggaagcccttg

SEQ ID NO: 6840 - DNA, 20 bp, Artificial Sequence
  Description of Artificial Sequence:  Hypothetical Probe Sequence
ttgatgcgttagggtatgcg

SEQ ID NO: 6841 - DNA, 20 bp, Artificial Sequence
  Description of Artificial Sequence:  Hypothetical Probe Sequence
ttgacagcaaagatcgcacg

SEQ ID NO: 6842 - DNA, 20 bp, Artificial Sequence
  Description of Artificial Sequence:  Hypothetical Probe Sequence
ttgaggaccacggatgcacg

SEQ ID NO: 6843 - DNA, 20 bp, Artificial Sequence
  Description of Artificial Sequence:  Hypothetical Probe Sequence
tgattctgggaccagcagcc

SEQ ID NO: 6844 - DNA, 20 bp, Artificial Sequence
  Description of Artificial Sequence:  Hypothetical Probe Sequence
tgattcgtaatcacggcacg

SEQ ID NO: 6845 - DNA, 20 bp, Artificial Sequence
  Description of Artificial Sequence:  Hypothetical Probe Sequence
tgatcgaattgaagccagcc

SEQ ID NO: 6846 - DNA, 20 bp, Artificial Sequence
  Description of Artificial Sequence:  Hypothetical Probe Sequence
tccctgattgcgaggaccta

SEQ ID NO: 6847 - DNA, 20 bp, Artificial Sequence
  Description of Artificial Sequence:  Hypothetical Probe Sequence
tgatgacctgtcacggacgg

SEQ ID NO: 6848 - DNA, 20 bp, Artificial Sequence
  Description of Artificial Sequence:  Hypothetical Probe Sequence
ttagctgtatcgtgcgcgaa

SEQ ID NO: 6849 - DNA, 20 bp, Artificial Sequence
  Description of Artificial Sequence:  Hypothetical Probe Sequence
tcccttaggcaagcttgcaa

SEQ ID NO: 6850 - DNA, 20 bp, Artificial Sequence
  Description of Artificial Sequence:  Hypothetical Probe Sequence
ttagaggaaatctgcgtgcg

SEQ ID NO: 6851 - DNA, 20 bp, Artificial Sequence
  Description of Artificial Sequence:  Hypothetical Probe Sequence
tcccttagcacgcttgagga

SEQ ID NO: 6852 - DNA, 20 bp, Artificial Sequence
  Description of Artificial Sequence:  Hypothetical Probe Sequence
tcccaatcctgtggactccc

SEQ ID NO: 6853 - DNA, 20 bp, Artificial Sequence
  Description of Artificial Sequence:  Hypothetical Probe Sequence
tcccaatcgcttcctagacc

SEQ ID NO: 6854 - DNA, 20 bp, Artificial Sequence
  Description of Artificial Sequence:  Hypothetical Probe Sequence
tcccaatcgagtacctgacc

SEQ ID NO: 6855 - DNA, 20 bp, Artificial Sequence
  Description of Artificial Sequence:  Hypothetical Probe Sequence
tcccaatcagtggaccgacc

SEQ ID NO: 6856 - DNA, 20 bp, Artificial Sequence
  Description of Artificial Sequence:  Hypothetical Probe Sequence
tcccaatcacctcttgagcc

SEQ ID NO: 6857 - DNA, 20 bp, Artificial Sequence
  Description of Artificial Sequence:  Hypothetical Probe Sequence
tcccaatctcccagtgtgcg

SEQ ID NO: 6858 - DNA, 20 bp, Artificial Sequence
  Description of Artificial Sequence:  Hypothetical Probe Sequence
tcccaatcgacctctgcacg

SEQ ID NO: 6859 - DNA, 20 bp, Artificial Sequence
  Description of Artificial Sequence:  Hypothetical Probe Sequence
tcccaatcagccgatgcgtt

SEQ ID NO: 6860 - DNA, 20 bp, Artificial Sequence
  Description of Artificial Sequence:  Hypothetical Probe Sequence
tcccataccttggtgcacgg

SEQ ID NO: 6861 - DNA, 20 bp, Artificial Sequence
  Description of Artificial Sequence:  Hypothetical Probe Sequence
tcccatacccatcagccagc

SEQ ID NO: 6862 - DNA, 20 bp, Artificial Sequence
  Description of Artificial Sequence:  Hypothetical Probe Sequence
tcccataccgaaatacgtgc

SEQ ID NO: 6863 - DNA, 20 bp, Artificial Sequence
  Description of Artificial Sequence:  Hypothetical Probe Sequence
tcccatacgtgccgaactca

SEQ ID NO: 6864 - DNA, 20 bp, Artificial Sequence
  Description of Artificial Sequence:  Hypothetical Probe Sequence
tcccaaagcgtttcgtcgtt

SEQ ID NO: 6865 - DNA, 20 bp, Artificial Sequence
  Description of Artificial Sequence:  Hypothetical Probe Sequence
tcccaaagggtaccatcgtt

SEQ ID NO: 6866 - DNA, 20 bp, Artificial Sequence
  Description of Artificial Sequence:  Hypothetical Probe Sequence
tcccaaaggtctcgttcacg

SEQ ID NO: 6867 - DNA, 20 bp, Artificial Sequence
  Description of Artificial Sequence:  Hypothetical Probe Sequence
tcccaaagacctcacgatcg

SEQ ID NO: 6868 - DNA, 20 bp, Artificial Sequence
  Description of Artificial Sequence:  Hypothetical Probe Sequence
aaagatcgcgaattagcgaa

SEQ ID NO: 6869 - DNA, 20 bp, Artificial Sequence
  Description of Artificial Sequence:  Hypothetical Probe Sequence
aaaggatgacctcttgcgaa

SEQ ID NO: 6870 - DNA, 20 bp, Artificial Sequence
  Description of Artificial Sequence:  Hypothetical Probe Sequence
tcccaaagtgcgtgatccat

SEQ ID NO: 6871 - DNA, 20 bp, Artificial Sequence
  Description of Artificial Sequence:  Hypothetical Probe Sequence
aaagcagcaatctgtcgtgc

SEQ ID NO: 6872 - DNA, 20 bp, Artificial Sequence
  Description of Artificial Sequence:  Hypothetical Probe Sequence
tcccaaaggacctcgttcgt

SEQ ID NO: 6873 - DNA, 20 bp, Artificial Sequence
  Description of Artificial Sequence:  Hypothetical Probe Sequence
tcccaaagagcccttgacgg

SEQ ID NO: 6874 - DNA, 20 bp, Artificial Sequence
  Description of Artificial Sequence:  Hypothetical Probe Sequence
tccctctgcgtttccctcgt

SEQ ID NO: 6875 - DNA, 20 bp, Artificial Sequence
  Description of Artificial Sequence:  Hypothetical Probe Sequence
tctgctcacctaacggcgtt

SEQ ID NO: 6876 - DNA, 20 bp, Artificial Sequence
  Description of Artificial Sequence:  Hypothetical Probe Sequence
tccctctggtctgacccgaa

SEQ ID NO: 6877 - DNA, 20 bp, Artificial Sequence
  Description of Artificial Sequence:  Hypothetical Probe Sequence
tccctctgatcgcagcgcaa

SEQ ID NO: 6878 - DNA, 20 bp, Artificial Sequence
  Description of Artificial Sequence:  Hypothetical Probe Sequence
tctgaggacgttctgttgcg

SEQ ID NO: 6879 - DNA, 20 bp, Artificial Sequence
  Description of Artificial Sequence:  Hypothetical Probe Sequence
tctgtcccttgatgtcgcaa

SEQ ID NO: 6880 - DNA, 20 bp, Artificial Sequence
  Description of Artificial Sequence:  Hypothetical Probe Sequence
tccctctgggactgtcgacc

SEQ ID NO: 6881 - DNA, 20 bp, Artificial Sequence
  Description of Artificial Sequence:  Hypothetical Probe Sequence
tgtccttgcgtttctgacgg

SEQ ID NO: 6882 - DNA, 20 bp, Artificial Sequence
  Description of Artificial Sequence:  Hypothetical Probe Sequence
tgtcatcgaatcgtgcggac

SEQ ID NO: 6883 - DNA, 20 bp, Artificial Sequence
  Description of Artificial Sequence:  Hypothetical Probe Sequence
tgtcaggatgtcgacctgcg

SEQ ID NO: 6884 - DNA, 20 bp, Artificial Sequence
  Description of Artificial Sequence:  Hypothetical Probe Sequence
tgtcggactacatccccgtt

SEQ ID NO: 6885 - DNA, 20 bp, Artificial Sequence
  Description of Artificial Sequence:  Hypothetical Probe Sequence
tcgttgtcacctcagcagcc

SEQ ID NO: 6886 - DNA, 20 bp, Artificial Sequence
  Description of Artificial Sequence:  Hypothetical Probe Sequence
tcgtctcagacccagcgctt

SEQ ID NO: 6887 - DNA, 20 bp, Artificial Sequence
  Description of Artificial Sequence:  Hypothetical Probe Sequence
tcgtggtatacatgcgcagc

SEQ ID NO: 6888 - DNA, 20 bp, Artificial Sequence
  Description of Artificial Sequence:  Hypothetical Probe Sequence
tccctcgtgtcttgtcagcc

SEQ ID NO: 6889 - DNA, 20 bp, Artificial Sequence
  Description of Artificial Sequence:  Hypothetical Probe Sequence
tccctcgtgcaaagtggtgc

SEQ ID NO: 6890 - DNA, 20 bp, Artificial Sequence
  Description of Artificial Sequence:  Hypothetical Probe Sequence
tcgtacctcctagtgctgcg

SEQ ID NO: 6891 - DNA, 20 bp, Artificial Sequence
  Description of Artificial Sequence:  Hypothetical Probe Sequence
tccctcgtgatgcacgatcg

SEQ ID NO: 6892 - DNA, 20 bp, Artificial Sequence
  Description of Artificial Sequence:  Hypothetical Probe Sequence
tccctcgttgcgccatagga

SEQ ID NO: 6893 - DNA, 20 bp, Artificial Sequence
  Description of Artificial Sequence:  Hypothetical Probe Sequence
tccctcgtgacctcgtgcaa

SEQ ID NO: 6894 - DNA, 20 bp, Artificial Sequence
  Description of Artificial Sequence:  Hypothetical Probe Sequence
tccctcgtgtgcttagccat

SEQ ID NO: 6895 - DNA, 20 bp, Artificial Sequence
  Description of Artificial Sequence:  Hypothetical Probe Sequence
tcgtggacgcttagtgcgaa

SEQ ID NO: 6896 - DNA, 20 bp, Artificial Sequence
  Description of Artificial Sequence:  Hypothetical Probe Sequence
tccccttgtgattcgttgcg

SEQ ID NO: 6897 - DNA, 20 bp, Artificial Sequence
  Description of Artificial Sequence:  Hypothetical Probe Sequence
tccccttgaaagggtaacct

SEQ ID NO: 6898 - DNA, 20 bp, Artificial Sequence
  Description of Artificial Sequence:  Hypothetical Probe Sequence
tccccttgtctgacctagcc

SEQ ID NO: 6899 - DNA, 20 bp, Artificial Sequence
  Description of Artificial Sequence:  Hypothetical Probe Sequence
tccccttgctcaggactctg

SEQ ID NO: 6900 - DNA, 20 bp, Artificial Sequence
  Description of Artificial Sequence:  Hypothetical Probe Sequence
tccccttgggtaagtgtgcg

SEQ ID NO: 6901 - DNA, 20 bp, Artificial Sequence
  Description of Artificial Sequence:  Hypothetical Probe Sequence
tccccttgatcgtctgtccc

SEQ ID NO: 6902 - DNA, 20 bp, Artificial Sequence
  Description of Artificial Sequence:  Hypothetical Probe Sequence
tccccttgagccaggattga

SEQ ID NO: 6903 - DNA, 20 bp, Artificial Sequence
  Description of Artificial Sequence:  Hypothetical Probe Sequence
tccccgtttgatatcgtgat

SEQ ID NO: 6904 - DNA, 20 bp, Artificial Sequence
  Description of Artificial Sequence:  Hypothetical Probe Sequence
tccccgttatacgtgcgatg

SEQ ID NO: 6905 - DNA, 20 bp, Artificial Sequence
  Description of Artificial Sequence:  Hypothetical Probe Sequence
tccccgtttacattgacacg

SEQ ID NO: 6906 - DNA, 20 bp, Artificial Sequence
  Description of Artificial Sequence:  Hypothetical Probe Sequence
tccccgtttgtctgtcgacc

SEQ ID NO: 6907 - DNA, 20 bp, Artificial Sequence
  Description of Artificial Sequence:  Hypothetical Probe Sequence
tccccgtttcgtcagcatcg

SEQ ID NO: 6908 - DNA, 20 bp, Artificial Sequence
  Description of Artificial Sequence:  Hypothetical Probe Sequence
tccccgttcttggagtggta

SEQ ID NO: 6909 - DNA, 20 bp, Artificial Sequence
  Description of Artificial Sequence:  Hypothetical Probe Sequence
tccccgttctcaggtacacg

SEQ ID NO: 6910 - DNA, 20 bp, Artificial Sequence
  Description of Artificial Sequence:  Hypothetical Probe Sequence
tccccgttccatcacggatg

SEQ ID NO: 6911 - DNA, 20 bp, Artificial Sequence
  Description of Artificial Sequence:  Hypothetical Probe Sequence
tccccgttgctttcccctgt

SEQ ID NO: 6912 - DNA, 20 bp, Artificial Sequence
  Description of Artificial Sequence:  Hypothetical Probe Sequence
tccccgttgcaatctgacct

SEQ ID NO: 6913 - DNA, 20 bp, Artificial Sequence
  Description of Artificial Sequence:  Hypothetical Probe Sequence
tccccgttaccttgatacgg

SEQ ID NO: 6914 - DNA, 20 bp, Artificial Sequence
  Description of Artificial Sequence:  Hypothetical Probe Sequence
tccccgttatcgcctatccc

SEQ ID NO: 6915 - DNA, 20 bp, Artificial Sequence
  Description of Artificial Sequence:  Hypothetical Probe Sequence
tccccgtttgcgtcgtagga

SEQ ID NO: 6916 - DNA, 20 bp, Artificial Sequence
  Description of Artificial Sequence:  Hypothetical Probe Sequence
tccccgttgtgcagtgcgtt

SEQ ID NO: 6917 - DNA, 20 bp, Artificial Sequence
  Description of Artificial Sequence:  Hypothetical Probe Sequence
tcccctcatgattgcgacgg

SEQ ID NO: 6918 - DNA, 20 bp, Artificial Sequence
  Description of Artificial Sequence:  Hypothetical Probe Sequence
tcccctcattagcttgtgcg

SEQ ID NO: 6919 - DNA, 20 bp, Artificial Sequence
  Description of Artificial Sequence:  Hypothetical Probe Sequence
tcccctcatctggcttttag

SEQ ID NO: 6920 - DNA, 20 bp, Artificial Sequence
  Description of Artificial Sequence:  Hypothetical Probe Sequence
tcccctcaccatcctaagcc

SEQ ID NO: 6921 - DNA, 20 bp, Artificial Sequence
  Description of Artificial Sequence:  Hypothetical Probe Sequence
tcccctcagcttaggacgaa

SEQ ID NO: 6922 - DNA, 20 bp, Artificial Sequence
  Description of Artificial Sequence:  Hypothetical Probe Sequence
tcccctcaacctcctacacg

SEQ ID NO: 6923 - DNA, 20 bp, Artificial Sequence
  Description of Artificial Sequence:  Hypothetical Probe Sequence
tcccctcacacgatcgtcgt

SEQ ID NO: 6924 - DNA, 20 bp, Artificial Sequence
  Description of Artificial Sequence:  Hypothetical Probe Sequence
tcccctcacagcctgttccc

SEQ ID NO: 6925 - DNA, 20 bp, Artificial Sequence
  Description of Artificial Sequence:  Hypothetical Probe Sequence
tcccctgttgatgcttgacc

SEQ ID NO: 6926 - DNA, 20 bp, Artificial Sequence
  Description of Artificial Sequence:  Hypothetical Probe Sequence
tcccctgttctgccatgatg

SEQ ID NO: 6927 - DNA, 20 bp, Artificial Sequence
  Description of Artificial Sequence:  Hypothetical Probe Sequence
tcccctgttgtcgcaagacc

SEQ ID NO: 6928 - DNA, 20 bp, Artificial Sequence
  Description of Artificial Sequence:  Hypothetical Probe Sequence
tcccctgttcgtacctatcg

SEQ ID NO: 6929 - DNA, 20 bp, Artificial Sequence
  Description of Artificial Sequence:  Hypothetical Probe Sequence
tcccctgtcgaaaaagcgtt

SEQ ID NO: 6930 - DNA, 20 bp, Artificial Sequence
  Description of Artificial Sequence:  Hypothetical Probe Sequence
tcccctgtgcaaagtggacc

SEQ ID NO: 6931 - DNA, 20 bp, Artificial Sequence
  Description of Artificial Sequence:  Hypothetical Probe Sequence
tcccctgtaggatcccgcaa

SEQ ID NO: 6932 - DNA, 20 bp, Artificial Sequence
  Description of Artificial Sequence:  Hypothetical Probe Sequence
tcccctgtcctaagcctgcg

SEQ ID NO: 6933 - DNA, 20 bp, Artificial Sequence
  Description of Artificial Sequence:  Hypothetical Probe Sequence
tcccctgtgatgggacacgg

SEQ ID NO: 6934 - DNA, 20 bp, Artificial Sequence
  Description of Artificial Sequence:  Hypothetical Probe Sequence
tcccctgttgcgcttgtgtc

SEQ ID NO: 6935 - DNA, 20 bp, Artificial Sequence
  Description of Artificial Sequence:  Hypothetical Probe Sequence
tcccccatttgatcgtagtg

SEQ ID NO: 6936 - DNA, 20 bp, Artificial Sequence
  Description of Artificial Sequence:  Hypothetical Probe Sequence
tcccccatcttgtgcggatg

SEQ ID NO: 6937 - DNA, 20 bp, Artificial Sequence
  Description of Artificial Sequence:  Hypothetical Probe Sequence
tcccccatcgttgtctcgaa

SEQ ID NO: 6938 - DNA, 20 bp, Artificial Sequence
  Description of Artificial Sequence:  Hypothetical Probe Sequence
tcccccatctcagaccatcg

SEQ ID NO: 6939 - DNA, 20 bp, Artificial Sequence
  Description of Artificial Sequence:  Hypothetical Probe Sequence
tcccccatgcttcttgcgaa

SEQ ID NO: 6940 - DNA, 20 bp, Artificial Sequence
  Description of Artificial Sequence:  Hypothetical Probe Sequence
tcccccatggtattgaaaag

SEQ ID NO: 6941 - DNA, 20 bp, Artificial Sequence
  Description of Artificial Sequence:  Hypothetical Probe Sequence
tcccccatagtgagtgcgtt

SEQ ID NO: 6942 - DNA, 20 bp, Artificial Sequence
  Description of Artificial Sequence:  Hypothetical Probe Sequence
tcccccattgcgaatcagcc

SEQ ID NO: 6943 - DNA, 20 bp, Artificial Sequence
  Description of Artificial Sequence:  Hypothetical Probe Sequence
tcccccatgtgccagcttag

SEQ ID NO: 6944 - DNA, 20 bp, Artificial Sequence
  Description of Artificial Sequence:  Hypothetical Probe Sequence
tcccccatggacacctatac

SEQ ID NO: 6945 - DNA, 20 bp, Artificial Sequence
  Description of Artificial Sequence:  Hypothetical Probe Sequence
tccccgaaatacaatctccc

SEQ ID NO: 6946 - DNA, 20 bp, Artificial Sequence
  Description of Artificial Sequence:  Hypothetical Probe Sequence
tccccgaaaaaggcaaggta

SEQ ID NO: 6947 - DNA, 20 bp, Artificial Sequence
  Description of Artificial Sequence:  Hypothetical Probe Sequence
tccccgaatacaagtgcagc

SEQ ID NO: 6948 - DNA, 20 bp, Artificial Sequence
  Description of Artificial Sequence:  Hypothetical Probe Sequence
tccccgaacttggatgcagc

SEQ ID NO: 6949 - DNA, 20 bp, Artificial Sequence
  Description of Artificial Sequence:  Hypothetical Probe Sequence
tccccgaagcttttgaccat

SEQ ID NO: 6950 - DNA, 20 bp, Artificial Sequence
  Description of Artificial Sequence:  Hypothetical Probe Sequence
tccccgaagtctggtagtgc

SEQ ID NO: 6951 - DNA, 20 bp, Artificial Sequence
  Description of Artificial Sequence:  Hypothetical Probe Sequence
tccccgaaagtgggacggac

SEQ ID NO: 6952 - DNA, 20 bp, Artificial Sequence
  Description of Artificial Sequence:  Hypothetical Probe Sequence
tccccgaatgcgatcgttag

SEQ ID NO: 6953 - DNA, 20 bp, Artificial Sequence
  Description of Artificial Sequence:  Hypothetical Probe Sequence
tcccgcttttaggaccggac

SEQ ID NO: 6954 - DNA, 20 bp, Artificial Sequence
  Description of Artificial Sequence:  Hypothetical Probe Sequence
tcccgctttacactgtacgg

SEQ ID NO: 6955 - DNA, 20 bp, Artificial Sequence
  Description of Artificial Sequence:  Hypothetical Probe Sequence
tcccgcttcgaaatcgtctg

SEQ ID NO: 6956 - DNA, 20 bp, Artificial Sequence
  Description of Artificial Sequence:  Hypothetical Probe Sequence
tcccgcttgcttgtgcggta

SEQ ID NO: 6957 - DNA, 20 bp, Artificial Sequence
  Description of Artificial Sequence:  Hypothetical Probe Sequence
tcccgcttgtctaggacttg

SEQ ID NO: 6958 - DNA, 20 bp, Artificial Sequence
  Description of Artificial Sequence:  Hypothetical Probe Sequence
tcccgcttagtgcttggacc

SEQ ID NO: 6959 - DNA, 20 bp, Artificial Sequence
  Description of Artificial Sequence:  Hypothetical Probe Sequence
tcccgcttatcgagccttga

SEQ ID NO: 6960 - DNA, 20 bp, Artificial Sequence
  Description of Artificial Sequence:  Hypothetical Probe Sequence
tcccgcttcacgatcgccta

SEQ ID NO: 6961 - DNA, 20 bp, Artificial Sequence
  Description of Artificial Sequence:  Hypothetical Probe Sequence
tcccgcttcagcctcagatg

SEQ ID NO: 6962 - DNA, 20 bp, Artificial Sequence
  Description of Artificial Sequence:  Hypothetical Probe Sequence
tcccgcttagcctctggctt

SEQ ID NO: 6963 - DNA, 20 bp, Artificial Sequence
  Description of Artificial Sequence:  Hypothetical Probe Sequence
tcccggtatgatcgaagatg

SEQ ID NO: 6964 - DNA, 20 bp, Artificial Sequence
  Description of Artificial Sequence:  Hypothetical Probe Sequence
tcccggtaaatccacgggta

SEQ ID NO: 6965 - DNA, 20 bp, Artificial Sequence
  Description of Artificial Sequence:  Hypothetical Probe Sequence
tcccggtatgtccttggctt

SEQ ID NO: 6966 - DNA, 20 bp, Artificial Sequence
  Description of Artificial Sequence:  Hypothetical Probe Sequence
tcccggtactcaaatctgcg

SEQ ID NO: 6967 - DNA, 20 bp, Artificial Sequence
  Description of Artificial Sequence:  Hypothetical Probe Sequence
tcccggtactgtaggaacgg

SEQ ID NO: 6968 - DNA, 20 bp, Artificial Sequence
  Description of Artificial Sequence:  Hypothetical Probe Sequence
tcccggtaggtacctagtgc

SEQ ID NO: 6969 - DNA, 20 bp, Artificial Sequence
  Description of Artificial Sequence:  Hypothetical Probe Sequence
tcccggtaaggagcttcgtt

SEQ ID NO: 6970 - DNA, 20 bp, Artificial Sequence
  Description of Artificial Sequence:  Hypothetical Probe Sequence
tcccggtacctattagcagc

SEQ ID NO: 6971 - DNA, 20 bp, Artificial Sequence
  Description of Artificial Sequence:  Hypothetical Probe Sequence
tcccggtagatgtcgttctg

SEQ ID NO: 6972 - DNA, 20 bp, Artificial Sequence
  Description of Artificial Sequence:  Hypothetical Probe Sequence
tcccggtatgcgggtaagga

SEQ ID NO: 6973 - DNA, 20 bp, Artificial Sequence
  Description of Artificial Sequence:  Hypothetical Probe Sequence
tcccggtaagccccatctgt

SEQ ID NO: 6974 - DNA, 20 bp, Artificial Sequence
  Description of Artificial Sequence:  Hypothetical Probe Sequence
tcccgtctttgagcttgacc

SEQ ID NO: 6975 - DNA, 20 bp, Artificial Sequence
  Description of Artificial Sequence:  Hypothetical Probe Sequence
tcccgtcttgtcacggtgcg

SEQ ID NO: 6976 - DNA, 20 bp, Artificial Sequence
  Description of Artificial Sequence:  Hypothetical Probe Sequence
tcccgtcttcgtagtgcttg

SEQ ID NO: 6977 - DNA, 20 bp, Artificial Sequence
  Description of Artificial Sequence:  Hypothetical Probe Sequence
tcccgtctctcaaccttgcg

SEQ ID NO: 6978 - DNA, 20 bp, Artificial Sequence
  Description of Artificial Sequence:  Hypothetical Probe Sequence
tcccgtctagtgtcccagcc

SEQ ID NO: 6979 - DNA, 20 bp, Artificial Sequence
  Description of Artificial Sequence:  Hypothetical Probe Sequence
tcccgtctacctcctatgcg

SEQ ID NO: 6980 - DNA, 20 bp, Artificial Sequence
  Description of Artificial Sequence:  Hypothetical Probe Sequence
tcccgtctatcgctcatgcg

SEQ ID NO: 6981 - DNA, 20 bp, Artificial Sequence
  Description of Artificial Sequence:  Hypothetical Probe Sequence
tcccgtctcctaaggagacc

SEQ ID NO: 6982 - DNA, 20 bp, Artificial Sequence
  Description of Artificial Sequence:  Hypothetical Probe Sequence
tcccgtcttgcgccatgagt

SEQ ID NO: 6983 - DNA, 20 bp, Artificial Sequence
  Description of Artificial Sequence:  Hypothetical Probe Sequence
tcccgtctcacgaccttgtc

SEQ ID NO: 6984 - DNA, 20 bp, Artificial Sequence
  Description of Artificial Sequence:  Hypothetical Probe Sequence
tcccgtctggactctggctt

SEQ ID NO: 6985 - DNA, 20 bp, Artificial Sequence
  Description of Artificial Sequence:  Hypothetical Probe Sequence
tcccgtctacggcttgaatc

SEQ ID NO: 6986 - DNA, 20 bp, Artificial Sequence
  Description of Artificial Sequence:  Hypothetical Probe Sequence
tcccgtctagccgagtgacc

SEQ ID NO: 6987 - DNA, 20 bp, Artificial Sequence
  Description of Artificial Sequence:  Hypothetical Probe Sequence
tcccgagttgatccatcttg

SEQ ID NO: 6988 - DNA, 20 bp, Artificial Sequence
  Description of Artificial Sequence:  Hypothetical Probe Sequence
tcccgagtcttgatcggctt

SEQ ID NO: 6989 - DNA, 20 bp, Artificial Sequence
  Description of Artificial Sequence:  Hypothetical Probe Sequence
tcccgagtcgaagaccctca

SEQ ID NO: 6990 - DNA, 20 bp, Artificial Sequence
  Description of Artificial Sequence:  Hypothetical Probe Sequence
tcccgagtatcgtctgatcg

SEQ ID NO: 6991 - DNA, 20 bp, Artificial Sequence
  Description of Artificial Sequence:  Hypothetical Probe Sequence
tcccgagtcagcgaccacct

SEQ ID NO: 6992 - DNA, 20 bp, Artificial Sequence
  Description of Artificial Sequence:  Hypothetical Probe Sequence
tcccgagtgaccacgggctt

SEQ ID NO: 6993 - DNA, 20 bp, Artificial Sequence
  Description of Artificial Sequence:  Hypothetical Probe Sequence
tcccgagtgtgctgtcgatg

SEQ ID NO: 6994 - DNA, 20 bp, Artificial Sequence
  Description of Artificial Sequence:  Hypothetical Probe Sequence
tcccgagtacgggcaaagga

SEQ ID NO: 6995 - DNA, 20 bp, Artificial Sequence
  Description of Artificial Sequence:  Hypothetical Probe Sequence
tcccgcaattgacgttaaag

SEQ ID NO: 6996 - DNA, 20 bp, Artificial Sequence
  Description of Artificial Sequence:  Hypothetical Probe Sequence
tcccgcaattagccatccta

SEQ ID NO: 6997 - DNA, 20 bp, Artificial Sequence
  Description of Artificial Sequence:  Hypothetical Probe Sequence
tcccgcaaaatcggacaatc

SEQ ID NO: 6998 - DNA, 20 bp, Artificial Sequence
  Description of Artificial Sequence:  Hypothetical Probe Sequence
tcccgcaatacaatcgagtg

SEQ ID NO: 6999 - DNA, 20 bp, Artificial Sequence
  Description of Artificial Sequence:  Hypothetical Probe Sequence
tcccgcaacttgaaagatcg

SEQ ID NO: 7000 - DNA, 20 bp, Artificial Sequence
  Description of Artificial Sequence:  Hypothetical Probe Sequence
tcccgcaacgaagtgctgat

SEQ ID NO: 7001 - DNA, 20 bp, Artificial Sequence
  Description of Artificial Sequence:  Hypothetical Probe Sequence
tcccgcaagctttctggtgc

SEQ ID NO: 7002 - DNA, 20 bp, Artificial Sequence
  Description of Artificial Sequence:  Hypothetical Probe Sequence
tcccgcaagagtccatgcaa

SEQ ID NO: 7003 - DNA, 20 bp, Artificial Sequence
  Description of Artificial Sequence:  Hypothetical Probe Sequence
tcccgcaaagtgagtggatg

SEQ ID NO: 7004 - DNA, 20 bp, Artificial Sequence
  Description of Artificial Sequence:  Hypothetical Probe Sequence
tcccgcaacagcggacagga

SEQ ID NO: 7005 - DNA, 20 bp, Artificial Sequence
  Description of Artificial Sequence:  Hypothetical Probe Sequence
tcccgcaaggaccctacttg

SEQ ID NO: 7006 - DNA, 20 bp, Artificial Sequence
  Description of Artificial Sequence:  Hypothetical Probe Sequence
tcccgcaaagccggacatac

SEQ ID NO: 7007 - DNA, 20 bp, Artificial Sequence
  Description of Artificial Sequence:  Hypothetical Probe Sequence
tcccagtgctcagtgccgaa

SEQ ID NO: 7008 - DNA, 20 bp, Artificial Sequence
  Description of Artificial Sequence:  Hypothetical Probe Sequence
tcccagtgctgtatcgcacg

SEQ ID NO: 7009 - DNA, 20 bp, Artificial Sequence
  Description of Artificial Sequence:  Hypothetical Probe Sequence
tcccagtgccattcccgagt

SEQ ID NO: 7010 - DNA, 20 bp, Artificial Sequence
  Description of Artificial Sequence:  Hypothetical Probe Sequence
tcccagtggcaatcgtcgaa

SEQ ID NO: 7011 - DNA, 20 bp, Artificial Sequence
  Description of Artificial Sequence:  Hypothetical Probe Sequence
tcccagtgcctaggacgtct

SEQ ID NO: 7012 - DNA, 20 bp, Artificial Sequence
  Description of Artificial Sequence:  Hypothetical Probe Sequence
tcccagtgtccccctagtgc

SEQ ID NO: 7013 - DNA, 20 bp, Artificial Sequence
  Description of Artificial Sequence:  Hypothetical Probe Sequence
tcccagtgcagcgtctcgtt

SEQ ID NO: 7014 - DNA, 20 bp, Artificial Sequence
  Description of Artificial Sequence:  Hypothetical Probe Sequence
tcccagtgggacagtggctt

SEQ ID NO: 7015 - DNA, 20 bp, Artificial Sequence
  Description of Artificial Sequence:  Hypothetical Probe Sequence
tcccagtgagcccgtttcgt

SEQ ID NO: 7016 - DNA, 20 bp, Artificial Sequence
  Description of Artificial Sequence:  Hypothetical Probe Sequence
accttctgaatctccctgcg

SEQ ID NO: 7017 - DNA, 20 bp, Artificial Sequence
  Description of Artificial Sequence:  Hypothetical Probe Sequence
tcccaccttgtcatcggtgc

SEQ ID NO: 7018 - DNA, 20 bp, Artificial Sequence
  Description of Artificial Sequence:  Hypothetical Probe Sequence
tcccacctgcaacacgtgtc

SEQ ID NO: 7019 - DNA, 20 bp, Artificial Sequence
  Description of Artificial Sequence:  Hypothetical Probe Sequence
acctaggacagctctgcacg

SEQ ID NO: 7020 - DNA, 20 bp, Artificial Sequence
  Description of Artificial Sequence:  Hypothetical Probe Sequence
acctgatgcttgtcgttgcg

SEQ ID NO: 7021 - DNA, 20 bp, Artificial Sequence
  Description of Artificial Sequence:  Hypothetical Probe Sequence
tcccaccttccccacgctca

SEQ ID NO: 7022 - DNA, 20 bp, Artificial Sequence
  Description of Artificial Sequence:  Hypothetical Probe Sequence
tcccacctcagccttggagt

SEQ ID NO: 7023 - DNA, 20 bp, Artificial Sequence
  Description of Artificial Sequence:  Hypothetical Probe Sequence
tcccacctacggtcgtcgaa

SEQ ID NO: 7024 - DNA, 20 bp, Artificial Sequence
  Description of Artificial Sequence:  Hypothetical Probe Sequence
tcccatcgcgttgcttaaag

SEQ ID NO: 7025 - DNA, 20 bp, Artificial Sequence
  Description of Artificial Sequence:  Hypothetical Probe Sequence
tcccatcgccatcagcctca

SEQ ID NO: 7026 - DNA, 20 bp, Artificial Sequence
  Description of Artificial Sequence:  Hypothetical Probe Sequence
atcggatgttagaccttgcg

SEQ ID NO: 7027 - DNA, 20 bp, Artificial Sequence
  Description of Artificial Sequence:  Hypothetical Probe Sequence
tcccatcgtgcgaggaggta

SEQ ID NO: 7028 - DNA, 20 bp, Artificial Sequence
  Description of Artificial Sequence:  Hypothetical Probe Sequence
tcccatcgcacgtcgttccc

SEQ ID NO: 7029 - DNA, 20 bp, Artificial Sequence
  Description of Artificial Sequence:  Hypothetical Probe Sequence
tcccatcgcagccagcaatc

SEQ ID NO: 7030 - DNA, 20 bp, Artificial Sequence
  Description of Artificial Sequence:  Hypothetical Probe Sequence
tcccatcggaccttgacagc

SEQ ID NO: 7031 - DNA, 20 bp, Artificial Sequence
  Description of Artificial Sequence:  Hypothetical Probe Sequence
tcccatcgggacctcaatcg

SEQ ID NO: 7032 - DNA, 20 bp, Artificial Sequence
  Description of Artificial Sequence:  Hypothetical Probe Sequence
tcccatcgagccatcgccat

SEQ ID NO: 7033 - DNA, 20 bp, Artificial Sequence
  Description of Artificial Sequence:  Hypothetical Probe Sequence
tcccaggacttggtgcgtgc

SEQ ID NO: 7034 - DNA, 20 bp, Artificial Sequence
  Description of Artificial Sequence:  Hypothetical Probe Sequence
tcccaggagcttacggagcc

SEQ ID NO: 7035 - DNA, 20 bp, Artificial Sequence
  Description of Artificial Sequence:  Hypothetical Probe Sequence
aggaggtattagtgcgtgcg

SEQ ID NO: 7036 - DNA, 20 bp, Artificial Sequence
  Description of Artificial Sequence:  Hypothetical Probe Sequence
tcccaggagagtggactccc

SEQ ID NO: 7037 - DNA, 20 bp, Artificial Sequence
  Description of Artificial Sequence:  Hypothetical Probe Sequence
tcccaggaacctcgaagcaa

SEQ ID NO: 7038 - DNA, 20 bp, Artificial Sequence
  Description of Artificial Sequence:  Hypothetical Probe Sequence
tcccaggagatgtgcgtgcg

SEQ ID NO: 7039 - DNA, 20 bp, Artificial Sequence
  Description of Artificial Sequence:  Hypothetical Probe Sequence
tcccaggatccccctaagga

SEQ ID NO: 7040 - DNA, 20 bp, Artificial Sequence
  Description of Artificial Sequence:  Hypothetical Probe Sequence
tcccaggatgcgaatcgcaa

SEQ ID NO: 7041 - DNA, 20 bp, Artificial Sequence
  Description of Artificial Sequence:  Hypothetical Probe Sequence
tccccctatgatcgaaagcc

SEQ ID NO: 7042 - DNA, 20 bp, Artificial Sequence
  Description of Artificial Sequence:  Hypothetical Probe Sequence
tccccctacgttcctaatcg

SEQ ID NO: 7043 - DNA, 20 bp, Artificial Sequence
  Description of Artificial Sequence:  Hypothetical Probe Sequence
tccccctactcagtgcacgg

SEQ ID NO: 7044 - DNA, 20 bp, Artificial Sequence
  Description of Artificial Sequence:  Hypothetical Probe Sequence
tccccctagcttcacgggta

SEQ ID NO: 7045 - DNA, 20 bp, Artificial Sequence
  Description of Artificial Sequence:  Hypothetical Probe Sequence
tccccctaggtagagttgcg

SEQ ID NO: 7046 - DNA, 20 bp, Artificial Sequence
  Description of Artificial Sequence:  Hypothetical Probe Sequence
tccccctatgcggatgtgcg

SEQ ID NO: 7047 - DNA, 20 bp, Artificial Sequence
  Description of Artificial Sequence:  Hypothetical Probe Sequence
tccccctagaccatacacgg

SEQ ID NO: 7048 - DNA, 20 bp, Artificial Sequence
  Description of Artificial Sequence:  Hypothetical Probe Sequence
tccccctaggacaatcctca

SEQ ID NO: 7049 - DNA, 20 bp, Artificial Sequence
  Description of Artificial Sequence:  Hypothetical Probe Sequence
tccccctaacggctgtggac

SEQ ID NO: 7050 - DNA, 20 bp, Artificial Sequence
  Description of Artificial Sequence:  Hypothetical Probe Sequence
tcccgatgttgatcccccta

SEQ ID NO: 7051 - DNA, 20 bp, Artificial Sequence
  Description of Artificial Sequence:  Hypothetical Probe Sequence
tcccgatgttagctgtagcc

SEQ ID NO: 7052 - DNA, 20 bp, Artificial Sequence
  Description of Artificial Sequence:  Hypothetical Probe Sequence
tcccgatgtgtcacggtgtc

SEQ ID NO: 7053 - DNA, 20 bp, Artificial Sequence
  Description of Artificial Sequence:  Hypothetical Probe Sequence
tcccgatgctgtaaagggac

SEQ ID NO: 7054 - DNA, 20 bp, Artificial Sequence
  Description of Artificial Sequence:  Hypothetical Probe Sequence
tcccgatgggtaagtgtccc

SEQ ID NO: 7055 - DNA, 20 bp, Artificial Sequence
  Description of Artificial Sequence:  Hypothetical Probe Sequence
tcccgatggagttgtccttg

SEQ ID NO: 7056 - DNA, 20 bp, Artificial Sequence
  Description of Artificial Sequence:  Hypothetical Probe Sequence
tcccgatggcaagcaaaaag

SEQ ID NO: 7057 - DNA, 20 bp, Artificial Sequence
  Description of Artificial Sequence:  Hypothetical Probe Sequence
tcccgatgatcgggacagtg

SEQ ID NO: 7058 - DNA, 20 bp, Artificial Sequence
  Description of Artificial Sequence:  Hypothetical Probe Sequence
tcccgatgtgcgatacccat

SEQ ID NO: 7059 - DNA, 20 bp, Artificial Sequence
  Description of Artificial Sequence:  Hypothetical Probe Sequence
tcccgatgcacgggaccttg

SEQ ID NO: 7060 - DNA, 20 bp, Artificial Sequence
  Description of Artificial Sequence:  Hypothetical Probe Sequence
tcccgatggaccgcaacgtt

SEQ ID NO: 7061 - DNA, 20 bp, Artificial Sequence
  Description of Artificial Sequence:  Hypothetical Probe Sequence
tcccgatgggaccctacagc

SEQ ID NO: 7062 - DNA, 20 bp, Artificial Sequence
  Description of Artificial Sequence:  Hypothetical Probe Sequence
tcccgatgacggctcacttg

SEQ ID NO: 7063 - DNA, 20 bp, Artificial Sequence
  Description of Artificial Sequence:  Hypothetical Probe Sequence
tcccgatgagcctgcgttag

SEQ ID NO: 7064 - DNA, 20 bp, Artificial Sequence
  Description of Artificial Sequence:  Hypothetical Probe Sequence
tccctgatacctcagcgtgc

SEQ ID NO: 7065 - DNA, 20 bp, Artificial Sequence
  Description of Artificial Sequence:  Hypothetical Probe Sequence
tccctacagtgcgcaaacgg

SEQ ID NO: 7066 - DNA, 20 bp, Artificial Sequence
  Description of Artificial Sequence:  Hypothetical Probe Sequence
tccctccctgtccctacgaa

SEQ ID NO: 7067 - DNA, 20 bp, Artificial Sequence
  Description of Artificial Sequence:  Hypothetical Probe Sequence
tccccttgttagggacccat

SEQ ID NO: 7068 - DNA, 20 bp, Artificial Sequence
  Description of Artificial Sequence:  Hypothetical Probe Sequence
tccctcccctcacgttccat

SEQ ID NO: 7069 - DNA, 20 bp, Artificial Sequence
  Description of Artificial Sequence:  Hypothetical Probe Sequence
tccctcccctgtgtgcgagt

SEQ ID NO: 7070 - DNA, 20 bp, Artificial Sequence
  Description of Artificial Sequence:  Hypothetical Probe Sequence
tccccgaattagctgttgcg

SEQ ID NO: 7071 - DNA, 20 bp, Artificial Sequence
  Description of Artificial Sequence:  Hypothetical Probe Sequence
tccctcccatcgcctaatcg

SEQ ID NO: 7072 - DNA, 20 bp, Artificial Sequence
  Description of Artificial Sequence:  Hypothetical Probe Sequence
tccctcccaggattgaacgg

SEQ ID NO: 7073 - DNA, 20 bp, Artificial Sequence
  Description of Artificial Sequence:  Hypothetical Probe Sequence
tccctcccgatgaaagacct

SEQ ID NO: 7074 - DNA, 20 bp, Artificial Sequence
  Description of Artificial Sequence:  Hypothetical Probe Sequence
tccctcccacggaatcagga

SEQ ID NO: 7075 - DNA, 20 bp, Artificial Sequence
  Description of Artificial Sequence:  Hypothetical Probe Sequence
tccctgcgtgatagtggcaa

SEQ ID NO: 7076 - DNA, 20 bp, Artificial Sequence
  Description of Artificial Sequence:  Hypothetical Probe Sequence
tgcgatacgtgcaatcgcaa

SEQ ID NO: 7077 - DNA, 20 bp, Artificial Sequence
  Description of Artificial Sequence:  Hypothetical Probe Sequence
tccctgcgaaagagtgcgaa

SEQ ID NO: 7078 - DNA, 20 bp, Artificial Sequence
  Description of Artificial Sequence:  Hypothetical Probe Sequence
tgcgtacaccatatcgtgcg

SEQ ID NO: 7079 - DNA, 20 bp, Artificial Sequence
  Description of Artificial Sequence:  Hypothetical Probe Sequence
tgcgtgtcagtgcttggtgc

SEQ ID NO: 7080 - DNA, 20 bp, Artificial Sequence
  Description of Artificial Sequence:  Hypothetical Probe Sequence
tgcgcttgaggaataccgtt

SEQ ID NO: 7081 - DNA, 20 bp, Artificial Sequence
  Description of Artificial Sequence:  Hypothetical Probe Sequence
tgcgcgaacacgtgatcacg

SEQ ID NO: 7082 - DNA, 20 bp, Artificial Sequence
  Description of Artificial Sequence:  Hypothetical Probe Sequence
tgcggcttttgaagtgagcc

SEQ ID NO: 7083 - DNA, 20 bp, Artificial Sequence
  Description of Artificial Sequence:  Hypothetical Probe Sequence
tccctgcggcaacgttgtct

SEQ ID NO: 7084 - DNA, 20 bp, Artificial Sequence
  Description of Artificial Sequence:  Hypothetical Probe Sequence
tccctgcgacctgcaaatcg

SEQ ID NO: 7085 - DNA, 20 bp, Artificial Sequence
  Description of Artificial Sequence:  Hypothetical Probe Sequence
tgcgaggagagtgtgcggac

SEQ ID NO: 7086 - DNA, 20 bp, Artificial Sequence
  Description of Artificial Sequence:  Hypothetical Probe Sequence
tccctgcgtcccgagtgcaa

SEQ ID NO: 7087 - DNA, 20 bp, Artificial Sequence
  Description of Artificial Sequence:  Hypothetical Probe Sequence
tccctgcgcacgggtacgtt

SEQ ID NO: 7088 - DNA, 20 bp, Artificial Sequence
  Description of Artificial Sequence:  Hypothetical Probe Sequence
tccctgcgcagcctgtagga

SEQ ID NO: 7089 - DNA, 20 bp, Artificial Sequence
  Description of Artificial Sequence:  Hypothetical Probe Sequence
tccctgcggaccctgtcagc

SEQ ID NO: 7090 - DNA, 20 bp, Artificial Sequence
  Description of Artificial Sequence:  Hypothetical Probe Sequence
tccctgcggtgcgcttgcaa

SEQ ID NO: 7091 - DNA, 20 bp, Artificial Sequence
  Description of Artificial Sequence:  Hypothetical Probe Sequence
tccccacgttgacagctccc

SEQ ID NO: 7092 - DNA, 20 bp, Artificial Sequence
  Description of Artificial Sequence:  Hypothetical Probe Sequence
tccccacgttagtcgtcttg

SEQ ID NO: 7093 - DNA, 20 bp, Artificial Sequence
  Description of Artificial Sequence:  Hypothetical Probe Sequence
tccccacgtctgggacacgg

SEQ ID NO: 7094 - DNA, 20 bp, Artificial Sequence
  Description of Artificial Sequence:  Hypothetical Probe Sequence
tccccacgtcgtgtgcatac

SEQ ID NO: 7095 - DNA, 20 bp, Artificial Sequence
  Description of Artificial Sequence:  Hypothetical Probe Sequence
tccccacgctgttctgagcc

SEQ ID NO: 7096 - DNA, 20 bp, Artificial Sequence
  Description of Artificial Sequence:  Hypothetical Probe Sequence
tccccacgggtatcccctgt

SEQ ID NO: 7097 - DNA, 20 bp, Artificial Sequence
  Description of Artificial Sequence:  Hypothetical Probe Sequence
tccccacggtctcagcatcg

SEQ ID NO: 7098 - DNA, 20 bp, Artificial Sequence
  Description of Artificial Sequence:  Hypothetical Probe Sequence
tccccacggcaaaatcgtgc

SEQ ID NO: 7099 - DNA, 20 bp, Artificial Sequence
  Description of Artificial Sequence:  Hypothetical Probe Sequence
tccccacgacctaatcgatg

SEQ ID NO: 7100 - DNA, 20 bp, Artificial Sequence
  Description of Artificial Sequence:  Hypothetical Probe Sequence
tccccacgatcgcgaatgat

SEQ ID NO: 7101 - DNA, 20 bp, Artificial Sequence
  Description of Artificial Sequence:  Hypothetical Probe Sequence
tccccacgcctagtgcagcc

SEQ ID NO: 7102 - DNA, 20 bp, Artificial Sequence
  Description of Artificial Sequence:  Hypothetical Probe Sequence
tccccacgtgcgtgattcgt

SEQ ID NO: 7103 - DNA, 20 bp, Artificial Sequence
  Description of Artificial Sequence:  Hypothetical Probe Sequence
tccccacgcagccgttcttg

SEQ ID NO: 7104 - DNA, 20 bp, Artificial Sequence
  Description of Artificial Sequence:  Hypothetical Probe Sequence
tccccacggaccagcctaca

SEQ ID NO: 7105 - DNA, 20 bp, Artificial Sequence
  Description of Artificial Sequence:  Hypothetical Probe Sequence
tccccacggtgctgtctgcg

SEQ ID NO: 7106 - DNA, 20 bp, Artificial Sequence
  Description of Artificial Sequence:  Hypothetical Probe Sequence
tccccacgggacccatcgtt

SEQ ID NO: 7107 - DNA, 20 bp, Artificial Sequence
  Description of Artificial Sequence:  Hypothetical Probe Sequence
tccccagcttgaaaaggacc

SEQ ID NO: 7108 - DNA, 20 bp, Artificial Sequence
  Description of Artificial Sequence:  Hypothetical Probe Sequence
tccccagcaatcggacggta

SEQ ID NO: 7109 - DNA, 20 bp, Artificial Sequence
  Description of Artificial Sequence:  Hypothetical Probe Sequence
tccccagctacagcaaaaag

SEQ ID NO: 7110 - DNA, 20 bp, Artificial Sequence
  Description of Artificial Sequence:  Hypothetical Probe Sequence
tccccagctctgatcggtct

SEQ ID NO: 7111 - DNA, 20 bp, Artificial Sequence
  Description of Artificial Sequence:  Hypothetical Probe Sequence
tccccagctcgtctgtgatg

SEQ ID NO: 7112 - DNA, 20 bp, Artificial Sequence
  Description of Artificial Sequence:  Hypothetical Probe Sequence
tccccagccttgctgtatcg

SEQ ID NO: 7113 - DNA, 20 bp, Artificial Sequence
  Description of Artificial Sequence:  Hypothetical Probe Sequence
tccccagccgaagtgcctca

SEQ ID NO: 7114 - DNA, 20 bp, Artificial Sequence
  Description of Artificial Sequence:  Hypothetical Probe Sequence
tccccagcggtaaggacagc

SEQ ID NO: 7115 - DNA, 20 bp, Artificial Sequence
  Description of Artificial Sequence:  Hypothetical Probe Sequence
tccccagcacctaatcacgg

SEQ ID NO: 7116 - DNA, 20 bp, Artificial Sequence
  Description of Artificial Sequence:  Hypothetical Probe Sequence
tccccagcatcggatgcttg

SEQ ID NO: 7117 - DNA, 20 bp, Artificial Sequence
  Description of Artificial Sequence:  Hypothetical Probe Sequence
tccccagcaggagagtagcc

SEQ ID NO: 7118 - DNA, 20 bp, Artificial Sequence
  Description of Artificial Sequence:  Hypothetical Probe Sequence
tccccagccagctctgtgtc

SEQ ID NO: 7119 - DNA, 20 bp, Artificial Sequence
  Description of Artificial Sequence:  Hypothetical Probe Sequence
tccccagcggaccgaatgtc

SEQ ID NO: 7120 - DNA, 20 bp, Artificial Sequence
  Description of Artificial Sequence:  Hypothetical Probe Sequence
tccccagcagccggtagctt

SEQ ID NO: 7121 - DNA, 20 bp, Artificial Sequence
  Description of Artificial Sequence:  Hypothetical Probe Sequence
tcccgacctgattgattgtc

SEQ ID NO: 7122 - DNA, 20 bp, Artificial Sequence
  Description of Artificial Sequence:  Hypothetical Probe Sequence
tcccgaccttagaatcgtgc

SEQ ID NO: 7123 - DNA, 20 bp, Artificial Sequence
  Description of Artificial Sequence:  Hypothetical Probe Sequence
tcccgaccaatcttgagacc

SEQ ID NO: 7124 - DNA, 20 bp, Artificial Sequence
  Description of Artificial Sequence:  Hypothetical Probe Sequence
tcccgacctacattgaacgg

SEQ ID NO: 7125 - DNA, 20 bp, Artificial Sequence
  Description of Artificial Sequence:  Hypothetical Probe Sequence
tcccgacctgtctcccgagt

SEQ ID NO: 7126 - DNA, 20 bp, Artificial Sequence
  Description of Artificial Sequence:  Hypothetical Probe Sequence
tcccgacccgttttagcgtt

SEQ ID NO: 7127 - DNA, 20 bp, Artificial Sequence
  Description of Artificial Sequence:  Hypothetical Probe Sequence
tcccgaccctcaggtagcaa

SEQ ID NO: 7128 - DNA, 20 bp, Artificial Sequence
  Description of Artificial Sequence:  Hypothetical Probe Sequence
tcccgaccctgtaggacttg

SEQ ID NO: 7129 - DNA, 20 bp, Artificial Sequence
  Description of Artificial Sequence:  Hypothetical Probe Sequence
tcccgaccgtctaaaggacc

SEQ ID NO: 7130 - DNA, 20 bp, Artificial Sequence
  Description of Artificial Sequence:  Hypothetical Probe Sequence
tcccgaccgagtgtcttgcg

SEQ ID NO: 7131 - DNA, 20 bp, Artificial Sequence
  Description of Artificial Sequence:  Hypothetical Probe Sequence
tcccgaccgcaaaggagatg

SEQ ID NO: 7132 - DNA, 20 bp, Artificial Sequence
  Description of Artificial Sequence:  Hypothetical Probe Sequence
tcccgacccctaatacgatg

SEQ ID NO: 7133 - DNA, 20 bp, Artificial Sequence
  Description of Artificial Sequence:  Hypothetical Probe Sequence
tcccgacccacggtgcagcc

SEQ ID NO: 7134 - DNA, 20 bp, Artificial Sequence
  Description of Artificial Sequence:  Hypothetical Probe Sequence
tcccgtgcttgatctgagtg

SEQ ID NO: 7135 - DNA, 20 bp, Artificial Sequence
  Description of Artificial Sequence:  Hypothetical Probe Sequence
tcccgtgcttagtgatagcc

SEQ ID NO: 7136 - DNA, 20 bp, Artificial Sequence
  Description of Artificial Sequence:  Hypothetical Probe Sequence
tcccgtgctgtcccatcgtt

SEQ ID NO: 7137 - DNA, 20 bp, Artificial Sequence
  Description of Artificial Sequence:  Hypothetical Probe Sequence
tcccgtgcctcaaatcgtgc

SEQ ID NO: 7138 - DNA, 20 bp, Artificial Sequence
  Description of Artificial Sequence:  Hypothetical Probe Sequence
tcccgtgccgaacgaactca

SEQ ID NO: 7139 - DNA, 20 bp, Artificial Sequence
  Description of Artificial Sequence:  Hypothetical Probe Sequence
tcccgtgcgtctctgtacgg

SEQ ID NO: 7140 - DNA, 20 bp, Artificial Sequence
  Description of Artificial Sequence:  Hypothetical Probe Sequence
tcccgtgcacctgtctgatg

SEQ ID NO: 7141 - DNA, 20 bp, Artificial Sequence
  Description of Artificial Sequence:  Hypothetical Probe Sequence
tcccgtgctcccgcttgtgc

SEQ ID NO: 7142 - DNA, 20 bp, Artificial Sequence
  Description of Artificial Sequence:  Hypothetical Probe Sequence
tcccgtgcgaccttgaagtg

SEQ ID NO: 7143 - DNA, 20 bp, Artificial Sequence
  Description of Artificial Sequence:  Hypothetical Probe Sequence
tcccgtgcgtgcttaggtgc

SEQ ID NO: 7144 - DNA, 20 bp, Artificial Sequence
  Description of Artificial Sequence:  Hypothetical Probe Sequence
tcccgtgcacggaaagccta

SEQ ID NO: 7145 - DNA, 20 bp, Artificial Sequence
  Description of Artificial Sequence:  Hypothetical Probe Sequence
tcccgtgcagccaggattag

SEQ ID NO: 7146 - DNA, 20 bp, Artificial Sequence
  Description of Artificial Sequence:  Hypothetical Probe Sequence
tcccggacaatcatcgagga

SEQ ID NO: 7147 - DNA, 20 bp, Artificial Sequence
  Description of Artificial Sequence:  Hypothetical Probe Sequence
tcccggacatactgtcggac

SEQ ID NO: 7148 - DNA, 20 bp, Artificial Sequence
  Description of Artificial Sequence:  Hypothetical Probe Sequence
tcccggacaaagtcccttag

SEQ ID NO: 7149 - DNA, 20 bp, Artificial Sequence
  Description of Artificial Sequence:  Hypothetical Probe Sequence
tcccggactacacttgacgg

SEQ ID NO: 7150 - DNA, 20 bp, Artificial Sequence
  Description of Artificial Sequence:  Hypothetical Probe Sequence
tcccggactcgtcgaagacc

SEQ ID NO: 7151 - DNA, 20 bp, Artificial Sequence
  Description of Artificial Sequence:  Hypothetical Probe Sequence
tcccggaccttgccatctca

SEQ ID NO: 7152 - DNA, 20 bp, Artificial Sequence
  Description of Artificial Sequence:  Hypothetical Probe Sequence
tcccggaccgttcacgctca

SEQ ID NO: 7153 - DNA, 20 bp, Artificial Sequence
  Description of Artificial Sequence:  Hypothetical Probe Sequence
tcccggacgtctatactccc

SEQ ID NO: 7154 - DNA, 20 bp, Artificial Sequence
  Description of Artificial Sequence:  Hypothetical Probe Sequence
tcccggacatcggagtctca

SEQ ID NO: 7155 - DNA, 20 bp, Artificial Sequence
  Description of Artificial Sequence:  Hypothetical Probe Sequence
tcccggacgatgccatatcg

SEQ ID NO: 7156 - DNA, 20 bp, Artificial Sequence
  Description of Artificial Sequence:  Hypothetical Probe Sequence
tcccggactgcgaatcccta

SEQ ID NO: 7157 - DNA, 20 bp, Artificial Sequence
  Description of Artificial Sequence:  Hypothetical Probe Sequence
tcccggaccacgttgacgaa

SEQ ID NO: 7158 - DNA, 20 bp, Artificial Sequence
  Description of Artificial Sequence:  Hypothetical Probe Sequence
tcccggacgaccggacaaag

SEQ ID NO: 7159 - DNA, 20 bp, Artificial Sequence
  Description of Artificial Sequence:  Hypothetical Probe Sequence
tcccggacgtgcaaagtctg

SEQ ID NO: 7160 - DNA, 20 bp, Artificial Sequence
  Description of Artificial Sequence:  Hypothetical Probe Sequence
tcccggacggacgcaaagga

SEQ ID NO: 7161 - DNA, 20 bp, Artificial Sequence
  Description of Artificial Sequence:  Hypothetical Probe Sequence
tcccggacagccacctagcc

SEQ ID NO: 7162 - DNA, 20 bp, Artificial Sequence
  Description of Artificial Sequence:  Hypothetical Probe Sequence
tcccacggttgactgtagga

SEQ ID NO: 7163 - DNA, 20 bp, Artificial Sequence
  Description of Artificial Sequence:  Hypothetical Probe Sequence
tcccacgggctttctgcgtt

SEQ ID NO: 7164 - DNA, 20 bp, Artificial Sequence
  Description of Artificial Sequence:  Hypothetical Probe Sequence
tcccacgggtctggtagctt

SEQ ID NO: 7165 - DNA, 20 bp, Artificial Sequence
  Description of Artificial Sequence:  Hypothetical Probe Sequence
tcccacggcctatcccatac

SEQ ID NO: 7166 - DNA, 20 bp, Artificial Sequence
  Description of Artificial Sequence:  Hypothetical Probe Sequence
acggtgcgcctaatacgcaa

SEQ ID NO: 7167 - DNA, 20 bp, Artificial Sequence
  Description of Artificial Sequence:  Hypothetical Probe Sequence
acgggaccatacctgttgcg

SEQ ID NO: 7168 - DNA, 20 bp, Artificial Sequence
  Description of Artificial Sequence:  Hypothetical Probe Sequence
tcccacgggtgcatcgttag

SEQ ID NO: 7169 - DNA, 20 bp, Artificial Sequence
  Description of Artificial Sequence:  Hypothetical Probe Sequence
tcccagccttgatctgatcg

SEQ ID NO: 7170 - DNA, 20 bp, Artificial Sequence
  Description of Artificial Sequence:  Hypothetical Probe Sequence
tcccagcctgatgatgtgcg

SEQ ID NO: 7171 - DNA, 20 bp, Artificial Sequence
  Description of Artificial Sequence:  Hypothetical Probe Sequence
tcccagccttagagtgcttg

SEQ ID NO: 7172 - DNA, 20 bp, Artificial Sequence
  Description of Artificial Sequence:  Hypothetical Probe Sequence
tcccagccatacaatcacgg

SEQ ID NO: 7173 - DNA, 20 bp, Artificial Sequence
  Description of Artificial Sequence:  Hypothetical Probe Sequence
tcccagcctctgttgagtgc

SEQ ID NO: 7174 - DNA, 20 bp, Artificial Sequence
  Description of Artificial Sequence:  Hypothetical Probe Sequence
tcccagcctcgtgtctacgg

SEQ ID NO: 7175 - DNA, 20 bp, Artificial Sequence
  Description of Artificial Sequence:  Hypothetical Probe Sequence
tcccagccctcattagtccc

SEQ ID NO: 7176 - DNA, 20 bp, Artificial Sequence
  Description of Artificial Sequence:  Hypothetical Probe Sequence
tcccagccgcttcctaacct

SEQ ID NO: 7177 - DNA, 20 bp, Artificial Sequence
  Description of Artificial Sequence:  Hypothetical Probe Sequence
tcccagccggtattaggacc

SEQ ID NO: 7178 - DNA, 20 bp, Artificial Sequence
  Description of Artificial Sequence:  Hypothetical Probe Sequence
tcccagccagtgttagccta

SEQ ID NO: 7179 - DNA, 20 bp, Artificial Sequence
  Description of Artificial Sequence:  Hypothetical Probe Sequence
tcccagccacctatactgcg

SEQ ID NO: 7180 - DNA, 20 bp, Artificial Sequence
  Description of Artificial Sequence:  Hypothetical Probe Sequence
tcccagccatcggtgctgat

SEQ ID NO: 7181 - DNA, 20 bp, Artificial Sequence
  Description of Artificial Sequence:  Hypothetical Probe Sequence
tcccagcctcccaccttgat

SEQ ID NO: 7182 - DNA, 20 bp, Artificial Sequence
  Description of Artificial Sequence:  Hypothetical Probe Sequence
tcccagcccacgggtaagcc

SEQ ID NO: 7183 - DNA, 20 bp, Artificial Sequence
  Description of Artificial Sequence:  Hypothetical Probe Sequence
tcccagcccagccttggatg

SEQ ID NO: 7184 - DNA, 20 bp, Artificial Sequence
  Description of Artificial Sequence:  Hypothetical Probe Sequence
tcccagccgtgcaaagagga

SEQ ID NO: 7185 - DNA, 20 bp, Artificial Sequence
  Description of Artificial Sequence:  Hypothetical Probe Sequence
tgcgttgattgagagtacgg

SEQ ID NO: 7186 - DNA, 20 bp, Artificial Sequence
  Description of Artificial Sequence:  Hypothetical Probe Sequence
tgcgttgaaaagatcgtgcg

SEQ ID NO: 7187 - DNA, 20 bp, Artificial Sequence
  Description of Artificial Sequence:  Hypothetical Probe Sequence
tgcgttgacgttctgtccta

SEQ ID NO: 7188 - DNA, 20 bp, Artificial Sequence
  Description of Artificial Sequence:  Hypothetical Probe Sequence
tgcgttgaccattcgtatcg

SEQ ID NO: 7189 - DNA, 20 bp, Artificial Sequence
  Description of Artificial Sequence:  Hypothetical Probe Sequence
tgcgttgacacgcgttttga

SEQ ID NO: 7190 - DNA, 20 bp, Artificial Sequence
  Description of Artificial Sequence:  Hypothetical Probe Sequence
tgcgttgaggacgatgtccc

SEQ ID NO: 7191 - DNA, 20 bp, Artificial Sequence
  Description of Artificial Sequence:  Hypothetical Probe Sequence
tgcgttgaagccagtgcgaa

SEQ ID NO: 7192 - DNA, 20 bp, Artificial Sequence
  Description of Artificial Sequence:  Hypothetical Probe Sequence
tgcgtgattgtccagccttg

SEQ ID NO: 7193 - DNA, 20 bp, Artificial Sequence
  Description of Artificial Sequence:  Hypothetical Probe Sequence
tgcgtgatcttgggactccc

SEQ ID NO: 7194 - DNA, 20 bp, Artificial Sequence
  Description of Artificial Sequence:  Hypothetical Probe Sequence
tgcgtgatgctttcccacct

SEQ ID NO: 7195 - DNA, 20 bp, Artificial Sequence
  Description of Artificial Sequence:  Hypothetical Probe Sequence
tgcgtgatgagtcagccagc

SEQ ID NO: 7196 - DNA, 20 bp, Artificial Sequence
  Description of Artificial Sequence:  Hypothetical Probe Sequence
tgatgcaactgtccattgcg

SEQ ID NO: 7197 - DNA, 20 bp, Artificial Sequence
  Description of Artificial Sequence:  Hypothetical Probe Sequence
tgcgtgattcccacctcttg

SEQ ID NO: 7198 - DNA, 20 bp, Artificial Sequence
  Description of Artificial Sequence:  Hypothetical Probe Sequence
tgcgtgatggacccatatcg

SEQ ID NO: 7199 - DNA, 20 bp, Artificial Sequence
  Description of Artificial Sequence:  Hypothetical Probe Sequence
tgatagcccagcaatcgcaa

SEQ ID NO: 7200 - DNA, 20 bp, Artificial Sequence
  Description of Artificial Sequence:  Hypothetical Probe Sequence
tgcgttagttgagaccgctt

SEQ ID NO: 7201 - DNA, 20 bp, Artificial Sequence
  Description of Artificial Sequence:  Hypothetical Probe Sequence
tgcgttagaaaggacccacg

SEQ ID NO: 7202 - DNA, 20 bp, Artificial Sequence
  Description of Artificial Sequence:  Hypothetical Probe Sequence
tgcgttagcgaatgtcggac

SEQ ID NO: 7203 - DNA, 20 bp, Artificial Sequence
  Description of Artificial Sequence:  Hypothetical Probe Sequence
tgcgttaggctttcccagtg

SEQ ID NO: 7204 - DNA, 20 bp, Artificial Sequence
  Description of Artificial Sequence:  Hypothetical Probe Sequence
ttagtgcgcgaaatactgcg

SEQ ID NO: 7205 - DNA, 20 bp, Artificial Sequence
  Description of Artificial Sequence:  Hypothetical Probe Sequence
tgcgttaggtgcttgagcaa

SEQ ID NO: 7206 - DNA, 20 bp, Artificial Sequence
  Description of Artificial Sequence:  Hypothetical Probe Sequence
tgcgttagacgggatgtgcg

SEQ ID NO: 7207 - DNA, 20 bp, Artificial Sequence
  Description of Artificial Sequence:  Hypothetical Probe Sequence
tgcgttagagccgcttgatg

SEQ ID NO: 7208 - DNA, 20 bp, Artificial Sequence
  Description of Artificial Sequence:  Hypothetical Probe Sequence
tgcgaatcaaagatcgtccc

SEQ ID NO: 7209 - DNA, 20 bp, Artificial Sequence
  Description of Artificial Sequence:  Hypothetical Probe Sequence
tgcgaatctcgttcgtcacg

SEQ ID NO: 7210 - DNA, 20 bp, Artificial Sequence
  Description of Artificial Sequence:  Hypothetical Probe Sequence
tgcgaatcctcagacccgaa

SEQ ID NO: 7211 - DNA, 20 bp, Artificial Sequence
  Description of Artificial Sequence:  Hypothetical Probe Sequence
tgcgaatcccattcccgtct

SEQ ID NO: 7212 - DNA, 20 bp, Artificial Sequence
  Description of Artificial Sequence:  Hypothetical Probe Sequence
tgcgaatcgagtagccgtgc

SEQ ID NO: 7213 - DNA, 20 bp, Artificial Sequence
  Description of Artificial Sequence:  Hypothetical Probe Sequence
tgcgaatcagtgcagctgcg

SEQ ID NO: 7214 - DNA, 20 bp, Artificial Sequence
  Description of Artificial Sequence:  Hypothetical Probe Sequence
tgcgaatccacgcgaactca

SEQ ID NO: 7215 - DNA, 20 bp, Artificial Sequence
  Description of Artificial Sequence:  Hypothetical Probe Sequence
tgcgatacggtatgatagcc

SEQ ID NO: 7216 - DNA, 20 bp, Artificial Sequence
  Description of Artificial Sequence:  Hypothetical Probe Sequence
tgcgatacgcaactgtgcaa

SEQ ID NO: 7217 - DNA, 20 bp, Artificial Sequence
  Description of Artificial Sequence:  Hypothetical Probe Sequence
tgcgataccctagcttgtgc

SEQ ID NO: 7218 - DNA, 20 bp, Artificial Sequence
  Description of Artificial Sequence:  Hypothetical Probe Sequence
tgcgatacgatggctttccc

SEQ ID NO: 7219 - DNA, 20 bp, Artificial Sequence
  Description of Artificial Sequence:  Hypothetical Probe Sequence
tgcgaaagaaagtcccgctt

SEQ ID NO: 7220 - DNA, 20 bp, Artificial Sequence
  Description of Artificial Sequence:  Hypothetical Probe Sequence
tgcgaaagtcgtcttgtgcg

SEQ ID NO: 7221 - DNA, 20 bp, Artificial Sequence
  Description of Artificial Sequence:  Hypothetical Probe Sequence
tgcgaaagcgttggacatcg

SEQ ID NO: 7222 - DNA, 20 bp, Artificial Sequence
  Description of Artificial Sequence:  Hypothetical Probe Sequence
tgcgaaagggtatcgtcacg

SEQ ID NO: 7223 - DNA, 20 bp, Artificial Sequence
  Description of Artificial Sequence:  Hypothetical Probe Sequence
tgcgaaaggagtgatgcacg

SEQ ID NO: 7224 - DNA, 20 bp, Artificial Sequence
  Description of Artificial Sequence:  Hypothetical Probe Sequence
tgcgaaagacctttagacgg

SEQ ID NO: 7225 - DNA, 20 bp, Artificial Sequence
  Description of Artificial Sequence:  Hypothetical Probe Sequence
tgcgaaagtccccgttgagt

SEQ ID NO: 7226 - DNA, 20 bp, Artificial Sequence
  Description of Artificial Sequence:  Hypothetical Probe Sequence
tgcgtacaaaagtgcgcttg

SEQ ID NO: 7227 - DNA, 20 bp, Artificial Sequence
  Description of Artificial Sequence:  Hypothetical Probe Sequence
tgcgtacaacctacggtccc

SEQ ID NO: 7228 - DNA, 20 bp, Artificial Sequence
  Description of Artificial Sequence:  Hypothetical Probe Sequence
tgcgtacagaccacggacgg

SEQ ID NO: 7229 - DNA, 20 bp, Artificial Sequence
  Description of Artificial Sequence:  Hypothetical Probe Sequence
tgcgtctgttgatcccgagt

SEQ ID NO: 7230 - DNA, 20 bp, Artificial Sequence
  Description of Artificial Sequence:  Hypothetical Probe Sequence
tgcgtctgtgatgtgcacgg

SEQ ID NO: 7231 - DNA, 20 bp, Artificial Sequence
  Description of Artificial Sequence:  Hypothetical Probe Sequence
tgcgtctgtgtctgcgatcg

SEQ ID NO: 7232 - DNA, 20 bp, Artificial Sequence
  Description of Artificial Sequence:  Hypothetical Probe Sequence
tgcgtctgtcgtcctacacg

SEQ ID NO: 7233 - DNA, 20 bp, Artificial Sequence
  Description of Artificial Sequence:  Hypothetical Probe Sequence
tgcgtctgcttgaaaggtgc

SEQ ID NO: 7234 - DNA, 20 bp, Artificial Sequence
  Description of Artificial Sequence:  Hypothetical Probe Sequence
tgcgtctgctcaaggatgcg

SEQ ID NO: 7235 - DNA, 20 bp, Artificial Sequence
  Description of Artificial Sequence:  Hypothetical Probe Sequence
tgcgtctggcttcacgatac

SEQ ID NO: 7236 - DNA, 20 bp, Artificial Sequence
  Description of Artificial Sequence:  Hypothetical Probe Sequence
tgcgtctggtctagtgacgg

SEQ ID NO: 7237 - DNA, 20 bp, Artificial Sequence
  Description of Artificial Sequence:  Hypothetical Probe Sequence
tgcgtctggcaaatcgttga

SEQ ID NO: 7238 - DNA, 20 bp, Artificial Sequence
  Description of Artificial Sequence:  Hypothetical Probe Sequence
tgcgtctgagtgtccctgcg

SEQ ID NO: 7239 - DNA, 20 bp, Artificial Sequence
  Description of Artificial Sequence:  Hypothetical Probe Sequence
tgcgtctgatcgaaagcagc

SEQ ID NO: 7240 - DNA, 20 bp, Artificial Sequence
  Description of Artificial Sequence:  Hypothetical Probe Sequence
tgcgtctgcctattgacacg

SEQ ID NO: 7241 - DNA, 20 bp, Artificial Sequence
  Description of Artificial Sequence:  Hypothetical Probe Sequence
tgcgtctgcagcttagcgtt

SEQ ID NO: 7242 - DNA, 20 bp, Artificial Sequence
  Description of Artificial Sequence:  Hypothetical Probe Sequence
tgcgtgtctgattgcgtccc

SEQ ID NO: 7243 - DNA, 20 bp, Artificial Sequence
  Description of Artificial Sequence:  Hypothetical Probe Sequence
tgcgtgtctctgcacggtgc

SEQ ID NO: 7244 - DNA, 20 bp, Artificial Sequence
  Description of Artificial Sequence:  Hypothetical Probe Sequence
tgcgtgtctgtcgtgcggac

SEQ ID NO: 7245 - DNA, 20 bp, Artificial Sequence
  Description of Artificial Sequence:  Hypothetical Probe Sequence
tgcgtgtcgcttatacagcc

SEQ ID NO: 7246 - DNA, 20 bp, Artificial Sequence
  Description of Artificial Sequence:  Hypothetical Probe Sequence
tgcgtgtcgagttcccagcc

SEQ ID NO: 7247 - DNA, 20 bp, Artificial Sequence
  Description of Artificial Sequence:  Hypothetical Probe Sequence
tgcgtgtcacctatcgatcg

SEQ ID NO: 7248 - DNA, 20 bp, Artificial Sequence
  Description of Artificial Sequence:  Hypothetical Probe Sequence
tgcgtgtcaggaggtatccc

SEQ ID NO: 7249 - DNA, 20 bp, Artificial Sequence
  Description of Artificial Sequence:  Hypothetical Probe Sequence
tgcgtgtcgatggaccctgt

SEQ ID NO: 7250 - DNA, 20 bp, Artificial Sequence
  Description of Artificial Sequence:  Hypothetical Probe Sequence
tgcgtgtctccccgaatcgt

SEQ ID NO: 7251 - DNA, 20 bp, Artificial Sequence
  Description of Artificial Sequence:  Hypothetical Probe Sequence
tgcgtgtcgacctcgtcgtt

SEQ ID NO: 7252 - DNA, 20 bp, Artificial Sequence
  Description of Artificial Sequence:  Hypothetical Probe Sequence
tgcgtcgtctcaaccttcgt

SEQ ID NO: 7253 - DNA, 20 bp, Artificial Sequence
  Description of Artificial Sequence:  Hypothetical Probe Sequence
tcgtctgtttaggtcttgcg

SEQ ID NO: 7254 - DNA, 20 bp, Artificial Sequence
  Description of Artificial Sequence:  Hypothetical Probe Sequence
tgcgtcgtgtctagtgagcc

SEQ ID NO: 7255 - DNA, 20 bp, Artificial Sequence
  Description of Artificial Sequence:  Hypothetical Probe Sequence
tgcgtcgtcctatgcgagga

SEQ ID NO: 7256 - DNA, 20 bp, Artificial Sequence
  Description of Artificial Sequence:  Hypothetical Probe Sequence
tgcgtcgtgatgcgttctgt

SEQ ID NO: 7257 - DNA, 20 bp, Artificial Sequence
  Description of Artificial Sequence:  Hypothetical Probe Sequence
tgcgtcgttccccctattag

SEQ ID NO: 7258 - DNA, 20 bp, Artificial Sequence
  Description of Artificial Sequence:  Hypothetical Probe Sequence
tgcgtcgttgcgggactcgt

SEQ ID NO: 7259 - DNA, 20 bp, Artificial Sequence
  Description of Artificial Sequence:  Hypothetical Probe Sequence
tgcgtcgtcacgcacgctgt

SEQ ID NO: 7260 - DNA, 20 bp, Artificial Sequence
  Description of Artificial Sequence:  Hypothetical Probe Sequence
tgcgtcgtgacccctagacc

SEQ ID NO: 7261 - DNA, 20 bp, Artificial Sequence
  Description of Artificial Sequence:  Hypothetical Probe Sequence
tgcgtcgtggactcgtcacg

SEQ ID NO: 7262 - DNA, 20 bp, Artificial Sequence
  Description of Artificial Sequence:  Hypothetical Probe Sequence
tgcgcttgttagagccttga

SEQ ID NO: 7263 - DNA, 20 bp, Artificial Sequence
  Description of Artificial Sequence:  Hypothetical Probe Sequence
tgcgcttgtacaataccagc

SEQ ID NO: 7264 - DNA, 20 bp, Artificial Sequence
  Description of Artificial Sequence:  Hypothetical Probe Sequence
tgcgcttgtctgcgaacgtt

SEQ ID NO: 7265 - DNA, 20 bp, Artificial Sequence
  Description of Artificial Sequence:  Hypothetical Probe Sequence
tgcgcttgcgtttcgttgat

SEQ ID NO: 7266 - DNA, 20 bp, Artificial Sequence
  Description of Artificial Sequence:  Hypothetical Probe Sequence
tgcgcttgctcaataccgaa

SEQ ID NO: 7267 - DNA, 20 bp, Artificial Sequence
  Description of Artificial Sequence:  Hypothetical Probe Sequence
tgcgcttgctgtcgaaccat

SEQ ID NO: 7268 - DNA, 20 bp, Artificial Sequence
  Description of Artificial Sequence:  Hypothetical Probe Sequence
tgcgcttggagtatcgaatc

SEQ ID NO: 7269 - DNA, 20 bp, Artificial Sequence
  Description of Artificial Sequence:  Hypothetical Probe Sequence
tgcgcttgagtgaatccttg

SEQ ID NO: 7270 - DNA, 20 bp, Artificial Sequence
  Description of Artificial Sequence:  Hypothetical Probe Sequence
tgcgcttgatcgatcgagtg

SEQ ID NO: 7271 - DNA, 20 bp, Artificial Sequence
  Description of Artificial Sequence:  Hypothetical Probe Sequence
tgcgcttggatgacgggagt

SEQ ID NO: 7272 - DNA, 20 bp, Artificial Sequence
  Description of Artificial Sequence:  Hypothetical Probe Sequence
tgcgcttgcagccacggagt

SEQ ID NO: 7273 - DNA, 20 bp, Artificial Sequence
  Description of Artificial Sequence:  Hypothetical Probe Sequence
tgcgcttggtgcacctcgtt

SEQ ID NO: 7274 - DNA, 20 bp, Artificial Sequence
  Description of Artificial Sequence:  Hypothetical Probe Sequence
tgcgcttgagccgaccacct

SEQ ID NO: 7275 - DNA, 20 bp, Artificial Sequence
  Description of Artificial Sequence:  Hypothetical Probe Sequence
tgcgcgttaatccctaccat

SEQ ID NO: 7276 - DNA, 20 bp, Artificial Sequence
  Description of Artificial Sequence:  Hypothetical Probe Sequence
tgcgcgttatactctgagcc

SEQ ID NO: 7277 - DNA, 20 bp, Artificial Sequence
  Description of Artificial Sequence:  Hypothetical Probe Sequence
tgcgcgttaaagaatcgcaa

SEQ ID NO: 7278 - DNA, 20 bp, Artificial Sequence
  Description of Artificial Sequence:  Hypothetical Probe Sequence
tgcgcgtttctgcttgatcg

SEQ ID NO: 7279 - DNA, 20 bp, Artificial Sequence
  Description of Artificial Sequence:  Hypothetical Probe Sequence
tgcgcgtttcgtcgaacgaa

SEQ ID NO: 7280 - DNA, 20 bp, Artificial Sequence
  Description of Artificial Sequence:  Hypothetical Probe Sequence
tgcgcgttcgttagtgcttg

SEQ ID NO: 7281 - DNA, 20 bp, Artificial Sequence
  Description of Artificial Sequence:  Hypothetical Probe Sequence
tgcgcgttggtaccatttag

SEQ ID NO: 7282 - DNA, 20 bp, Artificial Sequence
  Description of Artificial Sequence:  Hypothetical Probe Sequence
tgcgcgttgtctggtagacc

SEQ ID NO: 7283 - DNA, 20 bp, Artificial Sequence
  Description of Artificial Sequence:  Hypothetical Probe Sequence
tgcgcgttatcgttgattga

SEQ ID NO: 7284 - DNA, 20 bp, Artificial Sequence
  Description of Artificial Sequence:  Hypothetical Probe Sequence
tgcgcgttgatgtcccttga

SEQ ID NO: 7285 - DNA, 20 bp, Artificial Sequence
  Description of Artificial Sequence:  Hypothetical Probe Sequence
tgcgcgtttcccgcttacct

SEQ ID NO: 7286 - DNA, 20 bp, Artificial Sequence
  Description of Artificial Sequence:  Hypothetical Probe Sequence
tgcgcgttcacggagtcacg

SEQ ID NO: 7287 - DNA, 20 bp, Artificial Sequence
  Description of Artificial Sequence:  Hypothetical Probe Sequence
tgcgcgttcagcttagagcc

SEQ ID NO: 7288 - DNA, 20 bp, Artificial Sequence
  Description of Artificial Sequence:  Hypothetical Probe Sequence
tgcgcgttgacctcccatac

SEQ ID NO: 7289 - DNA, 20 bp, Artificial Sequence
  Description of Artificial Sequence:  Hypothetical Probe Sequence
tgcgcgttacggggtagatg

SEQ ID NO: 7290 - DNA, 20 bp, Artificial Sequence
  Description of Artificial Sequence:  Hypothetical Probe Sequence
tgcgctcatgataatcagcc

SEQ ID NO: 7291 - DNA, 20 bp, Artificial Sequence
  Description of Artificial Sequence:  Hypothetical Probe Sequence
tgcgctcattagcacgcacg

SEQ ID NO: 7292 - DNA, 20 bp, Artificial Sequence
  Description of Artificial Sequence:  Hypothetical Probe Sequence
tgcgctcaaaagctcaatcg

SEQ ID NO: 7293 - DNA, 20 bp, Artificial Sequence
  Description of Artificial Sequence:  Hypothetical Probe Sequence
tgcgctcatacatgcgggta

SEQ ID NO: 7294 - DNA, 20 bp, Artificial Sequence
  Description of Artificial Sequence:  Hypothetical Probe Sequence
tgcgctcatctgatcgtgtc

SEQ ID NO: 7295 - DNA, 20 bp, Artificial Sequence
  Description of Artificial Sequence:  Hypothetical Probe Sequence
tgcgctcacgttatcgcttg

SEQ ID NO: 7296 - DNA, 20 bp, Artificial Sequence
  Description of Artificial Sequence:  Hypothetical Probe Sequence
tgcgctcactgttcccgtct

SEQ ID NO: 7297 - DNA, 20 bp, Artificial Sequence
  Description of Artificial Sequence:  Hypothetical Probe Sequence
tgcgctcagcaaagtgctca

SEQ ID NO: 7298 - DNA, 20 bp, Artificial Sequence
  Description of Artificial Sequence:  Hypothetical Probe Sequence
tgcgctcacctacgaaaaag

SEQ ID NO: 7299 - DNA, 20 bp, Artificial Sequence
  Description of Artificial Sequence:  Hypothetical Probe Sequence
tgcgctcagatggtgcgagt

SEQ ID NO: 7300 - DNA, 20 bp, Artificial Sequence
  Description of Artificial Sequence:  Hypothetical Probe Sequence
tgcgctgttgataaagtgcg

SEQ ID NO: 7301 - DNA, 20 bp, Artificial Sequence
  Description of Artificial Sequence:  Hypothetical Probe Sequence
tgcgctgtaatcgcttgtct

SEQ ID NO: 7302 - DNA, 20 bp, Artificial Sequence
  Description of Artificial Sequence:  Hypothetical Probe Sequence
tgcgctgtatacgaccacgg

SEQ ID NO: 7303 - DNA, 20 bp, Artificial Sequence
  Description of Artificial Sequence:  Hypothetical Probe Sequence
tgcgctgttacacctaacgg

SEQ ID NO: 7304 - DNA, 20 bp, Artificial Sequence
  Description of Artificial Sequence:  Hypothetical Probe Sequence
tgcgctgttctgtgatagcc

SEQ ID NO: 7305 - DNA, 20 bp, Artificial Sequence
  Description of Artificial Sequence:  Hypothetical Probe Sequence
tgcgctgttgtcaatcgcaa

SEQ ID NO: 7306 - DNA, 20 bp, Artificial Sequence
  Description of Artificial Sequence:  Hypothetical Probe Sequence
tgcgctgtcttggaccagtg

SEQ ID NO: 7307 - DNA, 20 bp, Artificial Sequence
  Description of Artificial Sequence:  Hypothetical Probe Sequence
tgcgctgtctcaccattctg

SEQ ID NO: 7308 - DNA, 20 bp, Artificial Sequence
  Description of Artificial Sequence:  Hypothetical Probe Sequence
tgcgctgtctgttctgcgaa

SEQ ID NO: 7309 - DNA, 20 bp, Artificial Sequence
  Description of Artificial Sequence:  Hypothetical Probe Sequence
tgcgctgtccatcctaaaag

SEQ ID NO: 7310 - DNA, 20 bp, Artificial Sequence
  Description of Artificial Sequence:  Hypothetical Probe Sequence
tgcgctgtcgaaaatcccat

SEQ ID NO: 7311 - DNA, 20 bp, Artificial Sequence
  Description of Artificial Sequence:  Hypothetical Probe Sequence
tgcgctgtggtagagttccc

SEQ ID NO: 7312 - DNA, 20 bp, Artificial Sequence
  Description of Artificial Sequence:  Hypothetical Probe Sequence
tgcgctgtagtgggaccgtt

SEQ ID NO: 7313 - DNA, 20 bp, Artificial Sequence
  Description of Artificial Sequence:  Hypothetical Probe Sequence
tgcgctgtcagcttagctca

SEQ ID NO: 7314 - DNA, 20 bp, Artificial Sequence
  Description of Artificial Sequence:  Hypothetical Probe Sequence
tgcgctgtgaccggacccat

SEQ ID NO: 7315 - DNA, 20 bp, Artificial Sequence
  Description of Artificial Sequence:  Hypothetical Probe Sequence
tgcgctgtacgggtgctctg

SEQ ID NO: 7316 - DNA, 20 bp, Artificial Sequence
  Description of Artificial Sequence:  Hypothetical Probe Sequence
tgcgctgtagccgagtcttg

SEQ ID NO: 7317 - DNA, 20 bp, Artificial Sequence
  Description of Artificial Sequence:  Hypothetical Probe Sequence
tgcgccatttgaacctatcg

SEQ ID NO: 7318 - DNA, 20 bp, Artificial Sequence
  Description of Artificial Sequence:  Hypothetical Probe Sequence
tgcgccatttaggagtcgtt

SEQ ID NO: 7319 - DNA, 20 bp, Artificial Sequence
  Description of Artificial Sequence:  Hypothetical Probe Sequence
tgcgccataatctctgtgcg

SEQ ID NO: 7320 - DNA, 20 bp, Artificial Sequence
  Description of Artificial Sequence:  Hypothetical Probe Sequence
tgcgccatcgaagtctttga

SEQ ID NO: 7321 - DNA, 20 bp, Artificial Sequence
  Description of Artificial Sequence:  Hypothetical Probe Sequence
tgcgccatgtctgatggacc

SEQ ID NO: 7322 - DNA, 20 bp, Artificial Sequence
  Description of Artificial Sequence:  Hypothetical Probe Sequence
tgcgccatatcggtctcagc

SEQ ID NO: 7323 - DNA, 20 bp, Artificial Sequence
  Description of Artificial Sequence:  Hypothetical Probe Sequence
tgcgccattccctcgttaca

SEQ ID NO: 7324 - DNA, 20 bp, Artificial Sequence
  Description of Artificial Sequence:  Hypothetical Probe Sequence
tgcgccatgacctgatcttg

SEQ ID NO: 7325 - DNA, 20 bp, Artificial Sequence
  Description of Artificial Sequence:  Hypothetical Probe Sequence
tgcgccatggacccatcgaa

SEQ ID NO: 7326 - DNA, 20 bp, Artificial Sequence
  Description of Artificial Sequence:  Hypothetical Probe Sequence
tgcgccatacggctgtctca

SEQ ID NO: 7327 - DNA, 20 bp, Artificial Sequence
  Description of Artificial Sequence:  Hypothetical Probe Sequence
tgcgcgaatgatcgttcttg

SEQ ID NO: 7328 - DNA, 20 bp, Artificial Sequence
  Description of Artificial Sequence:  Hypothetical Probe Sequence
tgcgcgaaaatcaaagcagc

SEQ ID NO: 7329 - DNA, 20 bp, Artificial Sequence
  Description of Artificial Sequence:  Hypothetical Probe Sequence
tgcgcgaactcagaccagga

SEQ ID NO: 7330 - DNA, 20 bp, Artificial Sequence
  Description of Artificial Sequence:  Hypothetical Probe Sequence
tgcgcgaaccatctgttgtc

SEQ ID NO: 7331 - DNA, 20 bp, Artificial Sequence
  Description of Artificial Sequence:  Hypothetical Probe Sequence
tgcgcgaacgaaagccaaag

SEQ ID NO: 7332 - DNA, 20 bp, Artificial Sequence
  Description of Artificial Sequence:  Hypothetical Probe Sequence
tgcgcgaagcaactcaccat

SEQ ID NO: 7333 - DNA, 20 bp, Artificial Sequence
  Description of Artificial Sequence:  Hypothetical Probe Sequence
tgcgcgaaatcgtgatccat

SEQ ID NO: 7334 - DNA, 20 bp, Artificial Sequence
  Description of Artificial Sequence:  Hypothetical Probe Sequence
tgcgcgaaaggagatggtgc

SEQ ID NO: 7335 - DNA, 20 bp, Artificial Sequence
  Description of Artificial Sequence:  Hypothetical Probe Sequence
tgcgcgaatccccctacagc

SEQ ID NO: 7336 - DNA, 20 bp, Artificial Sequence
  Description of Artificial Sequence:  Hypothetical Probe Sequence
tgcggcttatacaatcgctt

SEQ ID NO: 7337 - DNA, 20 bp, Artificial Sequence
  Description of Artificial Sequence:  Hypothetical Probe Sequence
tgcggctttctgcagctcgt

SEQ ID NO: 7338 - DNA, 20 bp, Artificial Sequence
  Description of Artificial Sequence:  Hypothetical Probe Sequence
tgcggcttcttgctgtgacc

SEQ ID NO: 7339 - DNA, 20 bp, Artificial Sequence
  Description of Artificial Sequence:  Hypothetical Probe Sequence
tgcggcttctcaagtgagtg

SEQ ID NO: 7340 - DNA, 20 bp, Artificial Sequence
  Description of Artificial Sequence:  Hypothetical Probe Sequence
tgcggcttcgaattgatctg

SEQ ID NO: 7341 - DNA, 20 bp, Artificial Sequence
  Description of Artificial Sequence:  Hypothetical Probe Sequence
tgcggcttgcaatctgaaag

SEQ ID NO: 7342 - DNA, 20 bp, Artificial Sequence
  Description of Artificial Sequence:  Hypothetical Probe Sequence
tgcggctttccccagcccta

SEQ ID NO: 7343 - DNA, 20 bp, Artificial Sequence
  Description of Artificial Sequence:  Hypothetical Probe Sequence
tgcggcttcacgggaccgaa

SEQ ID NO: 7344 - DNA, 20 bp, Artificial Sequence
  Description of Artificial Sequence:  Hypothetical Probe Sequence
tgcggcttagccgacccgaa

SEQ ID NO: 7345 - DNA, 20 bp, Artificial Sequence
  Description of Artificial Sequence:  Hypothetical Probe Sequence
tgcgggtaaaagaggaggac

SEQ ID NO: 7346 - DNA, 20 bp, Artificial Sequence
  Description of Artificial Sequence:  Hypothetical Probe Sequence
tgcgggtatacaccatacgg

SEQ ID NO: 7347 - DNA, 20 bp, Artificial Sequence
  Description of Artificial Sequence:  Hypothetical Probe Sequence
tgcgggtatgtccacgaaag

SEQ ID NO: 7348 - DNA, 20 bp, Artificial Sequence
  Description of Artificial Sequence:  Hypothetical Probe Sequence
tgcgggtacgttcagccttg

SEQ ID NO: 7349 - DNA, 20 bp, Artificial Sequence
  Description of Artificial Sequence:  Hypothetical Probe Sequence
tgcgggtactcagcaacgtt

SEQ ID NO: 7350 - DNA, 20 bp, Artificial Sequence
  Description of Artificial Sequence:  Hypothetical Probe Sequence
tgcgggtactgtgcaacttg

SEQ ID NO: 7351 - DNA, 20 bp, Artificial Sequence
  Description of Artificial Sequence:  Hypothetical Probe Sequence
tgcgggtagcttagccgagt

SEQ ID NO: 7352 - DNA, 20 bp, Artificial Sequence
  Description of Artificial Sequence:  Hypothetical Probe Sequence
tgcgggtagagtggaccttg

SEQ ID NO: 7353 - DNA, 20 bp, Artificial Sequence
  Description of Artificial Sequence:  Hypothetical Probe Sequence
tgcgggtacctagacccagc

SEQ ID NO: 7354 - DNA, 20 bp, Artificial Sequence
  Description of Artificial Sequence:  Hypothetical Probe Sequence
tgcgggtacacgtgtcacgg

SEQ ID NO: 7355 - DNA, 20 bp, Artificial Sequence
  Description of Artificial Sequence:  Hypothetical Probe Sequence
tgcgggtagtgctgtctgtc

SEQ ID NO: 7356 - DNA, 20 bp, Artificial Sequence
  Description of Artificial Sequence:  Hypothetical Probe Sequence
tgcgggtaggaccctagagt

SEQ ID NO: 7357 - DNA, 20 bp, Artificial Sequence
  Description of Artificial Sequence:  Hypothetical Probe Sequence
tgcgggtaagccgtctgcaa

SEQ ID NO: 7358 - DNA, 20 bp, Artificial Sequence
  Description of Artificial Sequence:  Hypothetical Probe Sequence
tgcggtcttgatcgaatcgt

SEQ ID NO: 7359 - DNA, 20 bp, Artificial Sequence
  Description of Artificial Sequence:  Hypothetical Probe Sequence
tgcggtctttagctgttcgt

SEQ ID NO: 7360 - DNA, 20 bp, Artificial Sequence
  Description of Artificial Sequence:  Hypothetical Probe Sequence
tgcggtctaaaggatgcagc

SEQ ID NO: 7361 - DNA, 20 bp, Artificial Sequence
  Description of Artificial Sequence:  Hypothetical Probe Sequence
tgcggtcttctgtcccttag

SEQ ID NO: 7362 - DNA, 20 bp, Artificial Sequence
  Description of Artificial Sequence:  Hypothetical Probe Sequence
tgcggtcttgtccagccgtt

SEQ ID NO: 7363 - DNA, 20 bp, Artificial Sequence
  Description of Artificial Sequence:  Hypothetical Probe Sequence
tgcggtctcttgggtatccc

SEQ ID NO: 7364 - DNA, 20 bp, Artificial Sequence
  Description of Artificial Sequence:  Hypothetical Probe Sequence
tgcggtctctgtttgaatcg

SEQ ID NO: 7365 - DNA, 20 bp, Artificial Sequence
  Description of Artificial Sequence:  Hypothetical Probe Sequence
tgcggtctcgaaaggagcaa

SEQ ID NO: 7366 - DNA, 20 bp, Artificial Sequence
  Description of Artificial Sequence:  Hypothetical Probe Sequence
tgcggtctggtatcccgacc

SEQ ID NO: 7367 - DNA, 20 bp, Artificial Sequence
  Description of Artificial Sequence:  Hypothetical Probe Sequence
tgcggtctgagtagtgtgcg

SEQ ID NO: 7368 - DNA, 20 bp, Artificial Sequence
  Description of Artificial Sequence:  Hypothetical Probe Sequence
tgcggtctacctgcaaaaag

SEQ ID NO: 7369 - DNA, 20 bp, Artificial Sequence
  Description of Artificial Sequence:  Hypothetical Probe Sequence
tgcggtctatcggaccgatg

SEQ ID NO: 7370 - DNA, 20 bp, Artificial Sequence
  Description of Artificial Sequence:  Hypothetical Probe Sequence
tgcggtctaggaaaaggacc

SEQ ID NO: 7371 - DNA, 20 bp, Artificial Sequence
  Description of Artificial Sequence:  Hypothetical Probe Sequence
tgcggtctgatgaaagcttg

SEQ ID NO: 7372 - DNA, 20 bp, Artificial Sequence
  Description of Artificial Sequence:  Hypothetical Probe Sequence
tgcggtctcagccgaacttg

SEQ ID NO: 7373 - DNA, 20 bp, Artificial Sequence
  Description of Artificial Sequence:  Hypothetical Probe Sequence
tgcggagttgatagccttag

SEQ ID NO: 7374 - DNA, 20 bp, Artificial Sequence
  Description of Artificial Sequence:  Hypothetical Probe Sequence
tgcggagtatacgtgcggta

SEQ ID NO: 7375 - DNA, 20 bp, Artificial Sequence
  Description of Artificial Sequence:  Hypothetical Probe Sequence
tgcggagttctgatacgcaa

SEQ ID NO: 7376 - DNA, 20 bp, Artificial Sequence
  Description of Artificial Sequence:  Hypothetical Probe Sequence
tgcggagttcgttctggacc

SEQ ID NO: 7377 - DNA, 20 bp, Artificial Sequence
  Description of Artificial Sequence:  Hypothetical Probe Sequence
tgcggagtgcaagacccgaa

SEQ ID NO: 7378 - DNA, 20 bp, Artificial Sequence
  Description of Artificial Sequence:  Hypothetical Probe Sequence
tgcggagttccctgtcgatg

SEQ ID NO: 7379 - DNA, 20 bp, Artificial Sequence
  Description of Artificial Sequence:  Hypothetical Probe Sequence
tgcggagtgtgcgtgcacct

SEQ ID NO: 7380 - DNA, 20 bp, Artificial Sequence
  Description of Artificial Sequence:  Hypothetical Probe Sequence
tgcggagtggaccgttgagt

SEQ ID NO: 7381 - DNA, 20 bp, Artificial Sequence
  Description of Artificial Sequence:  Hypothetical Probe Sequence
tgcggcaattgagatgcgtt

SEQ ID NO: 7382 - DNA, 20 bp, Artificial Sequence
  Description of Artificial Sequence:  Hypothetical Probe Sequence
tgcggcaattagcgttacct

SEQ ID NO: 7383 - DNA, 20 bp, Artificial Sequence
  Description of Artificial Sequence:  Hypothetical Probe Sequence
tgcggcaaaatcttagcagc

SEQ ID NO: 7384 - DNA, 20 bp, Artificial Sequence
  Description of Artificial Sequence:  Hypothetical Probe Sequence
tgcggcaaaaagttagggac

SEQ ID NO: 7385 - DNA, 20 bp, Artificial Sequence
  Description of Artificial Sequence:  Hypothetical Probe Sequence
tgcggcaatctgataccttg

SEQ ID NO: 7386 - DNA, 20 bp, Artificial Sequence
  Description of Artificial Sequence:  Hypothetical Probe Sequence
tgcggcaacgaatgattccc

SEQ ID NO: 7387 - DNA, 20 bp, Artificial Sequence
  Description of Artificial Sequence:  Hypothetical Probe Sequence
tgcggcaagcttaaaggagt

SEQ ID NO: 7388 - DNA, 20 bp, Artificial Sequence
  Description of Artificial Sequence:  Hypothetical Probe Sequence
tgcggcaagtctgacccacg

SEQ ID NO: 7389 - DNA, 20 bp, Artificial Sequence
  Description of Artificial Sequence:  Hypothetical Probe Sequence
tgcggcaagagtatcgatcg

SEQ ID NO: 7390 - DNA, 20 bp, Artificial Sequence
  Description of Artificial Sequence:  Hypothetical Probe Sequence
tgcggcaagatgaggaaaag

SEQ ID NO: 7391 - DNA, 20 bp, Artificial Sequence
  Description of Artificial Sequence:  Hypothetical Probe Sequence
tgcggcaatcccgcttatac

SEQ ID NO: 7392 - DNA, 20 bp, Artificial Sequence
  Description of Artificial Sequence:  Hypothetical Probe Sequence
tgcggcaacagcaaagacct

SEQ ID NO: 7393 - DNA, 20 bp, Artificial Sequence
  Description of Artificial Sequence:  Hypothetical Probe Sequence
tgcggcaagacccctaacct

SEQ ID NO: 7394 - DNA, 20 bp, Artificial Sequence
  Description of Artificial Sequence:  Hypothetical Probe Sequence
tgcggcaagtgcaaagcgaa

SEQ ID NO: 7395 - DNA, 20 bp, Artificial Sequence
  Description of Artificial Sequence:  Hypothetical Probe Sequence
tgcgagtgtctgagcccagc

SEQ ID NO: 7396 - DNA, 20 bp, Artificial Sequence
  Description of Artificial Sequence:  Hypothetical Probe Sequence
tgcgagtgtcgttgcgagga

SEQ ID NO: 7397 - DNA, 20 bp, Artificial Sequence
  Description of Artificial Sequence:  Hypothetical Probe Sequence
tgcgagtgcttgcagcatac

SEQ ID NO: 7398 - DNA, 20 bp, Artificial Sequence
  Description of Artificial Sequence:  Hypothetical Probe Sequence
tgcgagtggcttccattgat

SEQ ID NO: 7399 - DNA, 20 bp, Artificial Sequence
  Description of Artificial Sequence:  Hypothetical Probe Sequence
tgcgagtgggtacttgtccc

SEQ ID NO: 7400 - DNA, 20 bp, Artificial Sequence
  Description of Artificial Sequence:  Hypothetical Probe Sequence
tgcgagtgacctcgaatccc

SEQ ID NO: 7401 - DNA, 20 bp, Artificial Sequence
  Description of Artificial Sequence:  Hypothetical Probe Sequence
tgcgagtgaggagatgcgtt

SEQ ID NO: 7402 - DNA, 20 bp, Artificial Sequence
  Description of Artificial Sequence:  Hypothetical Probe Sequence
tgcgagtgtgcggtgccttg

SEQ ID NO: 7403 - DNA, 20 bp, Artificial Sequence
  Description of Artificial Sequence:  Hypothetical Probe Sequence
tgcgagtgcagcacctagtg

SEQ ID NO: 7404 - DNA, 20 bp, Artificial Sequence
  Description of Artificial Sequence:  Hypothetical Probe Sequence
tgcgaccttgatcagcgtgc

SEQ ID NO: 7405 - DNA, 20 bp, Artificial Sequence
  Description of Artificial Sequence:  Hypothetical Probe Sequence
tgcgacctaaaggtgctgcg

SEQ ID NO: 7406 - DNA, 20 bp, Artificial Sequence
  Description of Artificial Sequence:  Hypothetical Probe Sequence
tgcgaccttacaggacagga

SEQ ID NO: 7407 - DNA, 20 bp, Artificial Sequence
  Description of Artificial Sequence:  Hypothetical Probe Sequence
tgcgaccttcgtgtctgacc

SEQ ID NO: 7408 - DNA, 20 bp, Artificial Sequence
  Description of Artificial Sequence:  Hypothetical Probe Sequence
tgcgacctcttgcgtttccc

SEQ ID NO: 7409 - DNA, 20 bp, Artificial Sequence
  Description of Artificial Sequence:  Hypothetical Probe Sequence
tgcgacctctcattaggacc

SEQ ID NO: 7410 - DNA, 20 bp, Artificial Sequence
  Description of Artificial Sequence:  Hypothetical Probe Sequence
tgcgacctctgtcagcccat

SEQ ID NO: 7411 - DNA, 20 bp, Artificial Sequence
  Description of Artificial Sequence:  Hypothetical Probe Sequence
tgcgacctccatgcaacttg

SEQ ID NO: 7412 - DNA, 20 bp, Artificial Sequence
  Description of Artificial Sequence:  Hypothetical Probe Sequence
tgcgacctcgaagcttaaag

SEQ ID NO: 7413 - DNA, 20 bp, Artificial Sequence
  Description of Artificial Sequence:  Hypothetical Probe Sequence
tgcgacctggtaaaagcttg

SEQ ID NO: 7414 - DNA, 20 bp, Artificial Sequence
  Description of Artificial Sequence:  Hypothetical Probe Sequence
tgcgacctagtgaccttgcg

SEQ ID NO: 7415 - DNA, 20 bp, Artificial Sequence
  Description of Artificial Sequence:  Hypothetical Probe Sequence
tgcgacctacctcctaacgg

SEQ ID NO: 7416 - DNA, 20 bp, Artificial Sequence
  Description of Artificial Sequence:  Hypothetical Probe Sequence
tgcgacctatcgcagcatac

SEQ ID NO: 7417 - DNA, 20 bp, Artificial Sequence
  Description of Artificial Sequence:  Hypothetical Probe Sequence
tgcgaccttccccgaacacg

SEQ ID NO: 7418 - DNA, 20 bp, Artificial Sequence
  Description of Artificial Sequence:  Hypothetical Probe Sequence
tgcgaccttgcggtgcagga

SEQ ID NO: 7419 - DNA, 20 bp, Artificial Sequence
  Description of Artificial Sequence:  Hypothetical Probe Sequence
tgcgacctcacgttgacacg

SEQ ID NO: 7420 - DNA, 20 bp, Artificial Sequence
  Description of Artificial Sequence:  Hypothetical Probe Sequence
tgcgacctggaccgttcgaa

SEQ ID NO: 7421 - DNA, 20 bp, Artificial Sequence
  Description of Artificial Sequence:  Hypothetical Probe Sequence
tgcgatcgttgatccccagc

SEQ ID NO: 7422 - DNA, 20 bp, Artificial Sequence
  Description of Artificial Sequence:  Hypothetical Probe Sequence
tgcgatcgtgataatcgatg

SEQ ID NO: 7423 - DNA, 20 bp, Artificial Sequence
  Description of Artificial Sequence:  Hypothetical Probe Sequence
tgcgatcgtgtcgcttcacg

SEQ ID NO: 7424 - DNA, 20 bp, Artificial Sequence
  Description of Artificial Sequence:  Hypothetical Probe Sequence
tgcgatcgcttgtcgtggac

SEQ ID NO: 7425 - DNA, 20 bp, Artificial Sequence
  Description of Artificial Sequence:  Hypothetical Probe Sequence
tgcgatcgccatggtacacg

SEQ ID NO: 7426 - DNA, 20 bp, Artificial Sequence
  Description of Artificial Sequence:  Hypothetical Probe Sequence
tgcgatcgggtaaatccttg

SEQ ID NO: 7427 - DNA, 20 bp, Artificial Sequence
  Description of Artificial Sequence:  Hypothetical Probe Sequence
tgcgatcgagtggcaaccat

SEQ ID NO: 7428 - DNA, 20 bp, Artificial Sequence
  Description of Artificial Sequence:  Hypothetical Probe Sequence
tgcgatcgatcgtgtccttg

SEQ ID NO: 7429 - DNA, 20 bp, Artificial Sequence
  Description of Artificial Sequence:  Hypothetical Probe Sequence
tgcgatcgcctacctacgaa

SEQ ID NO: 7430 - DNA, 20 bp, Artificial Sequence
  Description of Artificial Sequence:  Hypothetical Probe Sequence
tgcgatcgtcccgtctccat

SEQ ID NO: 7431 - DNA, 20 bp, Artificial Sequence
  Description of Artificial Sequence:  Hypothetical Probe Sequence
tgcgatcgcagcaaagtgtc

SEQ ID NO: 7432 - DNA, 20 bp, Artificial Sequence
  Description of Artificial Sequence:  Hypothetical Probe Sequence
tgcgatcgacggacctgcaa

SEQ ID NO: 7433 - DNA, 20 bp, Artificial Sequence
  Description of Artificial Sequence:  Hypothetical Probe Sequence
tgcgatcgagccatacagcc

SEQ ID NO: 7434 - DNA, 20 bp, Artificial Sequence
  Description of Artificial Sequence:  Hypothetical Probe Sequence
tgcgaggattagcacgatcg

SEQ ID NO: 7435 - DNA, 20 bp, Artificial Sequence
  Description of Artificial Sequence:  Hypothetical Probe Sequence
tgcgaggatgtctccctccc

SEQ ID NO: 7436 - DNA, 20 bp, Artificial Sequence
  Description of Artificial Sequence:  Hypothetical Probe Sequence
tgcgaggacttgcacgtaca

SEQ ID NO: 7437 - DNA, 20 bp, Artificial Sequence
  Description of Artificial Sequence:  Hypothetical Probe Sequence
tgcgaggactgtagccccat

SEQ ID NO: 7438 - DNA, 20 bp, Artificial Sequence
  Description of Artificial Sequence:  Hypothetical Probe Sequence
tgcgaggagcaaaaaggacc

SEQ ID NO: 7439 - DNA, 20 bp, Artificial Sequence
  Description of Artificial Sequence:  Hypothetical Probe Sequence
tgcgaggaagtgagtgggac

SEQ ID NO: 7440 - DNA, 20 bp, Artificial Sequence
  Description of Artificial Sequence:  Hypothetical Probe Sequence
tgcgaggaaggatgcgttag

SEQ ID NO: 7441 - DNA, 20 bp, Artificial Sequence
  Description of Artificial Sequence:  Hypothetical Probe Sequence
tgcgaggacagccgttcagc

SEQ ID NO: 7442 - DNA, 20 bp, Artificial Sequence
  Description of Artificial Sequence:  Hypothetical Probe Sequence
tgcgaggaacgggagtcacg

SEQ ID NO: 7443 - DNA, 20 bp, Artificial Sequence
  Description of Artificial Sequence:  Hypothetical Probe Sequence
tgcgcctattgacgaatgtc

SEQ ID NO: 7444 - DNA, 20 bp, Artificial Sequence
  Description of Artificial Sequence:  Hypothetical Probe Sequence
tgcgcctatacaagccggac

SEQ ID NO: 7445 - DNA, 20 bp, Artificial Sequence
  Description of Artificial Sequence:  Hypothetical Probe Sequence
tgcgcctatgtcaggaagcc

SEQ ID NO: 7446 - DNA, 20 bp, Artificial Sequence
  Description of Artificial Sequence:  Hypothetical Probe Sequence
tgcgcctacttgtgcgttga

SEQ ID NO: 7447 - DNA, 20 bp, Artificial Sequence
  Description of Artificial Sequence:  Hypothetical Probe Sequence
tgcgcctacgaaataccagc

SEQ ID NO: 7448 - DNA, 20 bp, Artificial Sequence
  Description of Artificial Sequence:  Hypothetical Probe Sequence
tgcgcctaggtaaatccgtt

SEQ ID NO: 7449 - DNA, 20 bp, Artificial Sequence
  Description of Artificial Sequence:  Hypothetical Probe Sequence
tgcgcctagtctcacgcagc

SEQ ID NO: 7450 - DNA, 20 bp, Artificial Sequence
  Description of Artificial Sequence:  Hypothetical Probe Sequence
tgcgcctatcccgcaatgtc

SEQ ID NO: 7451 - DNA, 20 bp, Artificial Sequence
  Description of Artificial Sequence:  Hypothetical Probe Sequence
tgcgcctatgcgagtgccta

SEQ ID NO: 7452 - DNA, 20 bp, Artificial Sequence
  Description of Artificial Sequence:  Hypothetical Probe Sequence
tgcgcctacacggatgaaag

SEQ ID NO: 7453 - DNA, 20 bp, Artificial Sequence
  Description of Artificial Sequence:  Hypothetical Probe Sequence
tgcgcctaggacaccttgcg

SEQ ID NO: 7454 - DNA, 20 bp, Artificial Sequence
  Description of Artificial Sequence:  Hypothetical Probe Sequence
tgcgcctaacggcctaacct

SEQ ID NO: 7455 - DNA, 20 bp, Artificial Sequence
  Description of Artificial Sequence:  Hypothetical Probe Sequence
tgcgcctaagccctcaagga

SEQ ID NO: 7456 - DNA, 20 bp, Artificial Sequence
  Description of Artificial Sequence:  Hypothetical Probe Sequence
tgcggatgttgagtgcgctt

SEQ ID NO: 7457 - DNA, 20 bp, Artificial Sequence
  Description of Artificial Sequence:  Hypothetical Probe Sequence
tgcggatgtgatgcttccat

SEQ ID NO: 7458 - DNA, 20 bp, Artificial Sequence
  Description of Artificial Sequence:  Hypothetical Probe Sequence
tgcggatgtgtccgttaaag

SEQ ID NO: 7459 - DNA, 20 bp, Artificial Sequence
  Description of Artificial Sequence:  Hypothetical Probe Sequence
tgcggatgcgttgatgcagc

SEQ ID NO: 7460 - DNA, 20 bp, Artificial Sequence
  Description of Artificial Sequence:  Hypothetical Probe Sequence
tgcggatgctcaatacgtct

SEQ ID NO: 7461 - DNA, 20 bp, Artificial Sequence
  Description of Artificial Sequence:  Hypothetical Probe Sequence
tgcggatgctgtgatggcaa

SEQ ID NO: 7462 - DNA, 20 bp, Artificial Sequence
  Description of Artificial Sequence:  Hypothetical Probe Sequence
tgcggatggcaaagtgagga

SEQ ID NO: 7463 - DNA, 20 bp, Artificial Sequence
  Description of Artificial Sequence:  Hypothetical Probe Sequence
tgcggatgcctatcgtcgtt

SEQ ID NO: 7464 - DNA, 20 bp, Artificial Sequence
  Description of Artificial Sequence:  Hypothetical Probe Sequence
tgcggatgcacgcgttggac

SEQ ID NO: 7465 - DNA, 20 bp, Artificial Sequence
  Description of Artificial Sequence:  Hypothetical Probe Sequence
tgcggatggtgccgaacttg

SEQ ID NO: 7466 - DNA, 20 bp, Artificial Sequence
  Description of Artificial Sequence:  Hypothetical Probe Sequence
tgcggatgggacttgacagc

SEQ ID NO: 7467 - DNA, 20 bp, Artificial Sequence
  Description of Artificial Sequence:  Hypothetical Probe Sequence
tgcggatgacggtgtcaatc

SEQ ID NO: 7468 - DNA, 20 bp, Artificial Sequence
  Description of Artificial Sequence:  Hypothetical Probe Sequence
tgcgtcccaatctctgacct

SEQ ID NO: 7469 - DNA, 20 bp, Artificial Sequence
  Description of Artificial Sequence:  Hypothetical Probe Sequence
tgcgtcccaaagcttggcaa

SEQ ID NO: 7470 - DNA, 20 bp, Artificial Sequence
  Description of Artificial Sequence:  Hypothetical Probe Sequence
tgcgtccctcgtaaaggtct

SEQ ID NO: 7471 - DNA, 20 bp, Artificial Sequence
  Description of Artificial Sequence:  Hypothetical Probe Sequence
tgcgtccccttgcttgaatc

SEQ ID NO: 7472 - DNA, 20 bp, Artificial Sequence
  Description of Artificial Sequence:  Hypothetical Probe Sequence
tgcgtccccgttgatggctt

SEQ ID NO: 7473 - DNA, 20 bp, Artificial Sequence
  Description of Artificial Sequence:  Hypothetical Probe Sequence
tgcgtcccccataatcaatc

SEQ ID NO: 7474 - DNA, 20 bp, Artificial Sequence
  Description of Artificial Sequence:  Hypothetical Probe Sequence
tgcgtccccgaaccatacct

SEQ ID NO: 7475 - DNA, 20 bp, Artificial Sequence
  Description of Artificial Sequence:  Hypothetical Probe Sequence
tgcgtcccggtaatacagga

SEQ ID NO: 7476 - DNA, 20 bp, Artificial Sequence
  Description of Artificial Sequence:  Hypothetical Probe Sequence
tgcgtcccgtctgagttgtc

SEQ ID NO: 7477 - DNA, 20 bp, Artificial Sequence
  Description of Artificial Sequence:  Hypothetical Probe Sequence
tgcgtcccacctatcgctgt

SEQ ID NO: 7478 - DNA, 20 bp, Artificial Sequence
  Description of Artificial Sequence:  Hypothetical Probe Sequence
tgcgtccctccctcccagtg

SEQ ID NO: 7479 - DNA, 20 bp, Artificial Sequence
  Description of Artificial Sequence:  Hypothetical Probe Sequence
tgcgtcccggacctcaagtg

SEQ ID NO: 7480 - DNA, 20 bp, Artificial Sequence
  Description of Artificial Sequence:  Hypothetical Probe Sequence
tgcgtcccacggaggaaatc

SEQ ID NO: 7481 - DNA, 20 bp, Artificial Sequence
  Description of Artificial Sequence:  Hypothetical Probe Sequence
tgcgtgcgataccttgccta

SEQ ID NO: 7482 - DNA, 20 bp, Artificial Sequence
  Description of Artificial Sequence:  Hypothetical Probe Sequence
tgcgtgcgtctgatacggac

SEQ ID NO: 7483 - DNA, 20 bp, Artificial Sequence
  Description of Artificial Sequence:  Hypothetical Probe Sequence
tgcgtgcgtgtcctcacagc

SEQ ID NO: 7484 - DNA, 20 bp, Artificial Sequence
  Description of Artificial Sequence:  Hypothetical Probe Sequence
tgcgtgcgtcgtcagctgtc

SEQ ID NO: 7485 - DNA, 20 bp, Artificial Sequence
  Description of Artificial Sequence:  Hypothetical Probe Sequence
tgcgtgcggcttagtggcaa

SEQ ID NO: 7486 - DNA, 20 bp, Artificial Sequence
  Description of Artificial Sequence:  Hypothetical Probe Sequence
tgcgtgcggagtcctacgtt

SEQ ID NO: 7487 - DNA, 20 bp, Artificial Sequence
  Description of Artificial Sequence:  Hypothetical Probe Sequence
tgcgtgcgatcgcgtttgtc

SEQ ID NO: 7488 - DNA, 20 bp, Artificial Sequence
  Description of Artificial Sequence:  Hypothetical Probe Sequence
tgcgtgcgcctaccatcttg

SEQ ID NO: 7489 - DNA, 20 bp, Artificial Sequence
  Description of Artificial Sequence:  Hypothetical Probe Sequence
tgcgtgcgtcccgctttgtc

SEQ ID NO: 7490 - DNA, 20 bp, Artificial Sequence
  Description of Artificial Sequence:  Hypothetical Probe Sequence
tgcgcacgttgaaaagagga

SEQ ID NO: 7491 - DNA, 20 bp, Artificial Sequence
  Description of Artificial Sequence:  Hypothetical Probe Sequence
tgcgcacgttagcgttacgg

SEQ ID NO: 7492 - DNA, 20 bp, Artificial Sequence
  Description of Artificial Sequence:  Hypothetical Probe Sequence
tgcgcacgaaagacctagcc

SEQ ID NO: 7493 - DNA, 20 bp, Artificial Sequence
  Description of Artificial Sequence:  Hypothetical Probe Sequence
tgcgcacgtcgtcacggacc

SEQ ID NO: 7494 - DNA, 20 bp, Artificial Sequence
  Description of Artificial Sequence:  Hypothetical Probe Sequence
tgcgcacgctgtccatcacg

SEQ ID NO: 7495 - DNA, 20 bp, Artificial Sequence
  Description of Artificial Sequence:  Hypothetical Probe Sequence
tgcgcacggtctaatcgtgc

SEQ ID NO: 7496 - DNA, 20 bp, Artificial Sequence
  Description of Artificial Sequence:  Hypothetical Probe Sequence
tgcgcacgcctattaggagt

SEQ ID NO: 7497 - DNA, 20 bp, Artificial Sequence
  Description of Artificial Sequence:  Hypothetical Probe Sequence
tgcgcacggatgctgttctg

SEQ ID NO: 7498 - DNA, 20 bp, Artificial Sequence
  Description of Artificial Sequence:  Hypothetical Probe Sequence
tgcgcacgtcccaccttcgt

SEQ ID NO: 7499 - DNA, 20 bp, Artificial Sequence
  Description of Artificial Sequence:  Hypothetical Probe Sequence
tgcgcacggaccagtgtcgt

SEQ ID NO: 7500 - DNA, 20 bp, Artificial Sequence
  Description of Artificial Sequence:  Hypothetical Probe Sequence
tgcgcacgggactcgtggta

SEQ ID NO: 7501 - DNA, 20 bp, Artificial Sequence
  Description of Artificial Sequence:  Hypothetical Probe Sequence
tgcgcacgagccgtctagga

SEQ ID NO: 7502 - DNA, 20 bp, Artificial Sequence
  Description of Artificial Sequence:  Hypothetical Probe Sequence
tgcgcagcttgacagcagga

SEQ ID NO: 7503 - DNA, 20 bp, Artificial Sequence
  Description of Artificial Sequence:  Hypothetical Probe Sequence
tgcgcagctgatttagcgaa

SEQ ID NO: 7504 - DNA, 20 bp, Artificial Sequence
  Description of Artificial Sequence:  Hypothetical Probe Sequence
tgcgcagcttaggcttaatc

SEQ ID NO: 7505 - DNA, 20 bp, Artificial Sequence
  Description of Artificial Sequence:  Hypothetical Probe Sequence
tgcgcagcatactctgcagc

SEQ ID NO: 7506 - DNA, 20 bp, Artificial Sequence
  Description of Artificial Sequence:  Hypothetical Probe Sequence
tgcgcagctcgtgtctcagc

SEQ ID NO: 7507 - DNA, 20 bp, Artificial Sequence
  Description of Artificial Sequence:  Hypothetical Probe Sequence
tgcgcagcccatttaggctt

SEQ ID NO: 7508 - DNA, 20 bp, Artificial Sequence
  Description of Artificial Sequence:  Hypothetical Probe Sequence
tgcgcagcggtactcaacgg

SEQ ID NO: 7509 - DNA, 20 bp, Artificial Sequence
  Description of Artificial Sequence:  Hypothetical Probe Sequence
tgcgcagcgagtgcaaatac

SEQ ID NO: 7510 - DNA, 20 bp, Artificial Sequence
  Description of Artificial Sequence:  Hypothetical Probe Sequence
tgcgcagcatcgttagggta

SEQ ID NO: 7511 - DNA, 20 bp, Artificial Sequence
  Description of Artificial Sequence:  Hypothetical Probe Sequence
tgcgcagccctagatgtcgt

SEQ ID NO: 7512 - DNA, 20 bp, Artificial Sequence
  Description of Artificial Sequence:  Hypothetical Probe Sequence
tgcgcagcgatgataccacg

SEQ ID NO: 7513 - DNA, 20 bp, Artificial Sequence
  Description of Artificial Sequence:  Hypothetical Probe Sequence
tgcgcagccagccagcccta

SEQ ID NO: 7514 - DNA, 20 bp, Artificial Sequence
  Description of Artificial Sequence:  Hypothetical Probe Sequence
tgcgcagcgaccaaagaaag

SEQ ID NO: 7515 - DNA, 20 bp, Artificial Sequence
  Description of Artificial Sequence:  Hypothetical Probe Sequence
tgcgcagcagcctcgttctg

SEQ ID NO: 7516 - DNA, 20 bp, Artificial Sequence
  Description of Artificial Sequence:  Hypothetical Probe Sequence
tgcggacctgatcgaatgtc

SEQ ID NO: 7517 - DNA, 20 bp, Artificial Sequence
  Description of Artificial Sequence:  Hypothetical Probe Sequence
tgcggaccaatcaggagacc

SEQ ID NO: 7518 - DNA, 20 bp, Artificial Sequence
  Description of Artificial Sequence:  Hypothetical Probe Sequence
tgcggaccatacaatctgcg

SEQ ID NO: 7519 - DNA, 20 bp, Artificial Sequence
  Description of Artificial Sequence:  Hypothetical Probe Sequence
tgcggacctacactgttccc

SEQ ID NO: 7520 - DNA, 20 bp, Artificial Sequence
  Description of Artificial Sequence:  Hypothetical Probe Sequence
tgcggacctgtctgatacgg

SEQ ID NO: 7521 - DNA, 20 bp, Artificial Sequence
  Description of Artificial Sequence:  Hypothetical Probe Sequence
tgcggacccgttgcaattag

SEQ ID NO: 7522 - DNA, 20 bp, Artificial Sequence
  Description of Artificial Sequence:  Hypothetical Probe Sequence
tgcggaccccatctgttctg

SEQ ID NO: 7523 - DNA, 20 bp, Artificial Sequence
  Description of Artificial Sequence:  Hypothetical Probe Sequence
tgcggacccgaacttgatcg

SEQ ID NO: 7524 - DNA, 20 bp, Artificial Sequence
  Description of Artificial Sequence:  Hypothetical Probe Sequence
tgcggaccgagtccatgtgc

SEQ ID NO: 7525 - DNA, 20 bp, Artificial Sequence
  Description of Artificial Sequence:  Hypothetical Probe Sequence
tgcggaccaggaaaaggtct

SEQ ID NO: 7526 - DNA, 20 bp, Artificial Sequence
  Description of Artificial Sequence:  Hypothetical Probe Sequence
tgcggaccgatgtgtcagtg

SEQ ID NO: 7527 - DNA, 20 bp, Artificial Sequence
  Description of Artificial Sequence:  Hypothetical Probe Sequence
tgcggacccagctcgtcttg

SEQ ID NO: 7528 - DNA, 20 bp, Artificial Sequence
  Description of Artificial Sequence:  Hypothetical Probe Sequence
tgcggaccgaccggtagcaa

SEQ ID NO: 7529 - DNA, 20 bp, Artificial Sequence
  Description of Artificial Sequence:  Hypothetical Probe Sequence
tgcggaccacggaaagccat

SEQ ID NO: 7530 - DNA, 20 bp, Artificial Sequence
  Description of Artificial Sequence:  Hypothetical Probe Sequence
tgcggtgcaatcacggccta

SEQ ID NO: 7531 - DNA, 20 bp, Artificial Sequence
  Description of Artificial Sequence:  Hypothetical Probe Sequence
tgcggtgcaaagcgttcacg

SEQ ID NO: 7532 - DNA, 20 bp, Artificial Sequence
  Description of Artificial Sequence:  Hypothetical Probe Sequence
tgcggtgctgtccctatccc

SEQ ID NO: 7533 - DNA, 20 bp, Artificial Sequence
  Description of Artificial Sequence:  Hypothetical Probe Sequence
tgcggtgccgttatcgaaag

SEQ ID NO: 7534 - DNA, 20 bp, Artificial Sequence
  Description of Artificial Sequence:  Hypothetical Probe Sequence
tgcggtgcacctccatccat

SEQ ID NO: 7535 - DNA, 20 bp, Artificial Sequence
  Description of Artificial Sequence:  Hypothetical Probe Sequence
tgcggtgctcccctgtacgg

SEQ ID NO: 7536 - DNA, 20 bp, Artificial Sequence
  Description of Artificial Sequence:  Hypothetical Probe Sequence
tgcggtgcagcccctaccat

SEQ ID NO: 7537 - DNA, 20 bp, Artificial Sequence
  Description of Artificial Sequence:  Hypothetical Probe Sequence
tgcgggacttgagtctgtgc

SEQ ID NO: 7538 - DNA, 20 bp, Artificial Sequence
  Description of Artificial Sequence:  Hypothetical Probe Sequence
tgcgggactgatttgacagc

SEQ ID NO: 7539 - DNA, 20 bp, Artificial Sequence
  Description of Artificial Sequence:  Hypothetical Probe Sequence
tgcgggacatacgcttagcc

SEQ ID NO: 7540 - DNA, 20 bp, Artificial Sequence
  Description of Artificial Sequence:  Hypothetical Probe Sequence
tgcgggacaaagttagcgtt

SEQ ID NO: 7541 - DNA, 20 bp, Artificial Sequence
  Description of Artificial Sequence:  Hypothetical Probe Sequence
tgcgggactgtctctgagcc

SEQ ID NO: 7542 - DNA, 20 bp, Artificial Sequence
  Description of Artificial Sequence:  Hypothetical Probe Sequence
tgcgggaccttgttaggagt

SEQ ID NO: 7543 - DNA, 20 bp, Artificial Sequence
  Description of Artificial Sequence:  Hypothetical Probe Sequence
tgcgggaccgttggtatccc

SEQ ID NO: 7544 - DNA, 20 bp, Artificial Sequence
  Description of Artificial Sequence:  Hypothetical Probe Sequence
tgcgggacctcagaccacct

SEQ ID NO: 7545 - DNA, 20 bp, Artificial Sequence
  Description of Artificial Sequence:  Hypothetical Probe Sequence
tgcgggacctgtaatccgtt

SEQ ID NO: 7546 - DNA, 20 bp, Artificial Sequence
  Description of Artificial Sequence:  Hypothetical Probe Sequence
tgcgggaccgaacgttctca

SEQ ID NO: 7547 - DNA, 20 bp, Artificial Sequence
  Description of Artificial Sequence:  Hypothetical Probe Sequence
tgcgggacgcttgcttatac

SEQ ID NO: 7548 - DNA, 20 bp, Artificial Sequence
  Description of Artificial Sequence:  Hypothetical Probe Sequence
tgcgggacgtctacctgctt

SEQ ID NO: 7549 - DNA, 20 bp, Artificial Sequence
  Description of Artificial Sequence:  Hypothetical Probe Sequence
tgcgggacagtgacggacct

SEQ ID NO: 7550 - DNA, 20 bp, Artificial Sequence
  Description of Artificial Sequence:  Hypothetical Probe Sequence
tgcgggacatcgctcatcgt

SEQ ID NO: 7551 - DNA, 20 bp, Artificial Sequence
  Description of Artificial Sequence:  Hypothetical Probe Sequence
tgcgggaccctatacagcaa

SEQ ID NO: 7552 - DNA, 20 bp, Artificial Sequence
  Description of Artificial Sequence:  Hypothetical Probe Sequence
tgcgggacgatggtgcgatg

SEQ ID NO: 7553 - DNA, 20 bp, Artificial Sequence
  Description of Artificial Sequence:  Hypothetical Probe Sequence
tgcgggactgcgtgtcccat

SEQ ID NO: 7554 - DNA, 20 bp, Artificial Sequence
  Description of Artificial Sequence:  Hypothetical Probe Sequence
tgcgggacagccatacgcaa

SEQ ID NO: 7555 - DNA, 20 bp, Artificial Sequence
  Description of Artificial Sequence:  Hypothetical Probe Sequence
tgcgacggttaggctttctg

SEQ ID NO: 7556 - DNA, 20 bp, Artificial Sequence
  Description of Artificial Sequence:  Hypothetical Probe Sequence
tgcgacggaatcaatcatcg

SEQ ID NO: 7557 - DNA, 20 bp, Artificial Sequence
  Description of Artificial Sequence:  Hypothetical Probe Sequence
tgcgacggtctgcgaattag

SEQ ID NO: 7558 - DNA, 20 bp, Artificial Sequence
  Description of Artificial Sequence:  Hypothetical Probe Sequence
tgcgacggctcattgaagtg

SEQ ID NO: 7559 - DNA, 20 bp, Artificial Sequence
  Description of Artificial Sequence:  Hypothetical Probe Sequence
tgcgacggctgtccatacct

SEQ ID NO: 7560 - DNA, 20 bp, Artificial Sequence
  Description of Artificial Sequence:  Hypothetical Probe Sequence
tgcgacgggtctcttggagt

SEQ ID NO: 7561 - DNA, 20 bp, Artificial Sequence
  Description of Artificial Sequence:  Hypothetical Probe Sequence
tgcgacgggagtcgttaaag

SEQ ID NO: 7562 - DNA, 20 bp, Artificial Sequence
  Description of Artificial Sequence:  Hypothetical Probe Sequence
tgcgacggagtgacctcacg

SEQ ID NO: 7563 - DNA, 20 bp, Artificial Sequence
  Description of Artificial Sequence:  Hypothetical Probe Sequence
tgcgacggaggatgtcggac

SEQ ID NO: 7564 - DNA, 20 bp, Artificial Sequence
  Description of Artificial Sequence:  Hypothetical Probe Sequence
tgcgacgggatggtgctgtc

SEQ ID NO: 7565 - DNA, 20 bp, Artificial Sequence
  Description of Artificial Sequence:  Hypothetical Probe Sequence
tgcgacgggtgcggtaagga

SEQ ID NO: 7566 - DNA, 20 bp, Artificial Sequence
  Description of Artificial Sequence:  Hypothetical Probe Sequence
tgcgacggggacgcttagcc

SEQ ID NO: 7567 - DNA, 20 bp, Artificial Sequence
  Description of Artificial Sequence:  Hypothetical Probe Sequence
tgcgagccttgatgtctctg

SEQ ID NO: 7568 - DNA, 20 bp, Artificial Sequence
  Description of Artificial Sequence:  Hypothetical Probe Sequence
tgcgagcctgattctggcaa

SEQ ID NO: 7569 - DNA, 20 bp, Artificial Sequence
  Description of Artificial Sequence:  Hypothetical Probe Sequence
tgcgagccttaggcaatctg

SEQ ID NO: 7570 - DNA, 20 bp, Artificial Sequence
  Description of Artificial Sequence:  Hypothetical Probe Sequence
tgcgagccaaagggacatac

SEQ ID NO: 7571 - DNA, 20 bp, Artificial Sequence
  Description of Artificial Sequence:  Hypothetical Probe Sequence
tgcgagcctacaaaaggtgc

SEQ ID NO: 7572 - DNA, 20 bp, Artificial Sequence
  Description of Artificial Sequence:  Hypothetical Probe Sequence
tgcgagcctgtcgacctaca

SEQ ID NO: 7573 - DNA, 20 bp, Artificial Sequence
  Description of Artificial Sequence:  Hypothetical Probe Sequence
tgcgagccctcaggtaggac

SEQ ID NO: 7574 - DNA, 20 bp, Artificial Sequence
  Description of Artificial Sequence:  Hypothetical Probe Sequence
tgcgagccccatggtaagcc

SEQ ID NO: 7575 - DNA, 20 bp, Artificial Sequence
  Description of Artificial Sequence:  Hypothetical Probe Sequence
tgcgagccggtatgtcagcc

SEQ ID NO: 7576 - DNA, 20 bp, Artificial Sequence
  Description of Artificial Sequence:  Hypothetical Probe Sequence
tgcgagccaggagatgcgaa

SEQ ID NO: 7577 - DNA, 20 bp, Artificial Sequence
  Description of Artificial Sequence:  Hypothetical Probe Sequence
tgcgagcccctatctgagcc

SEQ ID NO: 7578 - DNA, 20 bp, Artificial Sequence
  Description of Artificial Sequence:  Hypothetical Probe Sequence
tgcgagcctcccgcttgatg

SEQ ID NO: 7579 - DNA, 20 bp, Artificial Sequence
  Description of Artificial Sequence:  Hypothetical Probe Sequence
tgcgagcccacgtgtcgctt

SEQ ID NO: 7580 - DNA, 20 bp, Artificial Sequence
  Description of Artificial Sequence:  Hypothetical Probe Sequence
tgcgagcccagccagcgtct

SEQ ID NO: 7581 - DNA, 20 bp, Artificial Sequence
  Description of Artificial Sequence:  Hypothetical Probe Sequence
tgcgagccggactcgtgctt

SEQ ID NO: 7582 - DNA, 20 bp, Artificial Sequence
  Description of Artificial Sequence:  Hypothetical Probe Sequence
tgcgagccacggcagctgat

SEQ ID NO: 7583 - DNA, 20 bp, Artificial Sequence
  Description of Artificial Sequence:  Hypothetical Probe Sequence
tgcgagccagccgatgggta

SEQ ID NO: 7584 - DNA, 20 bp, Artificial Sequence
  Description of Artificial Sequence:  Hypothetical Probe Sequence
cacgttgaccattgcgccat

SEQ ID NO: 7585 - DNA, 20 bp, Artificial Sequence
  Description of Artificial Sequence:  Hypothetical Probe Sequence
ttgagcaaacggaaagtgcg

SEQ ID NO: 7586 - DNA, 20 bp, Artificial Sequence
  Description of Artificial Sequence:  Hypothetical Probe Sequence
ttgaatcgcacggaccctca

SEQ ID NO: 7587 - DNA, 20 bp, Artificial Sequence
  Description of Artificial Sequence:  Hypothetical Probe Sequence
tgattcgtgtgccgttcgaa

SEQ ID NO: 7588 - DNA, 20 bp, Artificial Sequence
  Description of Artificial Sequence:  Hypothetical Probe Sequence
cacgtgattcccaatcgcaa

SEQ ID NO: 7589 - DNA, 20 bp, Artificial Sequence
  Description of Artificial Sequence:  Hypothetical Probe Sequence
tgatgtgcccattccccgaa

SEQ ID NO: 7590 - DNA, 20 bp, Artificial Sequence
  Description of Artificial Sequence:  Hypothetical Probe Sequence
ttagcacggcaaagtggctt

SEQ ID NO: 7591 - DNA, 20 bp, Artificial Sequence
  Description of Artificial Sequence:  Hypothetical Probe Sequence
cacgaatccacggaccacgg

SEQ ID NO: 7592 - DNA, 20 bp, Artificial Sequence
  Description of Artificial Sequence:  Hypothetical Probe Sequence
atacgcaaaaagacgggcaa

SEQ ID NO: 7593 - DNA, 20 bp, Artificial Sequence
  Description of Artificial Sequence:  Hypothetical Probe Sequence
atactgcgtctgacggcgaa

SEQ ID NO: 7594 - DNA, 20 bp, Artificial Sequence
  Description of Artificial Sequence:  Hypothetical Probe Sequence
cacgatacacggacggagga

SEQ ID NO: 7595 - DNA, 20 bp, Artificial Sequence
  Description of Artificial Sequence:  Hypothetical Probe Sequence
cacgaaagctgtggaccgaa

SEQ ID NO: 7596 - DNA, 20 bp, Artificial Sequence
  Description of Artificial Sequence:  Hypothetical Probe Sequence
aaagggtaatcgcttgtgcg

SEQ ID NO: 7597 - DNA, 20 bp, Artificial Sequence
  Description of Artificial Sequence:  Hypothetical Probe Sequence
aaagcctaagtgcacgcagc

SEQ ID NO: 7598 - DNA, 20 bp, Artificial Sequence
  Description of Artificial Sequence:  Hypothetical Probe Sequence
aaagtgcgatacaccttgcg

SEQ ID NO: 7599 - DNA, 20 bp, Artificial Sequence
  Description of Artificial Sequence:  Hypothetical Probe Sequence
cacgaaaggtgcaaagagcc

SEQ ID NO: 7600 - DNA, 20 bp, Artificial Sequence
  Description of Artificial Sequence:  Hypothetical Probe Sequence
aaagggacacctgtgctgcg

SEQ ID NO: 7601 - DNA, 20 bp, Artificial Sequence
  Description of Artificial Sequence:  Hypothetical Probe Sequence
tctgcgttatactgcggctt

SEQ ID NO: 7602 - DNA, 20 bp, Artificial Sequence
  Description of Artificial Sequence:  Hypothetical Probe Sequence
tctgtgcgtgatacgggtgc

SEQ ID NO: 7603 - DNA, 20 bp, Artificial Sequence
  Description of Artificial Sequence:  Hypothetical Probe Sequence
tctgcacggcttaaagcacg

SEQ ID NO: 7604 - DNA, 20 bp, Artificial Sequence
  Description of Artificial Sequence:  Hypothetical Probe Sequence
cacgtctgcagcatcgacct

SEQ ID NO: 7605 - DNA, 20 bp, Artificial Sequence
  Description of Artificial Sequence:  Hypothetical Probe Sequence
tctggacccttggacctgcg

SEQ ID NO: 7606 - DNA, 20 bp, Artificial Sequence
  Description of Artificial Sequence:  Hypothetical Probe Sequence
tgtccgttaggagcaatccc

SEQ ID NO: 7607 - DNA, 20 bp, Artificial Sequence
  Description of Artificial Sequence:  Hypothetical Probe Sequence
tgtcgaccgatggaccggac

SEQ ID NO: 7608 - DNA, 20 bp, Artificial Sequence
  Description of Artificial Sequence:  Hypothetical Probe Sequence
cacgtgtcagccgatggcaa

SEQ ID NO: 7609 - DNA, 20 bp, Artificial Sequence
  Description of Artificial Sequence:  Hypothetical Probe Sequence
tcgttctgcgttacggacgg

SEQ ID NO: 7610 - DNA, 20 bp, Artificial Sequence
  Description of Artificial Sequence:  Hypothetical Probe Sequence
cacgtcgttcgtccatcgaa

SEQ ID NO: 7611 - DNA, 20 bp, Artificial Sequence
  Description of Artificial Sequence:  Hypothetical Probe Sequence
tcgtccataaagagcccacg

SEQ ID NO: 7612 - DNA, 20 bp, Artificial Sequence
  Description of Artificial Sequence:  Hypothetical Probe Sequence
tcgtacctgtcttgcgagcc

SEQ ID NO: 7613 - DNA, 20 bp, Artificial Sequence
  Description of Artificial Sequence:  Hypothetical Probe Sequence
tcgtggacgcaagatgcacg

SEQ ID NO: 7614 - DNA, 20 bp, Artificial Sequence
  Description of Artificial Sequence:  Hypothetical Probe Sequence
cacgcttgtgtcggaccgaa

SEQ ID NO: 7615 - DNA, 20 bp, Artificial Sequence
  Description of Artificial Sequence:  Hypothetical Probe Sequence
cacgcttgagtgagtggtgc

SEQ ID NO: 7616 - DNA, 20 bp, Artificial Sequence
  Description of Artificial Sequence:  Hypothetical Probe Sequence
cacgcttgacctcgttagcc

SEQ ID NO: 7617 - DNA, 20 bp, Artificial Sequence
  Description of Artificial Sequence:  Hypothetical Probe Sequence
cacgcttgtccctcgttgat

SEQ ID NO: 7618 - DNA, 20 bp, Artificial Sequence
  Description of Artificial Sequence:  Hypothetical Probe Sequence
cacgcttgagcctctgacct

SEQ ID NO: 7619 - DNA, 20 bp, Artificial Sequence
  Description of Artificial Sequence:  Hypothetical Probe Sequence
cacgcgtttacaaggacacg

SEQ ID NO: 7620 - DNA, 20 bp, Artificial Sequence
  Description of Artificial Sequence:  Hypothetical Probe Sequence
cacgcgtttgtcgcttaatc

SEQ ID NO: 7621 - DNA, 20 bp, Artificial Sequence
  Description of Artificial Sequence:  Hypothetical Probe Sequence
cacgcgtttcgtgatgcgaa

SEQ ID NO: 7622 - DNA, 20 bp, Artificial Sequence
  Description of Artificial Sequence:  Hypothetical Probe Sequence
cacgcgttcttgcgttcgtt

SEQ ID NO: 7623 - DNA, 20 bp, Artificial Sequence
  Description of Artificial Sequence:  Hypothetical Probe Sequence
cacgcgttcgaagtgcgtct

SEQ ID NO: 7624 - DNA, 20 bp, Artificial Sequence
  Description of Artificial Sequence:  Hypothetical Probe Sequence
cacgcgttgtctttagtgcg

SEQ ID NO: 7625 - DNA, 20 bp, Artificial Sequence
  Description of Artificial Sequence:  Hypothetical Probe Sequence
cacgcgttgcaagcaatgtc

SEQ ID NO: 7626 - DNA, 20 bp, Artificial Sequence
  Description of Artificial Sequence:  Hypothetical Probe Sequence
cacgcgttcctatgatgacc

SEQ ID NO: 7627 - DNA, 20 bp, Artificial Sequence
  Description of Artificial Sequence:  Hypothetical Probe Sequence
cacgcgttgatgctcaagga

SEQ ID NO: 7628 - DNA, 20 bp, Artificial Sequence
  Description of Artificial Sequence:  Hypothetical Probe Sequence
cacgcgtttccctgatagcc

SEQ ID NO: 7629 - DNA, 20 bp, Artificial Sequence
  Description of Artificial Sequence:  Hypothetical Probe Sequence
cacgcgttagcccacgtccc

SEQ ID NO: 7630 - DNA, 20 bp, Artificial Sequence
  Description of Artificial Sequence:  Hypothetical Probe Sequence
cacgctcaaatcagcccacg

SEQ ID NO: 7631 - DNA, 20 bp, Artificial Sequence
  Description of Artificial Sequence:  Hypothetical Probe Sequence
cacgctcacgaaaaagccat

SEQ ID NO: 7632 - DNA, 20 bp, Artificial Sequence
  Description of Artificial Sequence:  Hypothetical Probe Sequence
cacgctcaggtaatcgatcg

SEQ ID NO: 7633 - DNA, 20 bp, Artificial Sequence
  Description of Artificial Sequence:  Hypothetical Probe Sequence
cacgctcatcccccatccat

SEQ ID NO: 7634 - DNA, 20 bp, Artificial Sequence
  Description of Artificial Sequence:  Hypothetical Probe Sequence
cacgctgtatcgacctcagc

SEQ ID NO: 7635 - DNA, 20 bp, Artificial Sequence
  Description of Artificial Sequence:  Hypothetical Probe Sequence
cacgctgttgcgctcaagga

SEQ ID NO: 7636 - DNA, 20 bp, Artificial Sequence
  Description of Artificial Sequence:  Hypothetical Probe Sequence
ccattacaacctcagctgcg

SEQ ID NO: 7637 - DNA, 20 bp, Artificial Sequence
  Description of Artificial Sequence:  Hypothetical Probe Sequence
cacgccattctgcttggtgc

SEQ ID NO: 7638 - DNA, 20 bp, Artificial Sequence
  Description of Artificial Sequence:  Hypothetical Probe Sequence
cacgccattcgttctgggac

SEQ ID NO: 7639 - DNA, 20 bp, Artificial Sequence
  Description of Artificial Sequence:  Hypothetical Probe Sequence
cacgccatcttgaatccacg

SEQ ID NO: 7640 - DNA, 20 bp, Artificial Sequence
  Description of Artificial Sequence:  Hypothetical Probe Sequence
cacgccatccatcgttggta

SEQ ID NO: 7641 - DNA, 20 bp, Artificial Sequence
  Description of Artificial Sequence:  Hypothetical Probe Sequence
cacgccatggtaaggaacgg

SEQ ID NO: 7642 - DNA, 20 bp, Artificial Sequence
  Description of Artificial Sequence:  Hypothetical Probe Sequence
ccatgtctcagctgtcgcaa

SEQ ID NO: 7643 - DNA, 20 bp, Artificial Sequence
  Description of Artificial Sequence:  Hypothetical Probe Sequence
cacgccatgagtgtgcgctt

SEQ ID NO: 7644 - DNA, 20 bp, Artificial Sequence
  Description of Artificial Sequence:  Hypothetical Probe Sequence
cacgccatagtgtgtctccc

SEQ ID NO: 7645 - DNA, 20 bp, Artificial Sequence
  Description of Artificial Sequence:  Hypothetical Probe Sequence
cacgccataggacgttacgg

SEQ ID NO: 7646 - DNA, 20 bp, Artificial Sequence
  Description of Artificial Sequence:  Hypothetical Probe Sequence
cacgccattgcggcttcagc

SEQ ID NO: 7647 - DNA, 20 bp, Artificial Sequence
  Description of Artificial Sequence:  Hypothetical Probe Sequence
cacgccatcacgctcaggac

SEQ ID NO: 7648 - DNA, 20 bp, Artificial Sequence
  Description of Artificial Sequence:  Hypothetical Probe Sequence
cacgccatgacctacatgcg

SEQ ID NO: 7649 - DNA, 20 bp, Artificial Sequence
  Description of Artificial Sequence:  Hypothetical Probe Sequence
cacgccatacggagtgagcc

SEQ ID NO: 7650 - DNA, 20 bp, Artificial Sequence
  Description of Artificial Sequence:  Hypothetical Probe Sequence
cacgcgaattgacgttgctt

SEQ ID NO: 7651 - DNA, 20 bp, Artificial Sequence
  Description of Artificial Sequence:  Hypothetical Probe Sequence
cacgcgaaaatcgagtcacg

SEQ ID NO: 7652 - DNA, 20 bp, Artificial Sequence
  Description of Artificial Sequence:  Hypothetical Probe Sequence
cacgcgaatctgaatccttg

SEQ ID NO: 7653 - DNA, 20 bp, Artificial Sequence
  Description of Artificial Sequence:  Hypothetical Probe Sequence
cacgcgaacttgttgaggac

SEQ ID NO: 7654 - DNA, 20 bp, Artificial Sequence
  Description of Artificial Sequence:  Hypothetical Probe Sequence
cacgcgaactgtcagcccta

SEQ ID NO: 7655 - DNA, 20 bp, Artificial Sequence
  Description of Artificial Sequence:  Hypothetical Probe Sequence
cacgcgaagcttccattcgt

SEQ ID NO: 7656 - DNA, 20 bp, Artificial Sequence
  Description of Artificial Sequence:  Hypothetical Probe Sequence
cacgcgaaggtactcatccc

SEQ ID NO: 7657 - DNA, 20 bp, Artificial Sequence
  Description of Artificial Sequence:  Hypothetical Probe Sequence
cacgcgaagtcttcccgatg

SEQ ID NO: 7658 - DNA, 20 bp, Artificial Sequence
  Description of Artificial Sequence:  Hypothetical Probe Sequence
cacgcgaagcaacgaaatac

SEQ ID NO: 7659 - DNA, 20 bp, Artificial Sequence
  Description of Artificial Sequence:  Hypothetical Probe Sequence
cacgcgaagatgttagagcc

SEQ ID NO: 7660 - DNA, 20 bp, Artificial Sequence
  Description of Artificial Sequence:  Hypothetical Probe Sequence
cacgcgaatcccggtacgaa

SEQ ID NO: 7661 - DNA, 20 bp, Artificial Sequence
  Description of Artificial Sequence:  Hypothetical Probe Sequence
cacgcgaatgcggatgcttg

SEQ ID NO: 7662 - DNA, 20 bp, Artificial Sequence
  Description of Artificial Sequence:  Hypothetical Probe Sequence
gcttttagtgatggactgcg

SEQ ID NO: 7663 - DNA, 20 bp, Artificial Sequence
  Description of Artificial Sequence:  Hypothetical Probe Sequence
cacggctttcgtgtctgctt

SEQ ID NO: 7664 - DNA, 20 bp, Artificial Sequence
  Description of Artificial Sequence:  Hypothetical Probe Sequence
cacggcttgcaagcaactgt

SEQ ID NO: 7665 - DNA, 20 bp, Artificial Sequence
  Description of Artificial Sequence:  Hypothetical Probe Sequence
cacggcttatcggtgcgctt

SEQ ID NO: 7666 - DNA, 20 bp, Artificial Sequence
  Description of Artificial Sequence:  Hypothetical Probe Sequence
cacggctttcccgtgcctgt

SEQ ID NO: 7667 - DNA, 20 bp, Artificial Sequence
  Description of Artificial Sequence:  Hypothetical Probe Sequence
cacggcttggacctgttgtc

SEQ ID NO: 7668 - DNA, 20 bp, Artificial Sequence
  Description of Artificial Sequence:  Hypothetical Probe Sequence
cacggcttagccccatagga

SEQ ID NO: 7669 - DNA, 20 bp, Artificial Sequence
  Description of Artificial Sequence:  Hypothetical Probe Sequence
ggtatgatcagcgatgcacg

SEQ ID NO: 7670 - DNA, 20 bp, Artificial Sequence
  Description of Artificial Sequence:  Hypothetical Probe Sequence
cacgggtatcgtgcttcagc

SEQ ID NO: 7671 - DNA, 20 bp, Artificial Sequence
  Description of Artificial Sequence:  Hypothetical Probe Sequence
ggtaccatgtctgtgcgtgc

SEQ ID NO: 7672 - DNA, 20 bp, Artificial Sequence
  Description of Artificial Sequence:  Hypothetical Probe Sequence
ggtagcttaaagtcccgtgc

SEQ ID NO: 7673 - DNA, 20 bp, Artificial Sequence
  Description of Artificial Sequence:  Hypothetical Probe Sequence
cacgggtagcaaagtgatcg

SEQ ID NO: 7674 - DNA, 20 bp, Artificial Sequence
  Description of Artificial Sequence:  Hypothetical Probe Sequence
cacgggtaaggacacgtcgt

SEQ ID NO: 7675 - DNA, 20 bp, Artificial Sequence
  Description of Artificial Sequence:  Hypothetical Probe Sequence
ggtagatgtgcgtccctgcg

SEQ ID NO: 7676 - DNA, 20 bp, Artificial Sequence
  Description of Artificial Sequence:  Hypothetical Probe Sequence
cacgggtagaccagccgcaa

SEQ ID NO: 7677 - DNA, 20 bp, Artificial Sequence
  Description of Artificial Sequence:  Hypothetical Probe Sequence
cacgggtaggacaaagggac

SEQ ID NO: 7678 - DNA, 20 bp, Artificial Sequence
  Description of Artificial Sequence:  Hypothetical Probe Sequence
cacggtcttgatcacggcaa

SEQ ID NO: 7679 - DNA, 20 bp, Artificial Sequence
  Description of Artificial Sequence:  Hypothetical Probe Sequence
cacggtcttctgtgcgccat

SEQ ID NO: 7680 - DNA, 20 bp, Artificial Sequence
  Description of Artificial Sequence:  Hypothetical Probe Sequence
cacggtctgcaaggtatccc

SEQ ID NO: 7681 - DNA, 20 bp, Artificial Sequence
  Description of Artificial Sequence:  Hypothetical Probe Sequence
cacggtcttgcgcacgacct

SEQ ID NO: 7682 - DNA, 20 bp, Artificial Sequence
  Description of Artificial Sequence:  Hypothetical Probe Sequence
cacggtctacggttgaagcc

SEQ ID NO: 7683 - DNA, 20 bp, Artificial Sequence
  Description of Artificial Sequence:  Hypothetical Probe Sequence
cacggagttgatcagctgcg

SEQ ID NO: 7684 - DNA, 20 bp, Artificial Sequence
  Description of Artificial Sequence:  Hypothetical Probe Sequence
cacggagttcgtttagcagc

SEQ ID NO: 7685 - DNA, 20 bp, Artificial Sequence
  Description of Artificial Sequence:  Hypothetical Probe Sequence
cacggagtgcttacggcacg

SEQ ID NO: 7686 - DNA, 20 bp, Artificial Sequence
  Description of Artificial Sequence:  Hypothetical Probe Sequence
cacggagtaggagaccgtgc

SEQ ID NO: 7687 - DNA, 20 bp, Artificial Sequence
  Description of Artificial Sequence:  Hypothetical Probe Sequence
cacggagtagccggaccagc

SEQ ID NO: 7688 - DNA, 20 bp, Artificial Sequence
  Description of Artificial Sequence:  Hypothetical Probe Sequence
cacggcaattgatctgccta

SEQ ID NO: 7689 - DNA, 20 bp, Artificial Sequence
  Description of Artificial Sequence:  Hypothetical Probe Sequence
cacggcaatgtcacggaaag

SEQ ID NO: 7690 - DNA, 20 bp, Artificial Sequence
  Description of Artificial Sequence:  Hypothetical Probe Sequence
cacggcaacttgaatcatcg

SEQ ID NO: 7691 - DNA, 20 bp, Artificial Sequence
  Description of Artificial Sequence:  Hypothetical Probe Sequence
cacggcaaggtactcagacc

SEQ ID NO: 7692 - DNA, 20 bp, Artificial Sequence
  Description of Artificial Sequence:  Hypothetical Probe Sequence
cacggcaacctaaggaatcg

SEQ ID NO: 7693 - DNA, 20 bp, Artificial Sequence
  Description of Artificial Sequence:  Hypothetical Probe Sequence
cacggcaagatgttgagacc

SEQ ID NO: 7694 - DNA, 20 bp, Artificial Sequence
  Description of Artificial Sequence:  Hypothetical Probe Sequence
cacggcaatccccctacgaa

SEQ ID NO: 7695 - DNA, 20 bp, Artificial Sequence
  Description of Artificial Sequence:  Hypothetical Probe Sequence
cacggcaatgcgtctgcacg

SEQ ID NO: 7696 - DNA, 20 bp, Artificial Sequence
  Description of Artificial Sequence:  Hypothetical Probe Sequence
cacggcaacacggtgcatcg

SEQ ID NO: 7697 - DNA, 20 bp, Artificial Sequence
  Description of Artificial Sequence:  Hypothetical Probe Sequence
cacgagtggcttatcgcgtt

SEQ ID NO: 7698 - DNA, 20 bp, Artificial Sequence
  Description of Artificial Sequence:  Hypothetical Probe Sequence
agtggatgaggatgcgcagc

SEQ ID NO: 7699 - DNA, 20 bp, Artificial Sequence
  Description of Artificial Sequence:  Hypothetical Probe Sequence
agtgtcccgcaaccattccc

SEQ ID NO: 7700 - DNA, 20 bp, Artificial Sequence
  Description of Artificial Sequence:  Hypothetical Probe Sequence
agtggaccaatccagccacg

SEQ ID NO: 7701 - DNA, 20 bp, Artificial Sequence
  Description of Artificial Sequence:  Hypothetical Probe Sequence
cacgaccttgatggaccgaa

SEQ ID NO: 7702 - DNA, 20 bp, Artificial Sequence
  Description of Artificial Sequence:  Hypothetical Probe Sequence
accttctgcgaaacggcagc

SEQ ID NO: 7703 - DNA, 20 bp, Artificial Sequence
  Description of Artificial Sequence:  Hypothetical Probe Sequence
cacgaccttcgtgcaaagcc

SEQ ID NO: 7704 - DNA, 20 bp, Artificial Sequence
  Description of Artificial Sequence:  Hypothetical Probe Sequence
acctccatatcggaccgtgc

SEQ ID NO: 7705 - DNA, 20 bp, Artificial Sequence
  Description of Artificial Sequence:  Hypothetical Probe Sequence
cacgacctatcgtgcgtgcg

SEQ ID NO: 7706 - DNA, 20 bp, Artificial Sequence
  Description of Artificial Sequence:  Hypothetical Probe Sequence
cacgacctgatgtgcggacc

SEQ ID NO: 7707 - DNA, 20 bp, Artificial Sequence
  Description of Artificial Sequence:  Hypothetical Probe Sequence
acctggacggtacacgcagc

SEQ ID NO: 7708 - DNA, 20 bp, Artificial Sequence
  Description of Artificial Sequence:  Hypothetical Probe Sequence
cacgatcgaatcacgggacc

SEQ ID NO: 7709 - DNA, 20 bp, Artificial Sequence
  Description of Artificial Sequence:  Hypothetical Probe Sequence
atcgctgtagtgatcgccat

SEQ ID NO: 7710 - DNA, 20 bp, Artificial Sequence
  Description of Artificial Sequence:  Hypothetical Probe Sequence
cacgatcgggtatacaacgg

SEQ ID NO: 7711 - DNA, 20 bp, Artificial Sequence
  Description of Artificial Sequence:  Hypothetical Probe Sequence
atcggtctcttgtccccgaa

SEQ ID NO: 7712 - DNA, 20 bp, Artificial Sequence
  Description of Artificial Sequence:  Hypothetical Probe Sequence
atcgagtgccatcagcgcaa

SEQ ID NO: 7713 - DNA, 20 bp, Artificial Sequence
  Description of Artificial Sequence:  Hypothetical Probe Sequence
cacgatcgacctcgaaacgg

SEQ ID NO: 7714 - DNA, 20 bp, Artificial Sequence
  Description of Artificial Sequence:  Hypothetical Probe Sequence
cacgatcgagccgatgagcc

SEQ ID NO: 7715 - DNA, 20 bp, Artificial Sequence
  Description of Artificial Sequence:  Hypothetical Probe Sequence
cacgaggaaaaggcaatccc

SEQ ID NO: 7716 - DNA, 20 bp, Artificial Sequence
  Description of Artificial Sequence:  Hypothetical Probe Sequence
cacgaggatcgtcttgacgg

SEQ ID NO: 7717 - DNA, 20 bp, Artificial Sequence
  Description of Artificial Sequence:  Hypothetical Probe Sequence
cacgaggacttgtgcgctca

SEQ ID NO: 7718 - DNA, 20 bp, Artificial Sequence
  Description of Artificial Sequence:  Hypothetical Probe Sequence
aggaccattccccagcgacc

SEQ ID NO: 7719 - DNA, 20 bp, Artificial Sequence
  Description of Artificial Sequence:  Hypothetical Probe Sequence
cacgaggaaccttgcgaaag

SEQ ID NO: 7720 - DNA, 20 bp, Artificial Sequence
  Description of Artificial Sequence:  Hypothetical Probe Sequence
cacgaggacacggcttctca

SEQ ID NO: 7721 - DNA, 20 bp, Artificial Sequence
  Description of Artificial Sequence:  Hypothetical Probe Sequence
aggacagcgcttcagctccc

SEQ ID NO: 7722 - DNA, 20 bp, Artificial Sequence
  Description of Artificial Sequence:  Hypothetical Probe Sequence
aggaggacagtggacccgtt

SEQ ID NO: 7723 - DNA, 20 bp, Artificial Sequence
  Description of Artificial Sequence:  Hypothetical Probe Sequence
cacgaggaagccttgaacgg

SEQ ID NO: 7724 - DNA, 20 bp, Artificial Sequence
  Description of Artificial Sequence:  Hypothetical Probe Sequence
cacgcctaaatcgaccatcg

SEQ ID NO: 7725 - DNA, 20 bp, Artificial Sequence
  Description of Artificial Sequence:  Hypothetical Probe Sequence
cacgcctagcttcgttagcc

SEQ ID NO: 7726 - DNA, 20 bp, Artificial Sequence
  Description of Artificial Sequence:  Hypothetical Probe Sequence
cacgcctaatcgtgcgtctg

SEQ ID NO: 7727 - DNA, 20 bp, Artificial Sequence
  Description of Artificial Sequence:  Hypothetical Probe Sequence
cacgcctagatgggtacagc

SEQ ID NO: 7728 - DNA, 20 bp, Artificial Sequence
  Description of Artificial Sequence:  Hypothetical Probe Sequence
cacggatgtcgtcttgggac

SEQ ID NO: 7729 - DNA, 20 bp, Artificial Sequence
  Description of Artificial Sequence:  Hypothetical Probe Sequence
cacggatgcttgtcccccat

SEQ ID NO: 7730 - DNA, 20 bp, Artificial Sequence
  Description of Artificial Sequence:  Hypothetical Probe Sequence
cacggatgctcagctttgtc

SEQ ID NO: 7731 - DNA, 20 bp, Artificial Sequence
  Description of Artificial Sequence:  Hypothetical Probe Sequence
cacggatgggtatcgtagcc

SEQ ID NO: 7732 - DNA, 20 bp, Artificial Sequence
  Description of Artificial Sequence:  Hypothetical Probe Sequence
cacggatggagtcagcccta

SEQ ID NO: 7733 - DNA, 20 bp, Artificial Sequence
  Description of Artificial Sequence:  Hypothetical Probe Sequence
cacggatgcagcgaccagtg

SEQ ID NO: 7734 - DNA, 20 bp, Artificial Sequence
  Description of Artificial Sequence:  Hypothetical Probe Sequence
cacggatggtgccgttcacg

SEQ ID NO: 7735 - DNA, 20 bp, Artificial Sequence
  Description of Artificial Sequence:  Hypothetical Probe Sequence
cacgtcccaatcgtgcgcaa

SEQ ID NO: 7736 - DNA, 20 bp, Artificial Sequence
  Description of Artificial Sequence:  Hypothetical Probe Sequence
cacgtccctctggtgcagcc

SEQ ID NO: 7737 - DNA, 20 bp, Artificial Sequence
  Description of Artificial Sequence:  Hypothetical Probe Sequence
cacgtcccgcttggtaggta

SEQ ID NO: 7738 - DNA, 20 bp, Artificial Sequence
  Description of Artificial Sequence:  Hypothetical Probe Sequence
tcccggtagcttgatgggac

SEQ ID NO: 7739 - DNA, 20 bp, Artificial Sequence
  Description of Artificial Sequence:  Hypothetical Probe Sequence
tccctgcgggtacttgccat

SEQ ID NO: 7740 - DNA, 20 bp, Artificial Sequence
  Description of Artificial Sequence:  Hypothetical Probe Sequence
cacgtcccacggtgatctca

SEQ ID NO: 7741 - DNA, 20 bp, Artificial Sequence
  Description of Artificial Sequence:  Hypothetical Probe Sequence
cacgtgcgttgaagtgcgtt

SEQ ID NO: 7742 - DNA, 20 bp, Artificial Sequence
  Description of Artificial Sequence:  Hypothetical Probe Sequence
cacgtgcgatacacggggac

SEQ ID NO: 7743 - DNA, 20 bp, Artificial Sequence
  Description of Artificial Sequence:  Hypothetical Probe Sequence
cacgtgcgtacatcccagga

SEQ ID NO: 7744 - DNA, 20 bp, Artificial Sequence
  Description of Artificial Sequence:  Hypothetical Probe Sequence
tgcgtctgcgtttctgcagc

SEQ ID NO: 7745 - DNA, 20 bp, Artificial Sequence
  Description of Artificial Sequence:  Hypothetical Probe Sequence
cacgtgcgtgtctcgttcgt

SEQ ID NO: 7746 - DNA, 20 bp, Artificial Sequence
  Description of Artificial Sequence:  Hypothetical Probe Sequence
tgcggcttcctatctggtgc

SEQ ID NO: 7747 - DNA, 20 bp, Artificial Sequence
  Description of Artificial Sequence:  Hypothetical Probe Sequence
cacgtgcgggtaagtgcacg

SEQ ID NO: 7748 - DNA, 20 bp, Artificial Sequence
  Description of Artificial Sequence:  Hypothetical Probe Sequence
tgcggagtcgttgagtcacg

SEQ ID NO: 7749 - DNA, 20 bp, Artificial Sequence
  Description of Artificial Sequence:  Hypothetical Probe Sequence
cacgtgcggcaaggtacagc

SEQ ID NO: 7750 - DNA, 20 bp, Artificial Sequence
  Description of Artificial Sequence:  Hypothetical Probe Sequence
cacgtgcgagtgccatgacc

SEQ ID NO: 7751 - DNA, 20 bp, Artificial Sequence
  Description of Artificial Sequence:  Hypothetical Probe Sequence
cacgtgcgatcgaaagagcc

SEQ ID NO: 7752 - DNA, 20 bp, Artificial Sequence
  Description of Artificial Sequence:  Hypothetical Probe Sequence
tgcgcctactgtgaccacgg

SEQ ID NO: 7753 - DNA, 20 bp, Artificial Sequence
  Description of Artificial Sequence:  Hypothetical Probe Sequence
tgcgtgcggcaatacatgcg

SEQ ID NO: 7754 - DNA, 20 bp, Artificial Sequence
  Description of Artificial Sequence:  Hypothetical Probe Sequence
tgcgacggcctaaaagtccc

SEQ ID NO: 7755 - DNA, 20 bp, Artificial Sequence
  Description of Artificial Sequence:  Hypothetical Probe Sequence
cacgcacgttgaaatctccc

SEQ ID NO: 7756 - DNA, 20 bp, Artificial Sequence
  Description of Artificial Sequence:  Hypothetical Probe Sequence
cacgcacgtctggcttcagc

SEQ ID NO: 7757 - DNA, 20 bp, Artificial Sequence
  Description of Artificial Sequence:  Hypothetical Probe Sequence
cacgcacgtcgtctcatgcg

SEQ ID NO: 7758 - DNA, 20 bp, Artificial Sequence
  Description of Artificial Sequence:  Hypothetical Probe Sequence
cacgcacgccataaagaaag

SEQ ID NO: 7759 - DNA, 20 bp, Artificial Sequence
  Description of Artificial Sequence:  Hypothetical Probe Sequence
cacggtcttacacgtttgcg

SEQ ID NO: 7760 - DNA, 20 bp, Artificial Sequence
  Description of Artificial Sequence:  Hypothetical Probe Sequence
cacgcacgatcgcagcaatc

SEQ ID NO: 7761 - DNA, 20 bp, Artificial Sequence
  Description of Artificial Sequence:  Hypothetical Probe Sequence
cacgcacgcagccgaagagt

SEQ ID NO: 7762 - DNA, 20 bp, Artificial Sequence
  Description of Artificial Sequence:  Hypothetical Probe Sequence
cacgcacggaccgaccgtct

SEQ ID NO: 7763 - DNA, 20 bp, Artificial Sequence
  Description of Artificial Sequence:  Hypothetical Probe Sequence
cacgcagcttagcacggtgc

SEQ ID NO: 7764 - DNA, 20 bp, Artificial Sequence
  Description of Artificial Sequence:  Hypothetical Probe Sequence
cacgcagctctgcagcccat

SEQ ID NO: 7765 - DNA, 20 bp, Artificial Sequence
  Description of Artificial Sequence:  Hypothetical Probe Sequence
cacgcagccttgggtaaaag

SEQ ID NO: 7766 - DNA, 20 bp, Artificial Sequence
  Description of Artificial Sequence:  Hypothetical Probe Sequence
cacgcagcctcaacggacgg

SEQ ID NO: 7767 - DNA, 20 bp, Artificial Sequence
  Description of Artificial Sequence:  Hypothetical Probe Sequence
cacgcagcggtacgttatcg

SEQ ID NO: 7768 - DNA, 20 bp, Artificial Sequence
  Description of Artificial Sequence:  Hypothetical Probe Sequence
cacgcagcgtctgagttccc

SEQ ID NO: 7769 - DNA, 20 bp, Artificial Sequence
  Description of Artificial Sequence:  Hypothetical Probe Sequence
cacgcagcacctttgatcgt

SEQ ID NO: 7770 - DNA, 20 bp, Artificial Sequence
  Description of Artificial Sequence:  Hypothetical Probe Sequence
cacgcagcatcgcctagacc

SEQ ID NO: 7771 - DNA, 20 bp, Artificial Sequence
  Description of Artificial Sequence:  Hypothetical Probe Sequence
cacgcagcgatgggtagacc

SEQ ID NO: 7772 - DNA, 20 bp, Artificial Sequence
  Description of Artificial Sequence:  Hypothetical Probe Sequence
cacgcagctccccttggtgc

SEQ ID NO: 7773 - DNA, 20 bp, Artificial Sequence
  Description of Artificial Sequence:  Hypothetical Probe Sequence
cacggaccaatctgcgacct

SEQ ID NO: 7774 - DNA, 20 bp, Artificial Sequence
  Description of Artificial Sequence:  Hypothetical Probe Sequence
cacggacctctgcgttcacg

SEQ ID NO: 7775 - DNA, 20 bp, Artificial Sequence
  Description of Artificial Sequence:  Hypothetical Probe Sequence
cacggaccccatgatggtgc

SEQ ID NO: 7776 - DNA, 20 bp, Artificial Sequence
  Description of Artificial Sequence:  Hypothetical Probe Sequence
cacggaccgcaatcgtcttg

SEQ ID NO: 7777 - DNA, 20 bp, Artificial Sequence
  Description of Artificial Sequence:  Hypothetical Probe Sequence
cacggaccatcgaatccgaa

SEQ ID NO: 7778 - DNA, 20 bp, Artificial Sequence
  Description of Artificial Sequence:  Hypothetical Probe Sequence
gaccaggaggtatgtctgcg

SEQ ID NO: 7779 - DNA, 20 bp, Artificial Sequence
  Description of Artificial Sequence:  Hypothetical Probe Sequence
cacggaccgatgttagccat

SEQ ID NO: 7780 - DNA, 20 bp, Artificial Sequence
  Description of Artificial Sequence:  Hypothetical Probe Sequence
cacggtgcttagacgggtgc

SEQ ID NO: 7781 - DNA, 20 bp, Artificial Sequence
  Description of Artificial Sequence:  Hypothetical Probe Sequence
cacggtgcaatcccatcacg

SEQ ID NO: 7782 - DNA, 20 bp, Artificial Sequence
  Description of Artificial Sequence:  Hypothetical Probe Sequence
cacggtgcaaagaaagcagc

SEQ ID NO: 7783 - DNA, 20 bp, Artificial Sequence
  Description of Artificial Sequence:  Hypothetical Probe Sequence
cacggtgctctgcttgcgaa

SEQ ID NO: 7784 - DNA, 20 bp, Artificial Sequence
  Description of Artificial Sequence:  Hypothetical Probe Sequence
cacggtgccttgcgaactca

SEQ ID NO: 7785 - DNA, 20 bp, Artificial Sequence
  Description of Artificial Sequence:  Hypothetical Probe Sequence
cacggtgcctcaacctctca

SEQ ID NO: 7786 - DNA, 20 bp, Artificial Sequence
  Description of Artificial Sequence:  Hypothetical Probe Sequence
cacggtgccgaaaggagacc

SEQ ID NO: 7787 - DNA, 20 bp, Artificial Sequence
  Description of Artificial Sequence:  Hypothetical Probe Sequence
cacggtgcgagtgcaaagcc

SEQ ID NO: 7788 - DNA, 20 bp, Artificial Sequence
  Description of Artificial Sequence:  Hypothetical Probe Sequence
cacggtgcacctaggagcaa

SEQ ID NO: 7789 - DNA, 20 bp, Artificial Sequence
  Description of Artificial Sequence:  Hypothetical Probe Sequence
cacggtgcaggaatcgagga

SEQ ID NO: 7790 - DNA, 20 bp, Artificial Sequence
  Description of Artificial Sequence:  Hypothetical Probe Sequence
cacggtgccctaacctccta

SEQ ID NO: 7791 - DNA, 20 bp, Artificial Sequence
  Description of Artificial Sequence:  Hypothetical Probe Sequence
cacggtgctccccagcctgt

SEQ ID NO: 7792 - DNA, 20 bp, Artificial Sequence
  Description of Artificial Sequence:  Hypothetical Probe Sequence
cacggtgctgcgtgatgtgc

SEQ ID NO: 7793 - DNA, 20 bp, Artificial Sequence
  Description of Artificial Sequence:  Hypothetical Probe Sequence
cacggtgcggacgtgcagcc

SEQ ID NO: 7794 - DNA, 20 bp, Artificial Sequence
  Description of Artificial Sequence:  Hypothetical Probe Sequence
ggacttgagcttcgtttgcg

SEQ ID NO: 7795 - DNA, 20 bp, Artificial Sequence
  Description of Artificial Sequence:  Hypothetical Probe Sequence
cacgggacaatcttgaagcc

SEQ ID NO: 7796 - DNA, 20 bp, Artificial Sequence
  Description of Artificial Sequence:  Hypothetical Probe Sequence
cacgggacatacagccacct

SEQ ID NO: 7797 - DNA, 20 bp, Artificial Sequence
  Description of Artificial Sequence:  Hypothetical Probe Sequence
cacgggacctcactcagctt

SEQ ID NO: 7798 - DNA, 20 bp, Artificial Sequence
  Description of Artificial Sequence:  Hypothetical Probe Sequence
ggacctgtcttgagtgcacg

SEQ ID NO: 7799 - DNA, 20 bp, Artificial Sequence
  Description of Artificial Sequence:  Hypothetical Probe Sequence
cacgggacgagtttgaatcg

SEQ ID NO: 7800 - DNA, 20 bp, Artificial Sequence
  Description of Artificial Sequence:  Hypothetical Probe Sequence
cacgggaccctagtgcggac

SEQ ID NO: 7801 - DNA, 20 bp, Artificial Sequence
  Description of Artificial Sequence:  Hypothetical Probe Sequence
cacgggacgaccacggtgat

SEQ ID NO: 7802 - DNA, 20 bp, Artificial Sequence
  Description of Artificial Sequence:  Hypothetical Probe Sequence
acggaatctcgttgattccc

SEQ ID NO: 7803 - DNA, 20 bp, Artificial Sequence
  Description of Artificial Sequence:  Hypothetical Probe Sequence
cacgacggtacaagcccagc

SEQ ID NO: 7804 - DNA, 20 bp, Artificial Sequence
  Description of Artificial Sequence:  Hypothetical Probe Sequence
cacgacggtgtcgtgcgtgc

SEQ ID NO: 7805 - DNA, 20 bp, Artificial Sequence
  Description of Artificial Sequence:  Hypothetical Probe Sequence
acggagtgcttgttgatgcg

SEQ ID NO: 7806 - DNA, 20 bp, Artificial Sequence
  Description of Artificial Sequence:  Hypothetical Probe Sequence
cacgacggatcgcgtttcgt

SEQ ID NO: 7807 - DNA, 20 bp, Artificial Sequence
  Description of Artificial Sequence:  Hypothetical Probe Sequence
cacgacggcagctctggctt

SEQ ID NO: 7808 - DNA, 20 bp, Artificial Sequence
  Description of Artificial Sequence:  Hypothetical Probe Sequence
cacgacggggacaggaaatc

SEQ ID NO: 7809 - DNA, 20 bp, Artificial Sequence
  Description of Artificial Sequence:  Hypothetical Probe Sequence
cacgagccaaagtgcggagt

SEQ ID NO: 7810 - DNA, 20 bp, Artificial Sequence
  Description of Artificial Sequence:  Hypothetical Probe Sequence
cacgagcctacaacggtgcg

SEQ ID NO: 7811 - DNA, 20 bp, Artificial Sequence
  Description of Artificial Sequence:  Hypothetical Probe Sequence
cacgagcctctgaatcgctt

SEQ ID NO: 7812 - DNA, 20 bp, Artificial Sequence
  Description of Artificial Sequence:  Hypothetical Probe Sequence
cacgagcctgtcagccccta

SEQ ID NO: 7813 - DNA, 20 bp, Artificial Sequence
  Description of Artificial Sequence:  Hypothetical Probe Sequence
cacgagccctcacgttggac

SEQ ID NO: 7814 - DNA, 20 bp, Artificial Sequence
  Description of Artificial Sequence:  Hypothetical Probe Sequence
cacgagccgcttacctagga

SEQ ID NO: 7815 - DNA, 20 bp, Artificial Sequence
  Description of Artificial Sequence:  Hypothetical Probe Sequence
cacgagccagtgcgttagcc

SEQ ID NO: 7816 - DNA, 20 bp, Artificial Sequence
  Description of Artificial Sequence:  Hypothetical Probe Sequence
agccacctcagcagtgcagc

SEQ ID NO: 7817 - DNA, 20 bp, Artificial Sequence
  Description of Artificial Sequence:  Hypothetical Probe Sequence
cacgagcctgcggaccggac

SEQ ID NO: 7818 - DNA, 20 bp, Artificial Sequence
  Description of Artificial Sequence:  Hypothetical Probe Sequence
cacgagcccacggcaacagc

SEQ ID NO: 7819 - DNA, 20 bp, Artificial Sequence
  Description of Artificial Sequence:  Hypothetical Probe Sequence
agccgtgcgagtcttgtgcg

SEQ ID NO: 7820 - DNA, 20 bp, Artificial Sequence
  Description of Artificial Sequence:  Hypothetical Probe Sequence
cacgagccggacctcatcgt

SEQ ID NO: 7821 - DNA, 20 bp, Artificial Sequence
  Description of Artificial Sequence:  Hypothetical Probe Sequence
ttgagtgccgaaagccggac

SEQ ID NO: 7822 - DNA, 20 bp, Artificial Sequence
  Description of Artificial Sequence:  Hypothetical Probe Sequence
tgatgcttggacagcccagc

SEQ ID NO: 7823 - DNA, 20 bp, Artificial Sequence
  Description of Artificial Sequence:  Hypothetical Probe Sequence
tgatgcaacacgcttggtgc

SEQ ID NO: 7824 - DNA, 20 bp, Artificial Sequence
  Description of Artificial Sequence:  Hypothetical Probe Sequence
tgattcccagtgcacggtgc

SEQ ID NO: 7825 - DNA, 20 bp, Artificial Sequence
  Description of Artificial Sequence:  Hypothetical Probe Sequence
aatctcgtacggcacgcgtt

SEQ ID NO: 7826 - DNA, 20 bp, Artificial Sequence
  Description of Artificial Sequence:  Hypothetical Probe Sequence
aatcctcacgttagccgtgc

SEQ ID NO: 7827 - DNA, 20 bp, Artificial Sequence
  Description of Artificial Sequence:  Hypothetical Probe Sequence
cagcaatcggtaacggcttg

SEQ ID NO: 7828 - DNA, 20 bp, Artificial Sequence
  Description of Artificial Sequence:  Hypothetical Probe Sequence
cagcaatcgtcttccccagc

SEQ ID NO: 7829 - DNA, 20 bp, Artificial Sequence
  Description of Artificial Sequence:  Hypothetical Probe Sequence
cagcaatcatcgaaagcacg

SEQ ID NO: 7830 - DNA, 20 bp, Artificial Sequence
  Description of Artificial Sequence:  Hypothetical Probe Sequence
atactcccacggacggcgaa

SEQ ID NO: 7831 - DNA, 20 bp, Artificial Sequence
  Description of Artificial Sequence:  Hypothetical Probe Sequence
cagcatactgcgcacgtgcg

SEQ ID NO: 7832 - DNA, 20 bp, Artificial Sequence
  Description of Artificial Sequence:  Hypothetical Probe Sequence
aaaggtgcgtctagccagcc

SEQ ID NO: 7833 - DNA, 20 bp, Artificial Sequence
  Description of Artificial Sequence:  Hypothetical Probe Sequence
aaagacggcacgagtgagcc

SEQ ID NO: 7834 - DNA, 20 bp, Artificial Sequence
  Description of Artificial Sequence:  Hypothetical Probe Sequence
tctggatgagccacggcacg

SEQ ID NO: 7835 - DNA, 20 bp, Artificial Sequence
  Description of Artificial Sequence:  Hypothetical Probe Sequence
tgtccttgtcccgctttccc

SEQ ID NO: 7836 - DNA, 20 bp, Artificial Sequence
  Description of Artificial Sequence:  Hypothetical Probe Sequence
tgtcctcatgcgtgcggacc

SEQ ID NO: 7837 - DNA, 20 bp, Artificial Sequence
  Description of Artificial Sequence:  Hypothetical Probe Sequence
cagctgtcgtgcccatgcaa

SEQ ID NO: 7838 - DNA, 20 bp, Artificial Sequence
  Description of Artificial Sequence:  Hypothetical Probe Sequence
tgtcagcccgaaacctacgg

SEQ ID NO: 7839 - DNA, 20 bp, Artificial Sequence
  Description of Artificial Sequence:  Hypothetical Probe Sequence
cagctcgttcccgcttggac

SEQ ID NO: 7840 - DNA, 20 bp, Artificial Sequence
  Description of Artificial Sequence:  Hypothetical Probe Sequence
tcgtcagctcgtgagttgcg

SEQ ID NO: 7841 - DNA, 20 bp, Artificial Sequence
  Description of Artificial Sequence:  Hypothetical Probe Sequence
cttgaaaggcttagcctgcg

SEQ ID NO: 7842 - DNA, 20 bp, Artificial Sequence
  Description of Artificial Sequence:  Hypothetical Probe Sequence
cagccttgtctggaccagcc

SEQ ID NO: 7843 - DNA, 20 bp, Artificial Sequence
  Description of Artificial Sequence:  Hypothetical Probe Sequence
cagccttgtcgtatacgtgc

SEQ ID NO: 7844 - DNA, 20 bp, Artificial Sequence
  Description of Artificial Sequence:  Hypothetical Probe Sequence
cagccttgagtggacctgcg

SEQ ID NO: 7845 - DNA, 20 bp, Artificial Sequence
  Description of Artificial Sequence:  Hypothetical Probe Sequence
cttgaggagcaagaccacgg

SEQ ID NO: 7846 - DNA, 20 bp, Artificial Sequence
  Description of Artificial Sequence:  Hypothetical Probe Sequence
cagccttgtcccctcaatcg

SEQ ID NO: 7847 - DNA, 20 bp, Artificial Sequence
  Description of Artificial Sequence:  Hypothetical Probe Sequence
cagccttggacccgttcgtt

SEQ ID NO: 7848 - DNA, 20 bp, Artificial Sequence
  Description of Artificial Sequence:  Hypothetical Probe Sequence
cagccttgacgggcaagtct

SEQ ID NO: 7849 - DNA, 20 bp, Artificial Sequence
  Description of Artificial Sequence:  Hypothetical Probe Sequence
cagccgtttacatctgtccc

SEQ ID NO: 7850 - DNA, 20 bp, Artificial Sequence
  Description of Artificial Sequence:  Hypothetical Probe Sequence
cagccgtttctgaaagcagc

SEQ ID NO: 7851 - DNA, 20 bp, Artificial Sequence
  Description of Artificial Sequence:  Hypothetical Probe Sequence
cagccgttgcttagccctca

SEQ ID NO: 7852 - DNA, 20 bp, Artificial Sequence
  Description of Artificial Sequence:  Hypothetical Probe Sequence
cagccgttggtaacctgacc

SEQ ID NO: 7853 - DNA, 20 bp, Artificial Sequence
  Description of Artificial Sequence:  Hypothetical Probe Sequence
cagccgttgcaaatcggtct

SEQ ID NO: 7854 - DNA, 20 bp, Artificial Sequence
  Description of Artificial Sequence:  Hypothetical Probe Sequence
cagccgttatcggatgacct

SEQ ID NO: 7855 - DNA, 20 bp, Artificial Sequence
  Description of Artificial Sequence:  Hypothetical Probe Sequence
cgttcctaacggataccacg

SEQ ID NO: 7856 - DNA, 20 bp, Artificial Sequence
  Description of Artificial Sequence:  Hypothetical Probe Sequence
cgttgtgctcgtaaaggcaa

SEQ ID NO: 7857 - DNA, 20 bp, Artificial Sequence
  Description of Artificial Sequence:  Hypothetical Probe Sequence
cagccgttggacgatggctt

SEQ ID NO: 7858 - DNA, 20 bp, Artificial Sequence
  Description of Artificial Sequence:  Hypothetical Probe Sequence
cagccgttagccgcttagcc

SEQ ID NO: 7859 - DNA, 20 bp, Artificial Sequence
  Description of Artificial Sequence:  Hypothetical Probe Sequence
cagcctcatcgtaaaggtgc

SEQ ID NO: 7860 - DNA, 20 bp, Artificial Sequence
  Description of Artificial Sequence:  Hypothetical Probe Sequence
cagcctcaccatcagcgtgc

SEQ ID NO: 7861 - DNA, 20 bp, Artificial Sequence
  Description of Artificial Sequence:  Hypothetical Probe Sequence
cagcctcacgaacgaacgtt

SEQ ID NO: 7862 - DNA, 20 bp, Artificial Sequence
  Description of Artificial Sequence:  Hypothetical Probe Sequence
cagcctcagctttcgtgcaa

SEQ ID NO: 7863 - DNA, 20 bp, Artificial Sequence
  Description of Artificial Sequence:  Hypothetical Probe Sequencetes sp.
cagcctcagcaagaccgagt

SEQ ID NO: 7864 - DNA, 20 bp, Artificial Sequence
  Description of Artificial Sequence:  Hypothetical Probe Sequence
cagcctcaacctaatcgacc

SEQ ID NO: 7865 - DNA, 20 bp, Artificial Sequence
  Description of Artificial Sequence:  Hypothetical Probe Sequence
cagcctcatcccgaccaaag

SEQ ID NO: 7866 - DNA, 20 bp, Artificial Sequence
  Description of Artificial Sequence:  Hypothetical Probe Sequence
ctcagacctgattccctgcg

SEQ ID NO: 7867 - DNA, 20 bp, Artificial Sequence
  Description of Artificial Sequence:  Hypothetical Probe Sequence
cagcctgtttgatcgtttga

SEQ ID NO: 7868 - DNA, 20 bp, Artificial Sequence
  Description of Artificial Sequence:  Hypothetical Probe Sequence
ctgttgatcgaatcccgtgc

SEQ ID NO: 7869 - DNA, 20 bp, Artificial Sequence
  Description of Artificial Sequence:  Hypothetical Probe Sequence
cagcctgttctgcgttgcaa

SEQ ID NO: 7870 - DNA, 20 bp, Artificial Sequence
  Description of Artificial Sequence:  Hypothetical Probe Sequence
cagcctgtctcaagccggac

SEQ ID NO: 7871 - DNA, 20 bp, Artificial Sequence
  Description of Artificial Sequence:  Hypothetical Probe Sequence
cagcctgtccatctcatgcg

SEQ ID NO: 7872 - DNA, 20 bp, Artificial Sequence
  Description of Artificial Sequence:  Hypothetical Probe Sequence
cagcctgtgcttctcatccc

SEQ ID NO: 7873 - DNA, 20 bp, Artificial Sequence
  Description of Artificial Sequence:  Hypothetical Probe Sequence
cagcctgtgtgccgaagctt

SEQ ID NO: 7874 - DNA, 20 bp, Artificial Sequence
  Description of Artificial Sequence:  Hypothetical Probe Sequence
cagcccattacacacgcacg

SEQ ID NO: 7875 - DNA, 20 bp, Artificial Sequence
  Description of Artificial Sequence:  Hypothetical Probe Sequence
cagcccattctgccatccat

SEQ ID NO: 7876 - DNA, 20 bp, Artificial Sequence
  Description of Artificial Sequence:  Hypothetical Probe Sequence
cagcccatcttgtgatcacg

SEQ ID NO: 7877 - DNA, 20 bp, Artificial Sequence
  Description of Artificial Sequence:  Hypothetical Probe Sequence
cagcccatcgttgcttccat

SEQ ID NO: 7878 - DNA, 20 bp, Artificial Sequence
  Description of Artificial Sequence:  Hypothetical Probe Sequence
ccatgtctccatgaccacgg

SEQ ID NO: 7879 - DNA, 20 bp, Artificial Sequence
  Description of Artificial Sequence:  Hypothetical Probe Sequence
ccatgagtgcttagccacgg

SEQ ID NO: 7880 - DNA, 20 bp, Artificial Sequence
  Description of Artificial Sequence:  Hypothetical Probe Sequence
cagcccatgcaatctgctca

SEQ ID NO: 7881 - DNA, 20 bp, Artificial Sequence
  Description of Artificial Sequence:  Hypothetical Probe Sequence
cagcccatcctaacggccat

SEQ ID NO: 7882 - DNA, 20 bp, Artificial Sequence
  Description of Artificial Sequence:  Hypothetical Probe Sequence
cagcccatcacgaaaggctt

SEQ ID NO: 7883 - DNA, 20 bp, Artificial Sequence
  Description of Artificial Sequence:  Hypothetical Probe Sequence
cagcccatacgggagtgtgc

SEQ ID NO: 7884 - DNA, 20 bp, Artificial Sequence
  Description of Artificial Sequence:  Hypothetical Probe Sequence
cagccgaatctgaaagcgaa

SEQ ID NO: 7885 - DNA, 20 bp, Artificial Sequence
  Description of Artificial Sequence:  Hypothetical Probe Sequence
cagccgaatgtccgttcttg

SEQ ID NO: 7886 - DNA, 20 bp, Artificial Sequence
  Description of Artificial Sequence:  Hypothetical Probe Sequence
cagccgaagtcttgcgaatc

SEQ ID NO: 7887 - DNA, 20 bp, Artificial Sequence
  Description of Artificial Sequence:  Hypothetical Probe Sequence
cgaaagtgatacgtgcgcaa

SEQ ID NO: 7888 - DNA, 20 bp, Artificial Sequence
  Description of Artificial Sequence:  Hypothetical Probe Sequence
cagccgaaaggatgtcatcg

SEQ ID NO: 7889 - DNA, 20 bp, Artificial Sequence
  Description of Artificial Sequence:  Hypothetical Probe Sequence
cagccgaatgcgcttggcaa

SEQ ID NO: 7890 - DNA, 20 bp, Artificial Sequence
  Description of Artificial Sequence:  Hypothetical Probe Sequence
cagccgaacacggcttgctt

SEQ ID NO: 7891 - DNA, 20 bp, Artificial Sequence
  Description of Artificial Sequence:  Hypothetical Probe Sequence
cgaagacccacgatacgtgc

SEQ ID NO: 7892 - DNA, 20 bp, Artificial Sequence
  Description of Artificial Sequence:  Hypothetical Probe Sequence
cagccgaaacggcacgtgtc

SEQ ID NO: 7893 - DNA, 20 bp, Artificial Sequence
  Description of Artificial Sequence:  Hypothetical Probe Sequence
cagccgaaagccggtagatg

SEQ ID NO: 7894 - DNA, 20 bp, Artificial Sequence
  Description of Artificial Sequence:  Hypothetical Probe Sequence
cagcgcttaatctgcgtctg

SEQ ID NO: 7895 - DNA, 20 bp, Artificial Sequence
  Description of Artificial Sequence:  Hypothetical Probe Sequence
cagcgctttacacgtttgtc

SEQ ID NO: 7896 - DNA, 20 bp, Artificial Sequence
  Description of Artificial Sequence:  Hypothetical Probe Sequence
cagcgctttgtccgaaaaag

SEQ ID NO: 7897 - DNA, 20 bp, Artificial Sequence
  Description of Artificial Sequence:  Hypothetical Probe Sequence
cagcgctttcgttcgtttga

SEQ ID NO: 7898 - DNA, 20 bp, Artificial Sequence
  Description of Artificial Sequence:  Hypothetical Probe Sequence
cagcgcttctcaggacccat

SEQ ID NO: 7899 - DNA, 20 bp, Artificial Sequence
  Description of Artificial Sequence:  Hypothetical Probe Sequence
cagcgcttctgtcgaagtgc

SEQ ID NO: 7900 - DNA, 20 bp, Artificial Sequence
  Description of Artificial Sequence:  Hypothetical Probe Sequence
cagcgcttatcgcgaaaatc

SEQ ID NO: 7901 - DNA, 20 bp, Artificial Sequence
  Description of Artificial Sequence:  Hypothetical Probe Sequence
cagcgctttgcggcttgagt

SEQ ID NO: 7902 - DNA, 20 bp, Artificial Sequence
  Description of Artificial Sequence:  Hypothetical Probe Sequence
cagcgcttagccttgacttg

SEQ ID NO: 7903 - DNA, 20 bp, Artificial Sequence
  Description of Artificial Sequence:  Hypothetical Probe Sequence
cagcggtaccatccatgacc

SEQ ID NO: 7904 - DNA, 20 bp, Artificial Sequence
  Description of Artificial Sequence:  Hypothetical Probe Sequence
cagcggtacgaacgaacttg

SEQ ID NO: 7905 - DNA, 20 bp, Artificial Sequence
  Description of Artificial Sequence:  Hypothetical Probe Sequence
cagcggtacagcacctgctt

SEQ ID NO: 7906 - DNA, 20 bp, Artificial Sequence
  Description of Artificial Sequence:  Hypothetical Probe Sequence
cagcgtcttgatggaccagc

SEQ ID NO: 7907 - DNA, 20 bp, Artificial Sequence
  Description of Artificial Sequence:  Hypothetical Probe Sequence
gtctccatctcatcgttgcg

SEQ ID NO: 7908 - DNA, 20 bp, Artificial Sequence
  Description of Artificial Sequence:  Hypothetical Probe Sequence
cagcgtctcgaatcgttccc

SEQ ID NO: 7909 - DNA, 20 bp, Artificial Sequence
  Description of Artificial Sequence:  Hypothetical Probe Sequence
cagcgtctgcttatcgtccc

SEQ ID NO: 7910 - DNA, 20 bp, Artificial Sequence
  Description of Artificial Sequence:  Hypothetical Probe Sequence
cagcgtcttgcgaggagatg

SEQ ID NO: 7911 - DNA, 20 bp, Artificial Sequence
  Description of Artificial Sequence:  Hypothetical Probe Sequence
cagcgtctggacttgaatcg

SEQ ID NO: 7912 - DNA, 20 bp, Artificial Sequence
  Description of Artificial Sequence:  Hypothetical Probe Sequence
cagcgtctacggaatcacgg

SEQ ID NO: 7913 - DNA, 20 bp, Artificial Sequence
  Description of Artificial Sequence:  Hypothetical Probe Sequence
cagcgagttctgcagcgatg

SEQ ID NO: 7914 - DNA, 20 bp, Artificial Sequence
  Description of Artificial Sequence:  Hypothetical Probe Sequence
cagcgagtcttggcaacacg

SEQ ID NO: 7915 - DNA, 20 bp, Artificial Sequence
  Description of Artificial Sequence:  Hypothetical Probe Sequence
cagcgagtcgttatcgtgtc

SEQ ID NO: 7916 - DNA, 20 bp, Artificial Sequence
  Description of Artificial Sequence:  Hypothetical Probe Sequence
cagcgagtcgaaaggacgaa

SEQ ID NO: 7917 - DNA, 20 bp, Artificial Sequence
  Description of Artificial Sequence:  Hypothetical Probe Sequence
cagcgagtgtgcgacctgcg

SEQ ID NO: 7918 - DNA, 20 bp, Artificial Sequence
  Description of Artificial Sequence:  Hypothetical Probe Sequence
cagcgcaatgatcgaaatcg

SEQ ID NO: 7919 - DNA, 20 bp, Artificial Sequence
  Description of Artificial Sequence:  Hypothetical Probe Sequence
cagcgcaaatacaatccagc

SEQ ID NO: 7920 - DNA, 20 bp, Artificial Sequence
  Description of Artificial Sequence:  Hypothetical Probe Sequence
cagcgcaatctggcttgatg

SEQ ID NO: 7921 - DNA, 20 bp, Artificial Sequence
  Description of Artificial Sequence:  Hypothetical Probe Sequence
cagcgcaatgtccgttggac

SEQ ID NO: 7922 - DNA, 20 bp, Artificial Sequence
  Description of Artificial Sequence:  Hypothetical Probe Sequence
cagcgcaaccatggtaatcg

SEQ ID NO: 7923 - DNA, 20 bp, Artificial Sequence
  Description of Artificial Sequence:  Hypothetical Probe Sequence
cagcgcaacgaatcgtcttg

SEQ ID NO: 7924 - DNA, 20 bp, Artificial Sequence
  Description of Artificial Sequence:  Hypothetical Probe Sequence
cagcgcaaggtagcaagacc

SEQ ID NO: 7925 - DNA, 20 bp, Artificial Sequence
  Description of Artificial Sequence:  Hypothetical Probe Sequence
cagcgcaagagtcgttcttg

SEQ ID NO: 7926 - DNA, 20 bp, Artificial Sequence
  Description of Artificial Sequence:  Hypothetical Probe Sequence
cagcgcaaagtgtgattccc

SEQ ID NO: 7927 - DNA, 20 bp, Artificial Sequence
  Description of Artificial Sequence:  Hypothetical Probe Sequence
cagcgcaaggacgatggacc

SEQ ID NO: 7928 - DNA, 20 bp, Artificial Sequence
  Description of Artificial Sequence:  Hypothetical Probe Sequence
cagcgcaaacggtcgtcacg

SEQ ID NO: 7929 - DNA, 20 bp, Artificial Sequence
  Description of Artificial Sequence:  Hypothetical Probe Sequence
agtgtcgtgtgctccccacg

SEQ ID NO: 7930 - DNA, 20 bp, Artificial Sequence
  Description of Artificial Sequence:  Hypothetical Probe Sequence
agtggcttgtgcctgttccc

SEQ ID NO: 7931 - DNA, 20 bp, Artificial Sequence
  Description of Artificial Sequence:  Hypothetical Probe Sequence
cagcagtgcctaatcgcacg

SEQ ID NO: 7932 - DNA, 20 bp, Artificial Sequence
  Description of Artificial Sequence:  Hypothetical Probe Sequence
cagcagtgtccccttgccat

SEQ ID NO: 7933 - DNA, 20 bp, Artificial Sequence
  Description of Artificial Sequence:  Hypothetical Probe Sequence
agtgggacgtctacggtgcg

SEQ ID NO: 7934 - DNA, 20 bp, Artificial Sequence
  Description of Artificial Sequence:  Hypothetical Probe Sequence
cagcacctcgaaaatctgcg

SEQ ID NO: 7935 - DNA, 20 bp, Artificial Sequence
  Description of Artificial Sequence:  Hypothetical Probe Sequence
cagcacctcacgtctgcgaa

SEQ ID NO: 7936 - DNA, 20 bp, Artificial Sequence
  Description of Artificial Sequence:  Hypothetical Probe Sequence
acctgtgcgacctgtccgaa

SEQ ID NO: 7937 - DNA, 20 bp, Artificial Sequence
  Description of Artificial Sequence:  Hypothetical Probe Sequence
cagcacctggacgcttgtgc

SEQ ID NO: 7938 - DNA, 20 bp, Artificial Sequence
  Description of Artificial Sequence:  Hypothetical Probe Sequence
cagcatcggcttacctgtgc

SEQ ID NO: 7939 - DNA, 20 bp, Artificial Sequence
  Description of Artificial Sequence:  Hypothetical Probe Sequence
atcgggtaagtgagccgctt

SEQ ID NO: 7940 - DNA, 20 bp, Artificial Sequence
  Description of Artificial Sequence:  Hypothetical Probe Sequence
atcgatcggcaatctggtgc

SEQ ID NO: 7941 - DNA, 20 bp, Artificial Sequence
  Description of Artificial Sequence:  Hypothetical Probe Sequence
cagcatcgacggcacgggta

SEQ ID NO: 7942 - DNA, 20 bp, Artificial Sequence
  Description of Artificial Sequence:  Hypothetical Probe Sequence
cagcaggaaatcacggtccc

SEQ ID NO: 7943 - DNA, 20 bp, Artificial Sequence
  Description of Artificial Sequence:  Hypothetical Probe Sequence
aggatcgtgtctcgaatgcg

SEQ ID NO: 7944 - DNA, 20 bp, Artificial Sequence
  Description of Artificial Sequence:  Hypothetical Probe Sequence
cagcaggacttgacggcacg

SEQ ID NO: 7945 - DNA, 20 bp, Artificial Sequence
  Description of Artificial Sequence:  Hypothetical Probe Sequence
cagcaggagcaaatcggtgc

SEQ ID NO: 7946 - DNA, 20 bp, Artificial Sequence
  Description of Artificial Sequence:  Hypothetical Probe Sequence
cagcaggaagtgtgcgctgt

SEQ ID NO: 7947 - DNA, 20 bp, Artificial Sequence
  Description of Artificial Sequence:  Hypothetical Probe Sequence
cagcaggacacggatggctt

SEQ ID NO: 7948 - DNA, 20 bp, Artificial Sequence
  Description of Artificial Sequence:  Hypothetical Probe Sequence
aggagtgctctgggactccc

SEQ ID NO: 7949 - DNA, 20 bp, Artificial Sequence
  Description of Artificial Sequence:  Hypothetical Probe Sequence
cagcaggaagccatacggac

SEQ ID NO: 7950 - DNA, 20 bp, Artificial Sequence
  Description of Artificial Sequence:  Hypothetical Probe Sequence
cctatcgtgctttgtcgcaa

SEQ ID NO: 7951 - DNA, 20 bp, Artificial Sequence
  Description of Artificial Sequence:  Hypothetical Probe Sequence
cagccctacgaatctgcagc

SEQ ID NO: 7952 - DNA, 20 bp, Artificial Sequence
  Description of Artificial Sequence:  Hypothetical Probe Sequence
cctagcaaatactccctgcg

SEQ ID NO: 7953 - DNA, 20 bp, Artificial Sequence
  Description of Artificial Sequence:  Hypothetical Probe Sequence
cagccctaagtgagccgtct

SEQ ID NO: 7954 - DNA, 20 bp, Artificial Sequence
  Description of Artificial Sequence:  Hypothetical Probe Sequence
cagccctaaccttcccagcc

SEQ ID NO: 7955 - DNA, 20 bp, Artificial Sequence
  Description of Artificial Sequence:  Hypothetical Probe Sequence
cagccctaacggtcgtctgt

SEQ ID NO: 7956 - DNA, 20 bp, Artificial Sequence
  Description of Artificial Sequence:  Hypothetical Probe Sequence
cagcgatgaatccacgggac

SEQ ID NO: 7957 - DNA, 20 bp, Artificial Sequence
  Description of Artificial Sequence:  Hypothetical Probe Sequence
cagcgatgtctgacctatcg

SEQ ID NO: 7958 - DNA, 20 bp, Artificial Sequence
  Description of Artificial Sequence:  Hypothetical Probe Sequence
gatgtgtcccatgctttgcg

SEQ ID NO: 7959 - DNA, 20 bp, Artificial Sequence
  Description of Artificial Sequence:  Hypothetical Probe Sequence
cagcgatgcttgctgtcttg

SEQ ID NO: 7960 - DNA, 20 bp, Artificial Sequence
  Description of Artificial Sequence:  Hypothetical Probe Sequence
cagcgatgctcagtgctctg

SEQ ID NO: 7961 - DNA, 20 bp, Artificial Sequence
  Description of Artificial Sequence:  Hypothetical Probe Sequence
gatggtcttgattcccgcaa

SEQ ID NO: 7962 - DNA, 20 bp, Artificial Sequence
  Description of Artificial Sequence:  Hypothetical Probe Sequence
cagcgatgaggatcgttcgt

SEQ ID NO: 7963 - DNA, 20 bp, Artificial Sequence
  Description of Artificial Sequence:  Hypothetical Probe Sequence
cagcgatgcctagcaaccta

SEQ ID NO: 7964 - DNA, 20 bp, Artificial Sequence
  Description of Artificial Sequence:  Hypothetical Probe Sequence
cagcgatgtccccttgccta

SEQ ID NO: 7965 - DNA, 20 bp, Artificial Sequence
  Description of Artificial Sequence:  Hypothetical Probe Sequence
cagcgatggaccgatgagtg

SEQ ID NO: 7966 - DNA, 20 bp, Artificial Sequence
  Description of Artificial Sequence:  Hypothetical Probe Sequence
cagcgatgacgggatgtcgt

SEQ ID NO: 7967 - DNA, 20 bp, Artificial Sequence
  Description of Artificial Sequence:  Hypothetical Probe Sequence
cagcgatgagccctgtgcaa

SEQ ID NO: 7968 - DNA, 20 bp, Artificial Sequence
  Description of Artificial Sequence:  Hypothetical Probe Sequence
tcccaaagtcccctgtagcc

SEQ ID NO: 7969 - DNA, 20 bp, Artificial Sequence
  Description of Artificial Sequence:  Hypothetical Probe Sequence
tccccgttaaagatcggacc

SEQ ID NO: 7970 - DNA, 20 bp, Artificial Sequence
  Description of Artificial Sequence:  Hypothetical Probe Sequence
cagctcccctgtatcgcgtt

SEQ ID NO: 7971 - DNA, 20 bp, Artificial Sequence
  Description of Artificial Sequence:  Hypothetical Probe Sequence
tccccgaaatcgtgtcgatg

SEQ ID NO: 7972 - DNA, 20 bp, Artificial Sequence
  Description of Artificial Sequence:  Hypothetical Probe Sequence
tcccgagtgcttttgaagcc

SEQ ID NO: 7973 - DNA, 20 bp, Artificial Sequence
  Description of Artificial Sequence:  Hypothetical Probe Sequence
tcccagtgttagacggccat

SEQ ID NO: 7974 - DNA, 20 bp, Artificial Sequence
  Description of Artificial Sequence:  Hypothetical Probe Sequence
cagctcccacctacctggac

SEQ ID NO: 7975 - DNA, 20 bp, Artificial Sequence
  Description of Artificial Sequence:  Hypothetical Probe Sequence
tcccgatggtcttcgtcgtt

SEQ ID NO: 7976 - DNA, 20 bp, Artificial Sequence
  Description of Artificial Sequence:  Hypothetical Probe Sequence
cagctccctcccgagttccc

SEQ ID NO: 7977 - DNA, 20 bp, Artificial Sequence
  Description of Artificial Sequence:  Hypothetical Probe Sequence
tccctgcgaatcaggacgaa

SEQ ID NO: 7978 - DNA, 20 bp, Artificial Sequence
  Description of Artificial Sequence:  Hypothetical Probe Sequence
tccccacggatgatcgatcg

SEQ ID NO: 7979 - DNA, 20 bp, Artificial Sequence
  Description of Artificial Sequence:  Hypothetical Probe Sequence
tcccacggtcgttgtccttg

SEQ ID NO: 7980 - DNA, 20 bp, Artificial Sequence
  Description of Artificial Sequence:  Hypothetical Probe Sequence
cagctgcgttgagtgccgtt

SEQ ID NO: 7981 - DNA, 20 bp, Artificial Sequence
  Description of Artificial Sequence:  Hypothetical Probe Sequence
tgcgttagtctgggaccgaa

SEQ ID NO: 7982 - DNA, 20 bp, Artificial Sequence
  Description of Artificial Sequence:  Hypothetical Probe Sequence
tgcgataccgaaagcccgtt

SEQ ID NO: 7983 - DNA, 20 bp, Artificial Sequence
  Description of Artificial Sequence:  Hypothetical Probe Sequence
cagctgcgtctggacccagc

SEQ ID NO: 7984 - DNA, 20 bp, Artificial Sequence
  Description of Artificial Sequence:  Hypothetical Probe Sequence
cagctgcgacctaatcagcc

SEQ ID NO: 7985 - DNA, 20 bp, Artificial Sequence
  Description of Artificial Sequence:  Hypothetical Probe Sequence
tgcgatcggctttgatgcaa

SEQ ID NO: 7986 - DNA, 20 bp, Artificial Sequence
  Description of Artificial Sequence:  Hypothetical Probe Sequence
tgcggatggcttgagtcagc

SEQ ID NO: 7987 - DNA, 20 bp, Artificial Sequence
  Description of Artificial Sequence:  Hypothetical Probe Sequence
cagctgcgtccctgtccacg

SEQ ID NO: 7988 - DNA, 20 bp, Artificial Sequence
  Description of Artificial Sequence:  Hypothetical Probe Sequence
cagctgcgcacgcttgacgg

SEQ ID NO: 7989 - DNA, 20 bp, Artificial Sequence
  Description of Artificial Sequence:  Hypothetical Probe Sequence
cacgttgattaggaccgcaa

SEQ ID NO: 7990 - DNA, 20 bp, Artificial Sequence
  Description of Artificial Sequence:  Hypothetical Probe Sequence
cagccacgaatcgagttgcg

SEQ ID NO: 7991 - DNA, 20 bp, Artificial Sequence
  Description of Artificial Sequence:  Hypothetical Probe Sequence
cagccacgataccgaaggac

SEQ ID NO: 7992 - DNA, 20 bp, Artificial Sequence
  Description of Artificial Sequence:  Hypothetical Probe Sequence
cacgtctgtgtctcccacgg

SEQ ID NO: 7993 - DNA, 20 bp, Artificial Sequence
  Description of Artificial Sequence:  Hypothetical Probe Sequence
cagccacgtcgtgcaagtct

SEQ ID NO: 7994 - DNA, 20 bp, Artificial Sequence
  Description of Artificial Sequence:  Hypothetical Probe Sequence
cagccacgcgttcgttccat

SEQ ID NO: 7995 - DNA, 20 bp, Artificial Sequence
  Description of Artificial Sequence:  Hypothetical Probe Sequence
cagccacgcgaagtgcaatc

SEQ ID NO: 7996 - DNA, 20 bp, Artificial Sequence
  Description of Artificial Sequence:  Hypothetical Probe Sequence
cagccacgcctatcccccta

SEQ ID NO: 7997 - DNA, 20 bp, Artificial Sequence
  Description of Artificial Sequence:  Hypothetical Probe Sequence
cagccagcttgaggacggta

SEQ ID NO: 7998 - DNA, 20 bp, Artificial Sequence
  Description of Artificial Sequence:  Hypothetical Probe Sequence
cagccagcttaggaccgtgc

SEQ ID NO: 7999 - DNA, 20 bp, Artificial Sequence
  Description of Artificial Sequence:  Hypothetical Probe Sequence
cagccagctgtcacggagga

SEQ ID NO: 8000 - DNA, 20 bp, Artificial Sequence
  Description of Artificial Sequence:  Hypothetical Probe Sequence
cagcctcaatacggtatgcg

SEQ ID NO: 8001 - DNA, 20 bp, Artificial Sequence
  Description of Artificial Sequence:  Hypothetical Probe Sequence
cagcccatatcgatactgcg

SEQ ID NO: 8002 - DNA, 20 bp, Artificial Sequence
  Description of Artificial Sequence:  Hypothetical Probe Sequence
cagccagcaggacgttcgaa

SEQ ID NO: 8003 - DNA, 20 bp, Artificial Sequence
  Description of Artificial Sequence:  Hypothetical Probe Sequence
cagccagcgatgttagggac

SEQ ID NO: 8004 - DNA, 20 bp, Artificial Sequence
  Description of Artificial Sequence:  Hypothetical Probe Sequence
cagccagctcccggtacttg

SEQ ID NO: 8005 - DNA, 20 bp, Artificial Sequence
  Description of Artificial Sequence:  Hypothetical Probe Sequence
cagccagcagcccttggatg

SEQ ID NO: 8006 - DNA, 20 bp, Artificial Sequence
  Description of Artificial Sequence:  Hypothetical Probe Sequence
cagcgaccaatcatacagcc

SEQ ID NO: 8007 - DNA, 20 bp, Artificial Sequence
  Description of Artificial Sequence:  Hypothetical Probe Sequence
cagcgacctcgtaggagcaa

SEQ ID NO: 8008 - DNA, 20 bp, Artificial Sequence
  Description of Artificial Sequence:  Hypothetical Probe Sequence
cagcgacccttgcctagacc

SEQ ID NO: 8009 - DNA, 20 bp, Artificial Sequence
  Description of Artificial Sequence:  Hypothetical Probe Sequence
cagcgaccgcaacacggtct

SEQ ID NO: 8010 - DNA, 20 bp, Artificial Sequence
  Description of Artificial Sequence:  Hypothetical Probe Sequence
cagcgaccatcgtacacagc

SEQ ID NO: 8011 - DNA, 20 bp, Artificial Sequence
  Description of Artificial Sequence:  Hypothetical Probe Sequence
cagcgacctcccaatcggac

SEQ ID NO: 8012 - DNA, 20 bp, Artificial Sequence
  Description of Artificial Sequence:  Hypothetical Probe Sequence
cagcgacccacggctttaca

SEQ ID NO: 8013 - DNA, 20 bp, Artificial Sequence
  Description of Artificial Sequence:  Hypothetical Probe Sequence
cagcgaccgacctcgtctgt

SEQ ID NO: 8014 - DNA, 20 bp, Artificial Sequence
  Description of Artificial Sequence:  Hypothetical Probe Sequence
cagcgaccagccaggaaatc

SEQ ID NO: 8015 - DNA, 20 bp, Artificial Sequence
  Description of Artificial Sequence:  Hypothetical Probe Sequence
cagcgtgcatactgcgaaag

SEQ ID NO: 8016 - DNA, 20 bp, Artificial Sequence
  Description of Artificial Sequence:  Hypothetical Probe Sequence
cagcgtgctacaagtgcacg

SEQ ID NO: 8017 - DNA, 20 bp, Artificial Sequence
  Description of Artificial Sequence:  Hypothetical Probe Sequence
cagcgtgctctggatggcaa

SEQ ID NO: 8018 - DNA, 20 bp, Artificial Sequence
  Description of Artificial Sequence:  Hypothetical Probe Sequence
cagcgtgctcgtagtgacgg

SEQ ID NO: 8019 - DNA, 20 bp, Artificial Sequence
  Description of Artificial Sequence:  Hypothetical Probe Sequence
cagcgtgcctgtaatctgcg

SEQ ID NO: 8020 - DNA, 20 bp, Artificial Sequence
  Description of Artificial Sequence:  Hypothetical Probe Sequence
cagcgtgccgaactgtgctt

SEQ ID NO: 8021 - DNA, 20 bp, Artificial Sequence
  Description of Artificial Sequence:  Hypothetical Probe Sequence
cagcgtgcgtctcttgcttg

SEQ ID NO: 8022 - DNA, 20 bp, Artificial Sequence
  Description of Artificial Sequence:  Hypothetical Probe Sequence
cagcgtgcaccttcgtcacg

SEQ ID NO: 8023 - DNA, 20 bp, Artificial Sequence
  Description of Artificial Sequence:  Hypothetical Probe Sequence
cagcgtgccacgcttgtcgt

SEQ ID NO: 8024 - DNA, 20 bp, Artificial Sequence
  Description of Artificial Sequence:  Hypothetical Probe Sequence
cagcgtgcgacccacggatg

SEQ ID NO: 8025 - DNA, 20 bp, Artificial Sequence
  Description of Artificial Sequence:  Hypothetical Probe Sequence
cagcgtgcggacatcgtgat

SEQ ID NO: 8026 - DNA, 20 bp, Artificial Sequence
  Description of Artificial Sequence:  Hypothetical Probe Sequence
cagcgtgcacggcagcgagt

SEQ ID NO: 8027 - DNA, 20 bp, Artificial Sequence
  Description of Artificial Sequence:  Hypothetical Probe Sequence
cagcgtgcagccctcaacgg

SEQ ID NO: 8028 - DNA, 20 bp, Artificial Sequence
  Description of Artificial Sequence:  Hypothetical Probe Sequence
cagcggactgatagccagga

SEQ ID NO: 8029 - DNA, 20 bp, Artificial Sequence
  Description of Artificial Sequence:  Hypothetical Probe Sequence
cagcggacaatcaaaggcaa

SEQ ID NO: 8030 - DNA, 20 bp, Artificial Sequence
  Description of Artificial Sequence:  Hypothetical Probe Sequence
cagcggactgtcaatccgaa

SEQ ID NO: 8031 - DNA, 20 bp, Artificial Sequence
  Description of Artificial Sequence:  Hypothetical Probe Sequence
cagcggacgagtcgaagctt

SEQ ID NO: 8032 - DNA, 20 bp, Artificial Sequence
  Description of Artificial Sequence:  Hypothetical Probe Sequence
cagcggacaccttacaagcc

SEQ ID NO: 8033 - DNA, 20 bp, Artificial Sequence
  Description of Artificial Sequence:  Hypothetical Probe Sequence
cagcggacgatgggacacct

SEQ ID NO: 8034 - DNA, 20 bp, Artificial Sequence
  Description of Artificial Sequence:  Hypothetical Probe Sequence
cagcggactgcggtctggac

SEQ ID NO: 8035 - DNA, 20 bp, Artificial Sequence
  Description of Artificial Sequence:  Hypothetical Probe Sequence
cagcggaccacgccatgctt

SEQ ID NO: 8036 - DNA, 20 bp, Artificial Sequence
  Description of Artificial Sequence:  Hypothetical Probe Sequence
cagcggaccagccctaccat

SEQ ID NO: 8037 - DNA, 20 bp, Artificial Sequence
  Description of Artificial Sequence:  Hypothetical Probe Sequence
cagcggacacggcgaactgt

SEQ ID NO: 8038 - DNA, 20 bp, Artificial Sequence
  Description of Artificial Sequence:  Hypothetical Probe Sequence
acggttgaaatccctaacgg

SEQ ID NO: 8039 - DNA, 20 bp, Artificial Sequence
  Description of Artificial Sequence:  Hypothetical Probe Sequence
cagcacggtgatgatgcgtt

SEQ ID NO: 8040 - DNA, 20 bp, Artificial Sequence
  Description of Artificial Sequence:  Hypothetical Probe Sequence
acggaatctctgggtatgcg

SEQ ID NO: 8041 - DNA, 20 bp, Artificial Sequence
  Description of Artificial Sequence:  Hypothetical Probe Sequence
cagcacggatacaaagcacg

SEQ ID NO: 8042 - DNA, 20 bp, Artificial Sequence
  Description of Artificial Sequence:  Hypothetical Probe Sequence
cagcacggctgtgaccgctt

SEQ ID NO: 8043 - DNA, 20 bp, Artificial Sequence
  Description of Artificial Sequence:  Hypothetical Probe Sequence
cagcacggcgaagcttgatg

SEQ ID NO: 8044 - DNA, 20 bp, Artificial Sequence
  Description of Artificial Sequence:  Hypothetical Probe Sequence
acgggcttgtctcctatgcg

SEQ ID NO: 8045 - DNA, 20 bp, Artificial Sequence
  Description of Artificial Sequence:  Hypothetical Probe Sequence
cagcacggggtacgaatccc

SEQ ID NO: 8046 - DNA, 20 bp, Artificial Sequence
  Description of Artificial Sequence:  Hypothetical Probe Sequence
acgggagtatcgagtgagcc

SEQ ID NO: 8047 - DNA, 20 bp, Artificial Sequence
  Description of Artificial Sequence:  Hypothetical Probe Sequence
cagcacggaccttctgcgtt

SEQ ID NO: 8048 - DNA, 20 bp, Artificial Sequence
  Description of Artificial Sequence:  Hypothetical Probe Sequence
cagcacggatcgtcccagtg

SEQ ID NO: 8049 - DNA, 20 bp, Artificial Sequence
  Description of Artificial Sequence:  Hypothetical Probe Sequence
acggaggaacctgagtgcaa

SEQ ID NO: 8050 - DNA, 20 bp, Artificial Sequence
  Description of Artificial Sequence:  Hypothetical Probe Sequence
cagcacggagccacctgtgc

SEQ ID NO: 8051 - DNA, 20 bp, Artificial Sequence
  Description of Artificial Sequence:  Hypothetical Probe Sequence
agcctgataaagagccacgg

SEQ ID NO: 8052 - DNA, 20 bp, Artificial Sequence
  Description of Artificial Sequence:  Hypothetical Probe Sequence
cagcagccaatccttggtgc

SEQ ID NO: 8053 - DNA, 20 bp, Artificial Sequence
  Description of Artificial Sequence:  Hypothetical Probe Sequence
cagcagcctctgtcgtggac

SEQ ID NO: 8054 - DNA, 20 bp, Artificial Sequence
  Description of Artificial Sequence:  Hypothetical Probe Sequence
cagcagcctgtcgtgcgcaa

SEQ ID NO: 8055 - DNA, 20 bp, Artificial Sequence
  Description of Artificial Sequence:  Hypothetical Probe Sequence
cagcagcccgttcctaagga

SEQ ID NO: 8056 - DNA, 20 bp, Artificial Sequence
  Description of Artificial Sequence:  Hypothetical Probe Sequence
cagcagccgtctcttgctca

SEQ ID NO: 8057 - DNA, 20 bp, Artificial Sequence
  Description of Artificial Sequence:  Hypothetical Probe Sequence
agccgagtgagtcacgcgtt

SEQ ID NO: 8058 - DNA, 20 bp, Artificial Sequence
  Description of Artificial Sequence:  Hypothetical Probe Sequence
agccacctgatgtgtcgcaa

SEQ ID NO: 8059 - DNA, 20 bp, Artificial Sequence
  Description of Artificial Sequence:  Hypothetical Probe Sequence
cagcagccgatgatcgctca

SEQ ID NO: 8060 - DNA, 20 bp, Artificial Sequence
  Description of Artificial Sequence:  Hypothetical Probe Sequence
cagcagccgacctacatccc

SEQ ID NO: 8061 - DNA, 20 bp, Artificial Sequence
  Description of Artificial Sequence:  Hypothetical Probe Sequence
ttaggcaaacggcacgcgaa

SEQ ID NO: 8062 - DNA, 20 bp, Artificial Sequence
  Description of Artificial Sequence:  Hypothetical Probe Sequence
aatccgaacgaacgaaacgg

SEQ ID NO: 8063 - DNA, 20 bp, Artificial Sequence
  Description of Artificial Sequence:  Hypothetical Probe Sequence
gaccaatcggacgtgcggac

SEQ ID NO: 8064 - DNA, 20 bp, Artificial Sequence
  Description of Artificial Sequence:  Hypothetical Probe Sequence
aaagcgttagccctgtcagc

SEQ ID NO: 8065 - DNA, 20 bp, Artificial Sequence
  Description of Artificial Sequence:  Hypothetical Probe Sequence
aaagatcgcgttgtgctgcg

SEQ ID NO: 8066 - DNA, 20 bp, Artificial Sequence
  Description of Artificial Sequence:  Hypothetical Probe Sequence
aaaggatgcacggacctgcg

SEQ ID NO: 8067 - DNA, 20 bp, Artificial Sequence
  Description of Artificial Sequence:  Hypothetical Probe Sequence
aaagggacgaccaggaacgg

SEQ ID NO: 8068 - DNA, 20 bp, Artificial Sequence
  Description of Artificial Sequence:  Hypothetical Probe Sequence
tctggtgccagcgcttggac

SEQ ID NO: 8069 - DNA, 20 bp, Artificial Sequence
  Description of Artificial Sequence:  Hypothetical Probe Sequence
tctgacggcgtttcgttccc

SEQ ID NO: 8070 - DNA, 20 bp, Artificial Sequence
  Description of Artificial Sequence:  Hypothetical Probe Sequence
tgtcgtgcaaagccatgacc

SEQ ID NO: 8071 - DNA, 20 bp, Artificial Sequence
  Description of Artificial Sequence:  Hypothetical Probe Sequence
tcgtcgaatgcggtctgtgc

SEQ ID NO: 8072 - DNA, 20 bp, Artificial Sequence
  Description of Artificial Sequence:  Hypothetical Probe Sequence
tcgtggtatcccgtgcgagt

SEQ ID NO: 8073 - DNA, 20 bp, Artificial Sequence
  Description of Artificial Sequence:  Hypothetical Probe Sequence
tcgtcacggcttacggctgt

SEQ ID NO: 8074 - DNA, 20 bp, Artificial Sequence
  Description of Artificial Sequence:  Hypothetical Probe Sequence
cttgcgaatcgttacatgcg

SEQ ID NO: 8075 - DNA, 20 bp, Artificial Sequence
  Description of Artificial Sequence:  Hypothetical Probe Sequence
gacccttgggtaccattccc

SEQ ID NO: 8076 - DNA, 20 bp, Artificial Sequence
  Description of Artificial Sequence:  Hypothetical Probe Sequence
cttgcagccctacagccagc

SEQ ID NO: 8077 - DNA, 20 bp, Artificial Sequence
  Description of Artificial Sequence:  Hypothetical Probe Sequence
gacccgtttacagtgcggac

SEQ ID NO: 8078 - DNA, 20 bp, Artificial Sequence
  Description of Artificial Sequence:  Hypothetical Probe Sequence
gacccgtttctgcacggtct

SEQ ID NO: 8079 - DNA, 20 bp, Artificial Sequence
  Description of Artificial Sequence:  Hypothetical Probe Sequence
gacccgttctcagctttccc

SEQ ID NO: 8080 - DNA, 20 bp, Artificial Sequence
  Description of Artificial Sequence:  Hypothetical Probe Sequence
cgttggtacagcaatctgcg

SEQ ID NO: 8081 - DNA, 20 bp, Artificial Sequence
  Description of Artificial Sequence:  Hypothetical Probe Sequence
cgttagtgttgatgcgcacg

SEQ ID NO: 8082 - DNA, 20 bp, Artificial Sequence
  Description of Artificial Sequence:  Hypothetical Probe Sequence
gacccgttaggatcccccat

SEQ ID NO: 8083 - DNA, 20 bp, Artificial Sequence
  Description of Artificial Sequence:  Hypothetical Probe Sequence
gacccgttgatgatcgcagc

SEQ ID NO: 8084 - DNA, 20 bp, Artificial Sequence
  Description of Artificial Sequence:  Hypothetical Probe Sequence
cgtttgcgaatctgtcgctt

SEQ ID NO: 8085 - DNA, 20 bp, Artificial Sequence
  Description of Artificial Sequence:  Hypothetical Probe Sequence
gacccgttcacgtgatgctt

SEQ ID NO: 8086 - DNA, 20 bp, Artificial Sequence
  Description of Artificial Sequence:  Hypothetical Probe Sequence
cgttcagcggtatctgtgcg

SEQ ID NO: 8087 - DNA, 20 bp, Artificial Sequence
  Description of Artificial Sequence:  Hypothetical Probe Sequence
gacccgttgtgcggacacct

SEQ ID NO: 8088 - DNA, 20 bp, Artificial Sequence
  Description of Artificial Sequence:  Hypothetical Probe Sequence
gaccctgtgcaaggtatgcg

SEQ ID NO: 8089 - DNA, 20 bp, Artificial Sequence
  Description of Artificial Sequence:  Hypothetical Probe Sequence
ccatttgagcaagtgcgacc

SEQ ID NO: 8090 - DNA, 20 bp, Artificial Sequence
  Description of Artificial Sequence:  Hypothetical Probe Sequence
ccatggtacttgtgcgcacg

SEQ ID NO: 8091 - DNA, 20 bp, Artificial Sequence
  Description of Artificial Sequence:  Hypothetical Probe Sequence
ccatcacggagtgacctgcg

SEQ ID NO: 8092 - DNA, 20 bp, Artificial Sequence
  Description of Artificial Sequence:  Hypothetical Probe Sequence
gaccccatacggggtacacg

SEQ ID NO: 8093 - DNA, 20 bp, Artificial Sequence
  Description of Artificial Sequence:  Hypothetical Probe Sequence
cgaattgaaggatccccgtt

SEQ ID NO: 8094 - DNA, 20 bp, Artificial Sequence
  Description of Artificial Sequence:  Hypothetical Probe Sequence
cgaaggtaccatcgaaagcc

SEQ ID NO: 8095 - DNA, 20 bp, Artificial Sequence
  Description of Artificial Sequence:  Hypothetical Probe Sequence
gacccgaaatcggcttctca

SEQ ID NO: 8096 - DNA, 20 bp, Artificial Sequence
  Description of Artificial Sequence:  Hypothetical Probe Sequence
gacccgaaacgggcttagga

SEQ ID NO: 8097 - DNA, 20 bp, Artificial Sequence
  Description of Artificial Sequence:  Hypothetical Probe Sequence
gaccgctttgatggtaatcg

SEQ ID NO: 8098 - DNA, 20 bp, Artificial Sequence
  Description of Artificial Sequence:  Hypothetical Probe Sequence
gctttgtcggaccagcgtgc

SEQ ID NO: 8099 - DNA, 20 bp, Artificial Sequence
  Description of Artificial Sequence:  Hypothetical Probe Sequence
gcttctgtccatgagttgcg

SEQ ID NO: 8100 - DNA, 20 bp, Artificial Sequence
  Description of Artificial Sequence:  Hypothetical Probe Sequence
gaccgcttgcttacggaaag

SEQ ID NO: 8101 - DNA, 20 bp, Artificial Sequence
  Description of Artificial Sequence:  Hypothetical Probe Sequence
gcttatcgaatcggtatgcg

SEQ ID NO: 8102 - DNA, 20 bp, Artificial Sequence
  Description of Artificial Sequence:  Hypothetical Probe Sequence
gaccgcttcctaaggaagcc

SEQ ID NO: 8103 - DNA, 20 bp, Artificial Sequence
  Description of Artificial Sequence:  Hypothetical Probe Sequence
gaccgctttgcgtcgtgtgc

SEQ ID NO: 8104 - DNA, 20 bp, Artificial Sequence
  Description of Artificial Sequence:  Hypothetical Probe Sequence
gaccgcttgtgcaatccgtt

SEQ ID NO: 8105 - DNA, 20 bp, Artificial Sequence
  Description of Artificial Sequence:  Hypothetical Probe Sequence
gaccggtattgatgcgacgg

SEQ ID NO: 8106 - DNA, 20 bp, Artificial Sequence
  Description of Artificial Sequence:  Hypothetical Probe Sequence
ggtacgttggacctcatgcg

SEQ ID NO: 8107 - DNA, 20 bp, Artificial Sequence
  Description of Artificial Sequence:  Hypothetical Probe Sequence
gaccggtacgaagaccggac

SEQ ID NO: 8108 - DNA, 20 bp, Artificial Sequence
  Description of Artificial Sequence:  Hypothetical Probe Sequence
ggtagcttcacgaatcgcaa

SEQ ID NO: 8109 - DNA, 20 bp, Artificial Sequence
  Description of Artificial Sequence:  Hypothetical Probe Sequence
ggtaggtagctttccccacg

SEQ ID NO: 8110 - DNA, 20 bp, Artificial Sequence
  Description of Artificial Sequence:  Hypothetical Probe Sequence
gaccggtaaggaaggaacgg

SEQ ID NO: 8111 - DNA, 20 bp, Artificial Sequence
  Description of Artificial Sequence:  Hypothetical Probe Sequence
gaccggtatgcgtgcgtgat

SEQ ID NO: 8112 - DNA, 20 bp, Artificial Sequence
  Description of Artificial Sequence:  Hypothetical Probe Sequence
gtcttcgtttgaagccgcaa

SEQ ID NO: 8113 - DNA, 20 bp, Artificial Sequence
  Description of Artificial Sequence:  Hypothetical Probe Sequence
gaccgtctcgaacagcatcg

SEQ ID NO: 8114 - DNA, 20 bp, Artificial Sequence
  Description of Artificial Sequence:  Hypothetical Probe Sequence
gtctgctttgatggacgctt

SEQ ID NO: 8115 - DNA, 20 bp, Artificial Sequence
  Description of Artificial Sequence:  Hypothetical Probe Sequence
gaccgtctgaccgtgccttg

SEQ ID NO: 8116 - DNA, 20 bp, Artificial Sequence
  Description of Artificial Sequence:  Hypothetical Probe Sequence
gagtggtaaaagacggcagc

SEQ ID NO: 8117 - DNA, 20 bp, Artificial Sequence
  Description of Artificial Sequence:  Hypothetical Probe Sequence
gaccgagtgtgccgttgcaa

SEQ ID NO: 8118 - DNA, 20 bp, Artificial Sequence
  Description of Artificial Sequence:  Hypothetical Probe Sequence
gaccgagtggacacggtcgt

SEQ ID NO: 8119 - DNA, 20 bp, Artificial Sequence
  Description of Artificial Sequence:  Hypothetical Probe Sequence
gaccgagtagccgatgcagc

SEQ ID NO: 8120 - DNA, 20 bp, Artificial Sequence
  Description of Artificial Sequence:  Hypothetical Probe Sequence
gaccgcaatgatacggcgaa

SEQ ID NO: 8121 - DNA, 20 bp, Artificial Sequence
  Description of Artificial Sequence:  Hypothetical Probe Sequence
gcaaaatctgtcctgttgcg

SEQ ID NO: 8122 - DNA, 20 bp, Artificial Sequence
  Description of Artificial Sequence:  Hypothetical Probe Sequence
gaccgcaatctgtgattccc

SEQ ID NO: 8123 - DNA, 20 bp, Artificial Sequence
  Description of Artificial Sequence:  Hypothetical Probe Sequence
gaccgcaacttgtgatgtgc

SEQ ID NO: 8124 - DNA, 20 bp, Artificial Sequence
  Description of Artificial Sequence:  Hypothetical Probe Sequence
gaccgcaagcttttgatccc

SEQ ID NO: 8125 - DNA, 20 bp, Artificial Sequence
  Description of Artificial Sequence:  Hypothetical Probe Sequence
gaccgcaagtctcacgcgtt

SEQ ID NO: 8126 - DNA, 20 bp, Artificial Sequence
  Description of Artificial Sequence:  Hypothetical Probe Sequence
gcaagagttgatggacacgg

SEQ ID NO: 8127 - DNA, 20 bp, Artificial Sequence
  Description of Artificial Sequence:  Hypothetical Probe Sequence
gaccgcaaagtggatggatg

SEQ ID NO: 8128 - DNA, 20 bp, Artificial Sequence
  Description of Artificial Sequence:  Hypothetical Probe Sequence
gaccgcaatcccccattccc

SEQ ID NO: 8129 - DNA, 20 bp, Artificial Sequence
  Description of Artificial Sequence:  Hypothetical Probe Sequence
agtgtgcggagtgaccgcaa

SEQ ID NO: 8130 - DNA, 20 bp, Artificial Sequence
  Description of Artificial Sequence:  Hypothetical Probe Sequence
agtgcacgctcacacggcaa

SEQ ID NO: 8131 - DNA, 20 bp, Artificial Sequence
  Description of Artificial Sequence:  Hypothetical Probe Sequence
agtgagccgaccgacccgtt

SEQ ID NO: 8132 - DNA, 20 bp, Artificial Sequence
  Description of Artificial Sequence:  Hypothetical Probe Sequence
acctcacggatgccatcacg

SEQ ID NO: 8133 - DNA, 20 bp, Artificial Sequence
  Description of Artificial Sequence:  Hypothetical Probe Sequence
acctacgggcttagcccgaa

SEQ ID NO: 8134 - DNA, 20 bp, Artificial Sequence
  Description of Artificial Sequence:  Hypothetical Probe Sequence
gaccatcgctcaagccctca

SEQ ID NO: 8135 - DNA, 20 bp, Artificial Sequence
  Description of Artificial Sequence:  Hypothetical Probe Sequence
gaccatcgcgaatcccctgt

SEQ ID NO: 8136 - DNA, 20 bp, Artificial Sequence
  Description of Artificial Sequence:  Hypothetical Probe Sequence
gaccaggaccatacggccat

SEQ ID NO: 8137 - DNA, 20 bp, Artificial Sequence
  Description of Artificial Sequence:  Hypothetical Probe Sequence
aggaatcgcgaagatggacc

SEQ ID NO: 8138 - DNA, 20 bp, Artificial Sequence
  Description of Artificial Sequence:  Hypothetical Probe Sequence
aggatcccgcttgagttccc

SEQ ID NO: 8139 - DNA, 20 bp, Artificial Sequence
  Description of Artificial Sequence:  Hypothetical Probe Sequence
aggagtgccttggcttgcaa

SEQ ID NO: 8140 - DNA, 20 bp, Artificial Sequence
  Description of Artificial Sequence:  Hypothetical Probe Sequence
cctacttgccatcacggtgc

SEQ ID NO: 8141 - DNA, 20 bp, Artificial Sequence
  Description of Artificial Sequence:  Hypothetical Probe Sequence
gacccctacgttaggaacgg

SEQ ID NO: 8142 - DNA, 20 bp, Artificial Sequence
  Description of Artificial Sequence:  Hypothetical Probe Sequence
cctacgaaggtaagcccagc

SEQ ID NO: 8143 - DNA, 20 bp, Artificial Sequence
  Description of Artificial Sequence:  Hypothetical Probe Sequence
cctagcaacacgacggagcc

SEQ ID NO: 8144 - DNA, 20 bp, Artificial Sequence
  Description of Artificial Sequence:  Hypothetical Probe Sequence
cctagtgctgtcaggatgcg

SEQ ID NO: 8145 - DNA, 20 bp, Artificial Sequence
  Description of Artificial Sequence:  Hypothetical Probe Sequence
gacccctaggacagccgcaa

SEQ ID NO: 8146 - DNA, 20 bp, Artificial Sequence
  Description of Artificial Sequence:  Hypothetical Probe Sequence
gaccgatgatcgtgcgccta

SEQ ID NO: 8147 - DNA, 20 bp, Artificial Sequence
  Description of Artificial Sequence:  Hypothetical Probe Sequence
gaccgatgaggaatcgggac

SEQ ID NO: 8148 - DNA, 20 bp, Artificial Sequence
  Description of Artificial Sequence:  Hypothetical Probe Sequence
gaccgatgtgcgtcgtatcg

SEQ ID NO: 8149 - DNA, 20 bp, Artificial Sequence
  Description of Artificial Sequence:  Hypothetical Probe Sequence
gaccgatgcagccctacacg

SEQ ID NO: 8150 - DNA, 20 bp, Artificial Sequence
  Description of Artificial Sequence:  Hypothetical Probe Sequence
gaccgatggtgccagcagga

SEQ ID NO: 8151 - DNA, 20 bp, Artificial Sequence
  Description of Artificial Sequence:  Hypothetical Probe Sequence
gaccgatgagcctctgggta

SEQ ID NO: 8152 - DNA, 20 bp, Artificial Sequence
  Description of Artificial Sequence:  Hypothetical Probe Sequence
tcccaaagcgaagatgcgtt

SEQ ID NO: 8153 - DNA, 20 bp, Artificial Sequence
  Description of Artificial Sequence:  Hypothetical Probe Sequence
tcccagtggtgcgctttcgt

SEQ ID NO: 8154 - DNA, 20 bp, Artificial Sequence
  Description of Artificial Sequence:  Hypothetical Probe Sequence
tcccaccttacacgaatgcg

SEQ ID NO: 8155 - DNA, 20 bp, Artificial Sequence
  Description of Artificial Sequence:  Hypothetical Probe Sequence
gacctcccggactctgcgaa

SEQ ID NO: 8156 - DNA, 20 bp, Artificial Sequence
  Description of Artificial Sequence:  Hypothetical Probe Sequence
gacctcccagcccgttgctt

SEQ ID NO: 8157 - DNA, 20 bp, Artificial Sequence
  Description of Artificial Sequence:  Hypothetical Probe Sequence
tgcgttgagtctacggcgaa

SEQ ID NO: 8158 - DNA, 20 bp, Artificial Sequence
  Description of Artificial Sequence:  Hypothetical Probe Sequence
tgcgtcgtacctgatggacc

SEQ ID NO: 8159 - DNA, 20 bp, Artificial Sequence
  Description of Artificial Sequence:  Hypothetical Probe Sequence
tgcggagtctgtatcgacgg

SEQ ID NO: 8160 - DNA, 20 bp, Artificial Sequence
  Description of Artificial Sequence:  Hypothetical Probe Sequence
tgcgatcggtctaccttgcg

SEQ ID NO: 8161 - DNA, 20 bp, Artificial Sequence
  Description of Artificial Sequence:  Hypothetical Probe Sequence
tgcgcctaaggaaaagagcc

SEQ ID NO: 8162 - DNA, 20 bp, Artificial Sequence
  Description of Artificial Sequence:  Hypothetical Probe Sequence
tgcgtgcgcgtttgtcagga

SEQ ID NO: 8163 - DNA, 20 bp, Artificial Sequence
  Description of Artificial Sequence:  Hypothetical Probe Sequence
gacctgcggtgccacgagga

SEQ ID NO: 8164 - DNA, 20 bp, Artificial Sequence
  Description of Artificial Sequence:  Hypothetical Probe Sequence
cacgttagggacgatggcaa

SEQ ID NO: 8165 - DNA, 20 bp, Artificial Sequence
  Description of Artificial Sequence:  Hypothetical Probe Sequence
cacgtgtcccatgacccagc

SEQ ID NO: 8166 - DNA, 20 bp, Artificial Sequence
  Description of Artificial Sequence:  Hypothetical Probe Sequence
gacccacgctgtcagcgtct

SEQ ID NO: 8167 - DNA, 20 bp, Artificial Sequence
  Description of Artificial Sequence:  Hypothetical Probe Sequence
gacccacgcctatcgtctca

SEQ ID NO: 8168 - DNA, 20 bp, Artificial Sequence
  Description of Artificial Sequence:  Hypothetical Probe Sequence
gacccacgagccgcaagacc

SEQ ID NO: 8169 - DNA, 20 bp, Artificial Sequence
  Description of Artificial Sequence:  Hypothetical Probe Sequence
cagcttgatacatgcgcgaa

SEQ ID NO: 8170 - DNA, 20 bp, Artificial Sequence
  Description of Artificial Sequence:  Hypothetical Probe Sequence
cagcataccttggcaatgcg

SEQ ID NO: 8171 - DNA, 20 bp, Artificial Sequence
  Description of Artificial Sequence:  Hypothetical Probe Sequence
cagctacacttggtgccgtt

SEQ ID NO: 8172 - DNA, 20 bp, Artificial Sequence
  Description of Artificial Sequence:  Hypothetical Probe Sequence
gacccagcggtagctttgtc

SEQ ID NO: 8173 - DNA, 20 bp, Artificial Sequence
  Description of Artificial Sequence:  Hypothetical Probe Sequence
cagcagtggaccaaagcgaa

SEQ ID NO: 8174 - DNA, 20 bp, Artificial Sequence
  Description of Artificial Sequence:  Hypothetical Probe Sequence
cagcgatgccattgtcccat

SEQ ID NO: 8175 - DNA, 20 bp, Artificial Sequence
  Description of Artificial Sequence:  Hypothetical Probe Sequence
cagcgtgcaggatgtcgtgc

SEQ ID NO: 8176 - DNA, 20 bp, Artificial Sequence
  Description of Artificial Sequence:  Hypothetical Probe Sequence
gacccagcagccgcaaaatc

SEQ ID NO: 8177 - DNA, 20 bp, Artificial Sequence
  Description of Artificial Sequence:  Hypothetical Probe Sequence
gaccgacctgatagccccat

SEQ ID NO: 8178 - DNA, 20 bp, Artificial Sequence
  Description of Artificial Sequence:  Hypothetical Probe Sequence
gaccaaaggtctgaccgcaa

SEQ ID NO: 8179 - DNA, 20 bp, Artificial Sequence
  Description of Artificial Sequence:  Hypothetical Probe Sequence
gaccgacctctgcgaaggac

SEQ ID NO: 8180 - DNA, 20 bp, Artificial Sequence
  Description of Artificial Sequence:  Hypothetical Probe Sequence
gaccgaccctgtaaagcagc

SEQ ID NO: 8181 - DNA, 20 bp, Artificial Sequence
  Description of Artificial Sequence:  Hypothetical Probe Sequence
gaccgaccacctgcaacgtt

SEQ ID NO: 8182 - DNA, 20 bp, Artificial Sequence
  Description of Artificial Sequence:  Hypothetical Probe Sequence
gaccgtgcctcatctgcacg

SEQ ID NO: 8183 - DNA, 20 bp, Artificial Sequence
  Description of Artificial Sequence:  Hypothetical Probe Sequence
gaccgtgcttaggcttacgg

SEQ ID NO: 8184 - DNA, 20 bp, Artificial Sequence
  Description of Artificial Sequence:  Hypothetical Probe Sequence
gtgcatactcgtcttgcagc

SEQ ID NO: 8185 - DNA, 20 bp, Artificial Sequence
  Description of Artificial Sequence:  Hypothetical Probe Sequence
gaccgtgccgaaggtaagtg

SEQ ID NO: 8186 - DNA, 20 bp, Artificial Sequence
  Description of Artificial Sequence:  Hypothetical Probe Sequence
gaccgtgcgtctctcaaaag

SEQ ID NO: 8187 - DNA, 20 bp, Artificial Sequence
  Description of Artificial Sequence:  Hypothetical Probe Sequence
gaccgtgcgcaatcgtgtct

SEQ ID NO: 8188 - DNA, 20 bp, Artificial Sequence
  Description of Artificial Sequence:  Hypothetical Probe Sequence
gaccgtgcagtgtctgtgcg

SEQ ID NO: 8189 - DNA, 20 bp, Artificial Sequence
  Description of Artificial Sequence:  Hypothetical Probe Sequence
gaccgtgcacctctcacgaa

SEQ ID NO: 8190 - DNA, 20 bp, Artificial Sequence
  Description of Artificial Sequence:  Hypothetical Probe Sequence
gaccgtgcaggaccatggac

SEQ ID NO: 8191 - DNA, 20 bp, Artificial Sequence
  Description of Artificial Sequence:  Hypothetical Probe Sequence
gaccgtgctgcggtctgcaa

SEQ ID NO: 8192 - DNA, 20 bp, Artificial Sequence
  Description of Artificial Sequence:  Hypothetical Probe Sequence
gaccgtgccacgctcacttg

SEQ ID NO: 8193 - DNA, 20 bp, Artificial Sequence
  Description of Artificial Sequence:  Hypothetical Probe Sequence
gaccgtgccagcctcatctg

SEQ ID NO: 8194 - DNA, 20 bp, Artificial Sequence
  Description of Artificial Sequence:  Hypothetical Probe Sequence
gaccgtgcgtgcgcttgagt

SEQ ID NO: 8195 - DNA, 20 bp, Artificial Sequence
  Description of Artificial Sequence:  Hypothetical Probe Sequence
gaccggaccgttcagcgatg

SEQ ID NO: 8196 - DNA, 20 bp, Artificial Sequence
  Description of Artificial Sequence:  Hypothetical Probe Sequence
gaccggacctgtggaccgtt

SEQ ID NO: 8197 - DNA, 20 bp, Artificial Sequence
  Description of Artificial Sequence:  Hypothetical Probe Sequence
ggaccgaaaatctgtcacgg

SEQ ID NO: 8198 - DNA, 20 bp, Artificial Sequence
  Description of Artificial Sequence:  Hypothetical Probe Sequence
gaccggacgcaagcaagcaa

SEQ ID NO: 8199 - DNA, 20 bp, Artificial Sequence
  Description of Artificial Sequence:  Hypothetical Probe Sequence
gaccggacatcgatcgatcg

SEQ ID NO: 8200 - DNA, 20 bp, Artificial Sequence
  Description of Artificial Sequence:  Hypothetical Probe Sequence
ggaccagcgtctcagcagcc

SEQ ID NO: 8201 - DNA, 20 bp, Artificial Sequence
  Description of Artificial Sequence:  Hypothetical Probe Sequence
gaccggacgaccctcacacg

SEQ ID NO: 8202 - DNA, 20 bp, Artificial Sequence
  Description of Artificial Sequence:  Hypothetical Probe Sequence
gaccggacgtgcctcaatcg

SEQ ID NO: 8203 - DNA, 20 bp, Artificial Sequence
  Description of Artificial Sequence:  Hypothetical Probe Sequence
gaccggacacgggtctgctt

SEQ ID NO: 8204 - DNA, 20 bp, Artificial Sequence
  Description of Artificial Sequence:  Hypothetical Probe Sequence
acggtcgtaatcgatgtccc

SEQ ID NO: 8205 - DNA, 20 bp, Artificial Sequence
  Description of Artificial Sequence:  Hypothetical Probe Sequence
acggcttgatcgtgatgctt

SEQ ID NO: 8206 - DNA, 20 bp, Artificial Sequence
  Description of Artificial Sequence:  Hypothetical Probe Sequence
gaccacggcgttgtctgtgc

SEQ ID NO: 8207 - DNA, 20 bp, Artificial Sequence
  Description of Artificial Sequence:  Hypothetical Probe Sequence
acggctgtataccacgtgcg

SEQ ID NO: 8208 - DNA, 20 bp, Artificial Sequence
  Description of Artificial Sequence:  Hypothetical Probe Sequence
acggggtattagacggcttg

SEQ ID NO: 8209 - DNA, 20 bp, Artificial Sequence
  Description of Artificial Sequence:  Hypothetical Probe Sequence
acgggtctaggatgtcgctt

SEQ ID NO: 8210 - DNA, 20 bp, Artificial Sequence
  Description of Artificial Sequence:  Hypothetical Probe Sequence
acgggagtatacagccgtgc

SEQ ID NO: 8211 - DNA, 20 bp, Artificial Sequence
  Description of Artificial Sequence:  Hypothetical Probe Sequence
acggcagctcgtttagagcc

SEQ ID NO: 8212 - DNA, 20 bp, Artificial Sequence
  Description of Artificial Sequence:  Hypothetical Probe Sequence
gaccacggagccagccacct

SEQ ID NO: 8213 - DNA, 20 bp, Artificial Sequence
  Description of Artificial Sequence:  Hypothetical Probe Sequence
gaccagccaatcacggctgt

SEQ ID NO: 8214 - DNA, 20 bp, Artificial Sequence
  Description of Artificial Sequence:  Hypothetical Probe Sequence
gaccagccaaagcgttgcaa

SEQ ID NO: 8215 - DNA, 20 bp, Artificial Sequence
  Description of Artificial Sequence:  Hypothetical Probe Sequence
agcctcgtccataatcacgg

SEQ ID NO: 8216 - DNA, 20 bp, Artificial Sequence
  Description of Artificial Sequence:  Hypothetical Probe Sequence
gaccagccccatgcttcgtt

SEQ ID NO: 8217 - DNA, 20 bp, Artificial Sequence
  Description of Artificial Sequence:  Hypothetical Probe Sequence
gaccagccgcttcgaactca

SEQ ID NO: 8218 - DNA, 20 bp, Artificial Sequence
  Description of Artificial Sequence:  Hypothetical Probe Sequence
agccagtgagccagccccat

SEQ ID NO: 8219 - DNA, 20 bp, Artificial Sequence
  Description of Artificial Sequence:  Hypothetical Probe Sequence
agccatcgtacaatcgcgtt

SEQ ID NO: 8220 - DNA, 20 bp, Artificial Sequence
  Description of Artificial Sequence:  Hypothetical Probe Sequence
gaccagcccctaaatctgcg

SEQ ID NO: 8221 - DNA, 20 bp, Artificial Sequence
  Description of Artificial Sequence:  Hypothetical Probe Sequence
agcctcccggacagtgccat

SEQ ID NO: 8222 - DNA, 20 bp, Artificial Sequence
  Description of Artificial Sequence:  Hypothetical Probe Sequence
gaccagcctgcgtgtccgtt

SEQ ID NO: 8223 - DNA, 20 bp, Artificial Sequence
  Description of Artificial Sequence:  Hypothetical Probe Sequence
gaccagccgaccgatgctca

SEQ ID NO: 8224 - DNA, 20 bp, Artificial Sequence
  Description of Artificial Sequence:  Hypothetical Probe Sequence
ttgagcttatcggcaatgcg

SEQ ID NO: 8225 - DNA, 20 bp, Artificial Sequence
  Description of Artificial Sequence:  Hypothetical Probe Sequence
ttgagtgcgtgctgcgcgaa

SEQ ID NO: 8226 - DNA, 20 bp, Artificial Sequence
  Description of Artificial Sequence:  Hypothetical Probe Sequence
tgatccatgtgccttgacgg

SEQ ID NO: 8227 - DNA, 20 bp, Artificial Sequence
  Description of Artificial Sequence:  Hypothetical Probe Sequence
tgatgtgccgtttgcgggac

SEQ ID NO: 8228 - DNA, 20 bp, Artificial Sequence
  Description of Artificial Sequence:  Hypothetical Probe Sequence
gtgcaatccgaacgttggac

SEQ ID NO: 8229 - DNA, 20 bp, Artificial Sequence
  Description of Artificial Sequence:  Hypothetical Probe Sequence
gtgcaatcggtatcgtcgaa

SEQ ID NO: 8230 - DNA, 20 bp, Artificial Sequence
  Description of Artificial Sequence:  Hypothetical Probe Sequence
gtgcaatcgatgagccccat

SEQ ID NO: 8231 - DNA, 20 bp, Artificial Sequence
  Description of Artificial Sequence:  Hypothetical Probe Sequence
aatctcccgcaaatactgcg

SEQ ID NO: 8232 - DNA, 20 bp, Artificial Sequence
  Description of Artificial Sequence:  Hypothetical Probe Sequence
gtgcaatccacggatgtctg

SEQ ID NO: 8233 - DNA, 20 bp, Artificial Sequence
  Description of Artificial Sequence:  Hypothetical Probe Sequence
gtgcaatccagcagcccacg

SEQ ID NO: 8234 - DNA, 20 bp, Artificial Sequence
  Description of Artificial Sequence:  Hypothetical Probe Sequence
gtgcataccacggcaaatcg

SEQ ID NO: 8235 - DNA, 20 bp, Artificial Sequence
  Description of Artificial Sequence:  Hypothetical Probe Sequence
gtgcatacagccacggtgcg

SEQ ID NO: 8236 - DNA, 20 bp, Artificial Sequence
  Description of Artificial Sequence:  Hypothetical Probe Sequence
aaagtcgtcgaacacgcgaa

SEQ ID NO: 8237 - DNA, 20 bp, Artificial Sequence
  Description of Artificial Sequence:  Hypothetical Probe Sequence
gtgcaaagcctaatcggcaa

SEQ ID NO: 8238 - DNA, 20 bp, Artificial Sequence
  Description of Artificial Sequence:  Hypothetical Probe Sequence
aaagcagccagcagtgagcc

SEQ ID NO: 8239 - DNA, 20 bp, Artificial Sequence
  Description of Artificial Sequence:  Hypothetical Probe Sequence
gtgcaaaggaccatcggctt

SEQ ID NO: 8240 - DNA, 20 bp, Artificial Sequence
  Description of Artificial Sequence:  Hypothetical Probe Sequence
tctgggtaatcgggactgcg

SEQ ID NO: 8241 - DNA, 20 bp, Artificial Sequence
  Description of Artificial Sequence:  Hypothetical Probe Sequence
tctgcctagctttgcgcacg

SEQ ID NO: 8242 - DNA, 20 bp, Artificial Sequence
  Description of Artificial Sequence:  Hypothetical Probe Sequence
tctgtgcgcgttagtgcgaa

SEQ ID NO: 8243 - DNA, 20 bp, Artificial Sequence
  Description of Artificial Sequence:  Hypothetical Probe Sequence
gtgctgtccgaaacggctgt

SEQ ID NO: 8244 - DNA, 20 bp, Artificial Sequence
  Description of Artificial Sequence:  Hypothetical Probe Sequence
gtgctgtccacgggacacgg

SEQ ID NO: 8245 - DNA, 20 bp, Artificial Sequence
  Description of Artificial Sequence:  Hypothetical Probe Sequence
tgtcgaccgacccagcctca

SEQ ID NO: 8246 - DNA, 20 bp, Artificial Sequence
  Description of Artificial Sequence:  Hypothetical Probe Sequence
tgtcacgggtcttcccggac

SEQ ID NO: 8247 - DNA, 20 bp, Artificial Sequence
  Description of Artificial Sequence:  Hypothetical Probe Sequence
tcgttgatagccgcttcacg

SEQ ID NO: 8248 - DNA, 20 bp, Artificial Sequence
  Description of Artificial Sequence:  Hypothetical Probe Sequence
tcgtcttgtgtcacggcgaa

SEQ ID NO: 8249 - DNA, 20 bp, Artificial Sequence
  Description of Artificial Sequence:  Hypothetical Probe Sequence
tcgtaggaaatcagccgcaa

SEQ ID NO: 8250 - DNA, 20 bp, Artificial Sequence
  Description of Artificial Sequence:  Hypothetical Probe Sequence
tcgttccccgttttgacacg

SEQ ID NO: 8251 - DNA, 20 bp, Artificial Sequence
  Description of Artificial Sequence:  Hypothetical Probe Sequence
tcgtggacggacgcttccat

SEQ ID NO: 8252 - DNA, 20 bp, Artificial Sequence
  Description of Artificial Sequence:  Hypothetical Probe Sequence
tcgtagcctctgacggggac

SEQ ID NO: 8253 - DNA, 20 bp, Artificial Sequence
  Description of Artificial Sequence:  Hypothetical Probe Sequence
gtgccttgttgatcccgtgc

SEQ ID NO: 8254 - DNA, 20 bp, Artificial Sequence
  Description of Artificial Sequence:  Hypothetical Probe Sequence
cttgaaaggcaacttgcgaa

SEQ ID NO: 8255 - DNA, 20 bp, Artificial Sequence
  Description of Artificial Sequence:  Hypothetical Probe Sequence
gtgccttggtctggactgcg

SEQ ID NO: 8256 - DNA, 20 bp, Artificial Sequence
  Description of Artificial Sequence:  Hypothetical Probe Sequence
gtgccttgaggagtgctccc

SEQ ID NO: 8257 - DNA, 20 bp, Artificial Sequence
  Description of Artificial Sequence:  Hypothetical Probe Sequence
gtgccttgcctatcgtatcg

SEQ ID NO: 8258 - DNA, 20 bp, Artificial Sequence
  Description of Artificial Sequence:  Hypothetical Probe Sequence
gtgccttggatggcttcgaa

SEQ ID NO: 8259 - DNA, 20 bp, Artificial Sequence
  Description of Artificial Sequence:  Hypothetical Probe Sequence
gtgccttgcagctgtcagtg

SEQ ID NO: 8260 - DNA, 20 bp, Artificial Sequence
  Description of Artificial Sequence:  Hypothetical Probe Sequence
cgttttgaaggagacctgcg

SEQ ID NO: 8261 - DNA, 20 bp, Artificial Sequence
  Description of Artificial Sequence:  Hypothetical Probe Sequence
cgttttagatcggatgcgaa

SEQ ID NO: 8262 - DNA, 20 bp, Artificial Sequence
  Description of Artificial Sequence:  Hypothetical Probe Sequence
cgtttctgtgcgatacgctt

SEQ ID NO: 8263 - DNA, 20 bp, Artificial Sequence
  Description of Artificial Sequence:  Hypothetical Probe Sequence
cgttctgtaatcgtgcagcc

SEQ ID NO: 8264 - DNA, 20 bp, Artificial Sequence
  Description of Artificial Sequence:  Hypothetical Probe Sequence
gtgccgttccatttgacacg

SEQ ID NO: 8265 - DNA, 20 bp, Artificial Sequence
  Description of Artificial Sequence:  Hypothetical Probe Sequence
gtgccgttggtagacccgtt

SEQ ID NO: 8266 - DNA, 20 bp, Artificial Sequence
  Description of Artificial Sequence:  Hypothetical Probe Sequence
gtgccgttgagtagccgcaa

SEQ ID NO: 8267 - DNA, 20 bp, Artificial Sequence
  Description of Artificial Sequence:  Hypothetical Probe Sequence
gtgccgttgatgtctggctt

SEQ ID NO: 8268 - DNA, 20 bp, Artificial Sequence
  Description of Artificial Sequence:  Hypothetical Probe Sequence
cgtttcccttagtccccagc

SEQ ID NO: 8269 - DNA, 20 bp, Artificial Sequence
  Description of Artificial Sequence:  Hypothetical Probe Sequence
gtgccgttggacgaccaatc

SEQ ID NO: 8270 - DNA, 20 bp, Artificial Sequence
  Description of Artificial Sequence:  Hypothetical Probe Sequence
ctcattgacacgggtatgcg

SEQ ID NO: 8271 - DNA, 20 bp, Artificial Sequence
  Description of Artificial Sequence:  Hypothetical Probe Sequence
gtgcctcaccatagcccgtt

SEQ ID NO: 8272 - DNA, 20 bp, Artificial Sequence
  Description of Artificial Sequence:  Hypothetical Probe Sequence
ctcaagtgggaccagccacg

SEQ ID NO: 8273 - DNA, 20 bp, Artificial Sequence
  Description of Artificial Sequence:  Hypothetical Probe Sequence
gtgcctcacctacttgacgg

SEQ ID NO: 8274 - DNA, 20 bp, Artificial Sequence
  Description of Artificial Sequence:  Hypothetical Probe Sequence
ctcatccctgatgatgcacg

SEQ ID NO: 8275 - DNA, 20 bp, Artificial Sequence
  Description of Artificial Sequence:  Hypothetical Probe Sequence
ctcaagcctgatggacgtgc

SEQ ID NO: 8276 - DNA, 20 bp, Artificial Sequence
  Description of Artificial Sequence:  Hypothetical Probe Sequence
ctgttctgtgcgtcccgtgc

SEQ ID NO: 8277 - DNA, 20 bp, Artificial Sequence
  Description of Artificial Sequence:  Hypothetical Probe Sequence
ctgtgatgcacggctttgcg

SEQ ID NO: 8278 - DNA, 20 bp, Artificial Sequence
  Description of Artificial Sequence:  Hypothetical Probe Sequence
gtgcccatttgacgaagtgc

SEQ ID NO: 8279 - DNA, 20 bp, Artificial Sequence
  Description of Artificial Sequence:  Hypothetical Probe Sequence
ccattctgatcgtcccgctt

SEQ ID NO: 8280 - DNA, 20 bp, Artificial Sequence
  Description of Artificial Sequence:  Hypothetical Probe Sequence
ccattgtctgtccagcgctt

SEQ ID NO: 8281 - DNA, 20 bp, Artificial Sequence
  Description of Artificial Sequence:  Hypothetical Probe Sequence
gtgcccattcgtacgggtct

SEQ ID NO: 8282 - DNA, 20 bp, Artificial Sequence
  Description of Artificial Sequence:  Hypothetical Probe Sequence
ccatctcaatacggacgcaa

SEQ ID NO: 8283 - DNA, 20 bp, Artificial Sequence
  Description of Artificial Sequence:  Hypothetical Probe Sequence
gtgcccataggagtgcgatg

SEQ ID NO: 8284 - DNA, 20 bp, Artificial Sequence
  Description of Artificial Sequence:  Hypothetical Probe Sequence
gtgcccatcctacacggacc

SEQ ID NO: 8285 - DNA, 20 bp, Artificial Sequence
  Description of Artificial Sequence:  Hypothetical Probe Sequence
gtgcccattgcggagtacgg

SEQ ID NO: 8286 - DNA, 20 bp, Artificial Sequence
  Description of Artificial Sequence:  Hypothetical Probe Sequence
ccatcagcctgtaccttgcg

SEQ ID NO: 8287 - DNA, 20 bp, Artificial Sequence
  Description of Artificial Sequence:  Hypothetical Probe Sequence
cgaattgagatggatgcacg

SEQ ID NO: 8288 - DNA, 20 bp, Artificial Sequence
  Description of Artificial Sequence:  Hypothetical Probe Sequence
gtgccgaatgataatccagc

SEQ ID NO: 8289 - DNA, 20 bp, Artificial Sequence
  Description of Artificial Sequence:  Hypothetical Probe Sequence
gtgccgaaaatcaatcgagt

SEQ ID NO: 8290 - DNA, 20 bp, Artificial Sequence
  Description of Artificial Sequence:  Hypothetical Probe Sequence
gtgccgaaaaagggtatccc

SEQ ID NO: 8291 - DNA, 20 bp, Artificial Sequence
  Description of Artificial Sequence:  Hypothetical Probe Sequence
cgaatgtcgatgtgattgcg

SEQ ID NO: 8292 - DNA, 20 bp, Artificial Sequence
  Description of Artificial Sequence:  Hypothetical Probe Sequence
gtgccgaacgtttgatgacc

SEQ ID NO: 8293 - DNA, 20 bp, Artificial Sequence
  Description of Artificial Sequence:  Hypothetical Probe Sequence
gtgccgaaccattcgtcagc

SEQ ID NO: 8294 - DNA, 20 bp, Artificial Sequence
  Description of Artificial Sequence:  Hypothetical Probe Sequence
gtgccgaaagtgaatcgcaa

SEQ ID NO: 8295 - DNA, 20 bp, Artificial Sequence
  Description of Artificial Sequence:  Hypothetical Probe Sequence
gtgccgaacacgcgttgagt

SEQ ID NO: 8296 - DNA, 20 bp, Artificial Sequence
  Description of Artificial Sequence:  Hypothetical Probe Sequence
cgaaggacctgtaaagcacg

SEQ ID NO: 8297 - DNA, 20 bp, Artificial Sequence
  Description of Artificial Sequence:  Hypothetical Probe Sequence
gtgccgaaacggccatcgaa

SEQ ID NO: 8298 - DNA, 20 bp, Artificial Sequence
  Description of Artificial Sequence:  Hypothetical Probe Sequence
gtgcgcttttagtcgtgtgc

SEQ ID NO: 8299 - DNA, 20 bp, Artificial Sequence
  Description of Artificial Sequence:  Hypothetical Probe Sequence
gtgcgcttaaagagtgcacg

SEQ ID NO: 8300 - DNA, 20 bp, Artificial Sequence
  Description of Artificial Sequence:  Hypothetical Probe Sequence
gtgcgctttacaaaagcacg

SEQ ID NO: 8301 - DNA, 20 bp, Artificial Sequence
  Description of Artificial Sequence:  Hypothetical Probe Sequence
gtgcgcttctcactcaggac

SEQ ID NO: 8302 - DNA, 20 bp, Artificial Sequence
  Description of Artificial Sequence:  Hypothetical Probe Sequence
gtgcgcttggtagtctacgg

SEQ ID NO: 8303 - DNA, 20 bp, Artificial Sequence
  Description of Artificial Sequence:  Hypothetical Probe Sequence
gtgcgcttaggaccatcgtt

SEQ ID NO: 8304 - DNA, 20 bp, Artificial Sequence
  Description of Artificial Sequence:  Hypothetical Probe Sequence
gtgcgcttgatgcttgggta

SEQ ID NO: 8305 - DNA, 20 bp, Artificial Sequence
  Description of Artificial Sequence:  Hypothetical Probe Sequence
gtgcgctttccccgaattga

SEQ ID NO: 8306 - DNA, 20 bp, Artificial Sequence
  Description of Artificial Sequence:  Hypothetical Probe Sequence
gtgcgcttgacctctgggta

SEQ ID NO: 8307 - DNA, 20 bp, Artificial Sequence
  Description of Artificial Sequence:  Hypothetical Probe Sequence
gtgcgcttggactgtcgatg

SEQ ID NO: 8308 - DNA, 20 bp, Artificial Sequence
  Description of Artificial Sequence:  Hypothetical Probe Sequence
gtgcggtaaaaggaccggac

SEQ ID NO: 8309 - DNA, 20 bp, Artificial Sequence
  Description of Artificial Sequence:  Hypothetical Probe Sequence
gtgcggtacgtttctggacc

SEQ ID NO: 8310 - DNA, 20 bp, Artificial Sequence
  Description of Artificial Sequence:  Hypothetical Probe Sequence
gtgcggtacgaatgcgagga

SEQ ID NO: 8311 - DNA, 20 bp, Artificial Sequence
  Description of Artificial Sequence:  Hypothetical Probe Sequence
gtgcggtagcaaaggacagc

SEQ ID NO: 8312 - DNA, 20 bp, Artificial Sequence
  Description of Artificial Sequence:  Hypothetical Probe Sequence
gtgcggtacctaacgggtgc

SEQ ID NO: 8313 - DNA, 20 bp, Artificial Sequence
  Description of Artificial Sequence:  Hypothetical Probe Sequence
gtgcggtaagccggactctg

SEQ ID NO: 8314 - DNA, 20 bp, Artificial Sequence
  Description of Artificial Sequence:  Hypothetical Probe Sequence
gtgcgtctttgacctatgcg

SEQ ID NO: 8315 - DNA, 20 bp, Artificial Sequence
  Description of Artificial Sequence:  Hypothetical Probe Sequence
gtgcgtcttgtcgcaacgaa

SEQ ID NO: 8316 - DNA, 20 bp, Artificial Sequence
  Description of Artificial Sequence:  Hypothetical Probe Sequence
gtgcgtctggtaatcggtgc

SEQ ID NO: 8317 - DNA, 20 bp, Artificial Sequence
  Description of Artificial Sequence:  Hypothetical Probe Sequence
gtgcgtctatcggcttacgg

SEQ ID NO: 8318 - DNA, 20 bp, Artificial Sequence
  Description of Artificial Sequence:  Hypothetical Probe Sequence
gtgcgtctgatgcttggtgc

SEQ ID NO: 8319 - DNA, 20 bp, Artificial Sequence
  Description of Artificial Sequence:  Hypothetical Probe Sequence
gtgcgtcttcccgtctgctt

SEQ ID NO: 8320 - DNA, 20 bp, Artificial Sequence
  Description of Artificial Sequence:  Hypothetical Probe Sequence
gtgcgagtaggagcaatgcg

SEQ ID NO: 8321 - DNA, 20 bp, Artificial Sequence
  Description of Artificial Sequence:  Hypothetical Probe Sequence
gtgcgagtgatgcagccagc

SEQ ID NO: 8322 - DNA, 20 bp, Artificial Sequence
  Description of Artificial Sequence:  Hypothetical Probe Sequence
gtgcgagttcccgtctcagc

SEQ ID NO: 8323 - DNA, 20 bp, Artificial Sequence
  Description of Artificial Sequence:  Hypothetical Probe Sequence
gtgcgagttgcgaatccgtt

SEQ ID NO: 8324 - DNA, 20 bp, Artificial Sequence
  Description of Artificial Sequence:  Hypothetical Probe Sequence
gtgcgcaattgattagagcc

SEQ ID NO: 8325 - DNA, 20 bp, Artificial Sequence
  Description of Artificial Sequence:  Hypothetical Probe Sequence
gtgcgcaaataccagcaaag

SEQ ID NO: 8326 - DNA, 20 bp, Artificial Sequence
  Description of Artificial Sequence:  Hypothetical Probe Sequence
gcaatacaagccctgttgcg

SEQ ID NO: 8327 - DNA, 20 bp, Artificial Sequence
  Description of Artificial Sequence:  Hypothetical Probe Sequence
gtgcgcaatgtctctgggac

SEQ ID NO: 8328 - DNA, 20 bp, Artificial Sequence
  Description of Artificial Sequence:  Hypothetical Probe Sequence
gtgcgcaactcaggacatcg

SEQ ID NO: 8329 - DNA, 20 bp, Artificial Sequence
  Description of Artificial Sequence:  Hypothetical Probe Sequence
gtgcgcaactgtgatggacc

SEQ ID NO: 8330 - DNA, 20 bp, Artificial Sequence
  Description of Artificial Sequence:  Hypothetical Probe Sequence
gtgcgcaaggtatacagcaa

SEQ ID NO: 8331 - DNA, 20 bp, Artificial Sequence
  Description of Artificial Sequence:  Hypothetical Probe Sequence
gtgcgcaaagtgatacagga

SEQ ID NO: 8332 - DNA, 20 bp, Artificial Sequence
  Description of Artificial Sequence:  Hypothetical Probe Sequence
gtgcgcaaaccttcgtgacc

SEQ ID NO: 8333 - DNA, 20 bp, Artificial Sequence
  Description of Artificial Sequence:  Hypothetical Probe Sequence
gtgcgcaaatcgtacacacg

SEQ ID NO: 8334 - DNA, 20 bp, Artificial Sequence
  Description of Artificial Sequence:  Hypothetical Probe Sequence
gtgcgcaagatgagtgacgg

SEQ ID NO: 8335 - DNA, 20 bp, Artificial Sequence
  Description of Artificial Sequence:  Hypothetical Probe Sequence
gtgcgcaatgcggcttggac

SEQ ID NO: 8336 - DNA, 20 bp, Artificial Sequence
  Description of Artificial Sequence:  Hypothetical Probe Sequence
gtgcgcaagtgcaggacgtt

SEQ ID NO: 8337 - DNA, 20 bp, Artificial Sequence
  Description of Artificial Sequence:  Hypothetical Probe Sequence
gtgcagtggcttacggccta

SEQ ID NO: 8338 - DNA, 20 bp, Artificial Sequence
  Description of Artificial Sequence:  Hypothetical Probe Sequence
agtggatggcaatgcgccat

SEQ ID NO: 8339 - DNA, 20 bp, Artificial Sequence
  Description of Artificial Sequence:  Hypothetical Probe Sequence
agtgtgcggctttgtctgcg

SEQ ID NO: 8340 - DNA, 20 bp, Artificial Sequence
  Description of Artificial Sequence:  Hypothetical Probe Sequence
gtgcagtgggacatcggatg

SEQ ID NO: 8341 - DNA, 20 bp, Artificial Sequence
  Description of Artificial Sequence:  Hypothetical Probe Sequence
agtgacggcagcgtctcacg

SEQ ID NO: 8342 - DNA, 20 bp, Artificial Sequence
  Description of Artificial Sequence:  Hypothetical Probe Sequence
agtgagccaatcgaccgacc

SEQ ID NO: 8343 - DNA, 20 bp, Artificial Sequence
  Description of Artificial Sequence:  Hypothetical Probe Sequence
acctgatgacgggtgcgtgc

SEQ ID NO: 8344 - DNA, 20 bp, Artificial Sequence
  Description of Artificial Sequence:  Hypothetical Probe Sequence
acctcacgcacgaatccgaa

SEQ ID NO: 8345 - DNA, 20 bp, Artificial Sequence
  Description of Artificial Sequence:  Hypothetical Probe Sequence
gtgcacctacggccatttga

SEQ ID NO: 8346 - DNA, 20 bp, Artificial Sequence
  Description of Artificial Sequence:  Hypothetical Probe Sequence
atcgtgatcagcacgggcaa

SEQ ID NO: 8347 - DNA, 20 bp, Artificial Sequence
  Description of Artificial Sequence:  Hypothetical Probe Sequence
gtgcatcgcttgctcaacgg

SEQ ID NO: 8348 - DNA, 20 bp, Artificial Sequence
  Description of Artificial Sequence:  Hypothetical Probe Sequence
atcgctgtttagagcctgcg

SEQ ID NO: 8349 - DNA, 20 bp, Artificial Sequence
  Description of Artificial Sequence:  Hypothetical Probe Sequence
gtgcatcggtctgtgcgacc

SEQ ID NO: 8350 - DNA, 20 bp, Artificial Sequence
  Description of Artificial Sequence:  Hypothetical Probe Sequence
gtgcatcgaccttgcgcacg

SEQ ID NO: 8351 - DNA, 20 bp, Artificial Sequence
  Description of Artificial Sequence:  Hypothetical Probe Sequence
atcgatcgtgatagccgacc

SEQ ID NO: 8352 - DNA, 20 bp, Artificial Sequence
  Description of Artificial Sequence:  Hypothetical Probe Sequence
gtgcatcgtccccttgtccc

SEQ ID NO: 8353 - DNA, 20 bp, Artificial Sequence
  Description of Artificial Sequence:  Hypothetical Probe Sequence
gtgcatcgcacgcacggctt

SEQ ID NO: 8354 - DNA, 20 bp, Artificial Sequence
  Description of Artificial Sequence:  Hypothetical Probe Sequence
gtgcatcgcagccgtttcgt

SEQ ID NO: 8355 - DNA, 20 bp, Artificial Sequence
  Description of Artificial Sequence:  Hypothetical Probe Sequence
gtgcatcgacgggcaatgat

SEQ ID NO: 8356 - DNA, 20 bp, Artificial Sequence
  Description of Artificial Sequence:  Hypothetical Probe Sequence
aggatcgttgtctcccgcaa

SEQ ID NO: 8357 - DNA, 20 bp, Artificial Sequence
  Description of Artificial Sequence:  Hypothetical Probe Sequence
aggacttgcgaaatcgagcc

SEQ ID NO: 8358 - DNA, 20 bp, Artificial Sequence
  Description of Artificial Sequence:  Hypothetical Probe Sequence
gtgcaggagcttgcttcgtt

SEQ ID NO: 8359 - DNA, 20 bp, Artificial Sequence
  Description of Artificial Sequence:  Hypothetical Probe Sequence
aggaaggaaatcgacccgaa

SEQ ID NO: 8360 - DNA, 20 bp, Artificial Sequence
  Description of Artificial Sequence:  Hypothetical Probe Sequence
gtgcaggacacgtgtcgcaa

SEQ ID NO: 8361 - DNA, 20 bp, Artificial Sequence
  Description of Artificial Sequence:  Hypothetical Probe Sequence
gtgcaggacagccgaacgaa

SEQ ID NO: 8362 - DNA, 20 bp, Artificial Sequence
  Description of Artificial Sequence:  Hypothetical Probe Sequence
aggagacccgaagaccacgg

SEQ ID NO: 8363 - DNA, 20 bp, Artificial Sequence
  Description of Artificial Sequence:  Hypothetical Probe Sequence
gtgcaggagtgccgttagcc

SEQ ID NO: 8364 - DNA, 20 bp, Artificial Sequence
  Description of Artificial Sequence:  Hypothetical Probe Sequence
gtgcaggaacggctgtcgtt

SEQ ID NO: 8365 - DNA, 20 bp, Artificial Sequence
  Description of Artificial Sequence:  Hypothetical Probe Sequence
gtgccctaaaaggacctccc

SEQ ID NO: 8366 - DNA, 20 bp, Artificial Sequence
  Description of Artificial Sequence:  Hypothetical Probe Sequence
cctatgtccgaaatcgcacg

SEQ ID NO: 8367 - DNA, 20 bp, Artificial Sequence
  Description of Artificial Sequence:  Hypothetical Probe Sequence
cctacgttggtagctttgcg

SEQ ID NO: 8368 - DNA, 20 bp, Artificial Sequence
  Description of Artificial Sequence:  Hypothetical Probe Sequence
cctaccattctgcacgcgaa

SEQ ID NO: 8369 - DNA, 20 bp, Artificial Sequence
  Description of Artificial Sequence:  Hypothetical Probe Sequence
gtgccctagacctgtcgcaa

SEQ ID NO: 8370 - DNA, 20 bp, Artificial Sequence
  Description of Artificial Sequence:  Hypothetical Probe Sequence
gtgccctaagcctcgtctgt

SEQ ID NO: 8371 - DNA, 20 bp, Artificial Sequence
  Description of Artificial Sequence:  Hypothetical Probe Sequence
gtgcgatgtgatatcgcgaa

SEQ ID NO: 8372 - DNA, 20 bp, Artificial Sequence
  Description of Artificial Sequence:  Hypothetical Probe Sequence
gtgcgatgtctgtgcgagcc

SEQ ID NO: 8373 - DNA, 20 bp, Artificial Sequence
  Description of Artificial Sequence:  Hypothetical Probe Sequence
gtgcgatgcttggcaattag

SEQ ID NO: 8374 - DNA, 20 bp, Artificial Sequence
  Description of Artificial Sequence:  Hypothetical Probe Sequence
gtgcgatgatcgctgtgtgc

SEQ ID NO: 8375 - DNA, 20 bp, Artificial Sequence
  Description of Artificial Sequence:  Hypothetical Probe Sequence
gtgcgatgtcccggacgcaa

SEQ ID NO: 8376 - DNA, 20 bp, Artificial Sequence
  Description of Artificial Sequence:  Hypothetical Probe Sequence
tcccttagcttggtgctgcg

SEQ ID NO: 8377 - DNA, 20 bp, Artificial Sequence
  Description of Artificial Sequence:  Hypothetical Probe Sequence
tccccttggagttgattgcg

SEQ ID NO: 8378 - DNA, 20 bp, Artificial Sequence
  Description of Artificial Sequence:  Hypothetical Probe Sequence
tccccgttctgtctgttgcg

SEQ ID NO: 8379 - DNA, 20 bp, Artificial Sequence
  Description of Artificial Sequence:  Hypothetical Probe Sequence
tcccgagttacagtgccacg

SEQ ID NO: 8380 - DNA, 20 bp, Artificial Sequence
  Description of Artificial Sequence:  Hypothetical Probe Sequence
tcccacctgacccctatccc

SEQ ID NO: 8381 - DNA, 20 bp, Artificial Sequence
  Description of Artificial Sequence:  Hypothetical Probe Sequence
gtgctcccatcgatcgcgtt

SEQ ID NO: 8382 - DNA, 20 bp, Artificial Sequence
  Description of Artificial Sequence:  Hypothetical Probe Sequence
tcccgtgcagtgtcccggta

SEQ ID NO: 8383 - DNA, 20 bp, Artificial Sequence
  Description of Artificial Sequence:  Hypothetical Probe Sequence
gtgctcccggacttgagtgc

SEQ ID NO: 8384 - DNA, 20 bp, Artificial Sequence
  Description of Artificial Sequence:  Hypothetical Probe Sequence
tcccagccgtcttctgcacg

SEQ ID NO: 8385 - DNA, 20 bp, Artificial Sequence
  Description of Artificial Sequence:  Hypothetical Probe Sequence
gtgctgcgtctgtctgcacg

SEQ ID NO: 8386 - DNA, 20 bp, Artificial Sequence
  Description of Artificial Sequence:  Hypothetical Probe Sequence
gtgctgcgctgtgcaaaatc

SEQ ID NO: 8387 - DNA, 20 bp, Artificial Sequence
  Description of Artificial Sequence:  Hypothetical Probe Sequence
tgcggagtaaagagccccta

SEQ ID NO: 8388 - DNA, 20 bp, Artificial Sequence
  Description of Artificial Sequence:  Hypothetical Probe Sequence
tgcgtccctacacagctccc

SEQ ID NO: 8389 - DNA, 20 bp, Artificial Sequence
  Description of Artificial Sequence:  Hypothetical Probe Sequence
tgcgcacggcttgtctgtgc

SEQ ID NO: 8390 - DNA, 20 bp, Artificial Sequence
  Description of Artificial Sequence:  Hypothetical Probe Sequence
gtgctgcgcagcaaagcacg

SEQ ID NO: 8391 - DNA, 20 bp, Artificial Sequence
  Description of Artificial Sequence:  Hypothetical Probe Sequence
tgcggacctctgagtgtgcg

SEQ ID NO: 8392 - DNA, 20 bp, Artificial Sequence
  Description of Artificial Sequence:  Hypothetical Probe Sequence
tgcgagccgcaagatgcttg

SEQ ID NO: 8393 - DNA, 20 bp, Artificial Sequence
  Description of Artificial Sequence:  Hypothetical Probe Sequence
gtgccacgttaggtgcgtgc

SEQ ID NO: 8394 - DNA, 20 bp, Artificial Sequence
  Description of Artificial Sequence:  Hypothetical Probe Sequence
gtgccacgtctgagtggacc

SEQ ID NO: 8395 - DNA, 20 bp, Artificial Sequence
  Description of Artificial Sequence:  Hypothetical Probe Sequence
gtgccacgggtaacctagga

SEQ ID NO: 8396 - DNA, 20 bp, Artificial Sequence
  Description of Artificial Sequence:  Hypothetical Probe Sequence
gtgccacggagtacgggagt

SEQ ID NO: 8397 - DNA, 20 bp, Artificial Sequence
  Description of Artificial Sequence:  Hypothetical Probe Sequence
gtgccacgagtgtgtcatcg

SEQ ID NO: 8398 - DNA, 20 bp, Artificial Sequence
  Description of Artificial Sequence:  Hypothetical Probe Sequence
gtgccacgagccaatcctca

SEQ ID NO: 8399 - DNA, 20 bp, Artificial Sequence
  Description of Artificial Sequence:  Hypothetical Probe Sequence
gtgccagctgatagccaaag

SEQ ID NO: 8400 - DNA, 20 bp, Artificial Sequence
  Description of Artificial Sequence:  Hypothetical Probe Sequence
gtgccagcaatcaaagggta

SEQ ID NO: 8401 - DNA, 20 bp, Artificial Sequence
  Description of Artificial Sequence:  Hypothetical Probe Sequence
gtgccagcataccagcgatg

SEQ ID NO: 8402 - DNA, 20 bp, Artificial Sequence
  Description of Artificial Sequence:  Hypothetical Probe Sequence
gtgccagcaaaggtctgtgc

SEQ ID NO: 8403 - DNA, 20 bp, Artificial Sequence
  Description of Artificial Sequence:  Hypothetical Probe Sequence
gtgccagccgaattagtgcg

SEQ ID NO: 8404 - DNA, 20 bp, Artificial Sequence
  Description of Artificial Sequence:  Hypothetical Probe Sequence
gtgccagcgtcttgtcgtgc

SEQ ID NO: 8405 - DNA, 20 bp, Artificial Sequence
  Description of Artificial Sequence:  Hypothetical Probe Sequence
cagcgagtttaggtgcagcc

SEQ ID NO: 8406 - DNA, 20 bp, Artificial Sequence
  Description of Artificial Sequence:  Hypothetical Probe Sequence
gtgccagccctaaatcggac

SEQ ID NO: 8407 - DNA, 20 bp, Artificial Sequence
  Description of Artificial Sequence:  Hypothetical Probe Sequence
gtgccagctcccctcacttg

SEQ ID NO: 8408 - DNA, 20 bp, Artificial Sequence
  Description of Artificial Sequence:  Hypothetical Probe Sequence
gtgccagcgtgcagtggcaa

SEQ ID NO: 8409 - DNA, 20 bp, Artificial Sequence
  Description of Artificial Sequence:  Hypothetical Probe Sequence
gtgccagcacggaaagatcg

SEQ ID NO: 8410 - DNA, 20 bp, Artificial Sequence
  Description of Artificial Sequence:  Hypothetical Probe Sequence
gtgcgaccttaggtgcggta

SEQ ID NO: 8411 - DNA, 20 bp, Artificial Sequence
  Description of Artificial Sequence:  Hypothetical Probe Sequence
gtgcgaccatacagccggac

SEQ ID NO: 8412 - DNA, 20 bp, Artificial Sequence
  Description of Artificial Sequence:  Hypothetical Probe Sequence
gtgcgaccctgtttagcagc

SEQ ID NO: 8413 - DNA, 20 bp, Artificial Sequence
  Description of Artificial Sequence:  Hypothetical Probe Sequence
gtgcgacccgaaagcctgtc

SEQ ID NO: 8414 - DNA, 20 bp, Artificial Sequence
  Description of Artificial Sequence:  Hypothetical Probe Sequence
gtgcgaccgcttataccagc

SEQ ID NO: 8415 - DNA, 20 bp, Artificial Sequence
  Description of Artificial Sequence:  Hypothetical Probe Sequence
gtgcgaccggtaggacggta

SEQ ID NO: 8416 - DNA, 20 bp, Artificial Sequence
  Description of Artificial Sequence:  Hypothetical Probe Sequence
gtgcgaccagtggatgcacg

SEQ ID NO: 8417 - DNA, 20 bp, Artificial Sequence
  Description of Artificial Sequence:  Hypothetical Probe Sequence
gtgcgaccaggaagccacct

SEQ ID NO: 8418 - DNA, 20 bp, Artificial Sequence
  Description of Artificial Sequence:  Hypothetical Probe Sequence
gtgcgacccagcgagtagcc

SEQ ID NO: 8419 - DNA, 20 bp, Artificial Sequence
  Description of Artificial Sequence:  Hypothetical Probe Sequence
gtgcgaccacggctcaatcg

SEQ ID NO: 8420 - DNA, 20 bp, Artificial Sequence
  Description of Artificial Sequence:  Hypothetical Probe Sequence
gtgcgtgcttgacgaaggac

SEQ ID NO: 8421 - DNA, 20 bp, Artificial Sequence
  Description of Artificial Sequence:  Hypothetical Probe Sequence
gtgcgtgctgattcccaaag

SEQ ID NO: 8422 - DNA, 20 bp, Artificial Sequence
  Description of Artificial Sequence:  Hypothetical Probe Sequence
gtgcgtgctacatgcgagga

SEQ ID NO: 8423 - DNA, 20 bp, Artificial Sequence
  Description of Artificial Sequence:  Hypothetical Probe Sequence
gtgcgtgcctgtacctgacc

SEQ ID NO: 8424 - DNA, 20 bp, Artificial Sequence
  Description of Artificial Sequence:  Hypothetical Probe Sequence
gtgcgtgcgtctccatgcaa

SEQ ID NO: 8425 - DNA, 20 bp, Artificial Sequence
  Description of Artificial Sequence:  Hypothetical Probe Sequence
gtgcgtgcgagtctgtgtgc

SEQ ID NO: 8426 - DNA, 20 bp, Artificial Sequence
  Description of Artificial Sequence:  Hypothetical Probe Sequence
gtgcgtgcatcgccatagcc

SEQ ID NO: 8427 - DNA, 20 bp, Artificial Sequence
  Description of Artificial Sequence:  Hypothetical Probe Sequence
gtgcgtgccacggcttcacg

SEQ ID NO: 8428 - DNA, 20 bp, Artificial Sequence
  Description of Artificial Sequence:  Hypothetical Probe Sequence
gtgcggacatacgcaaagcc

SEQ ID NO: 8429 - DNA, 20 bp, Artificial Sequence
  Description of Artificial Sequence:  Hypothetical Probe Sequence
gtgcggacgtctcgttggta

SEQ ID NO: 8430 - DNA, 20 bp, Artificial Sequence
  Description of Artificial Sequence:  Hypothetical Probe Sequence
gtgcggactccccagcgtct

SEQ ID NO: 8431 - DNA, 20 bp, Artificial Sequence
  Description of Artificial Sequence:  Hypothetical Probe Sequence
ggactgcgagtgtgtcgcaa

SEQ ID NO: 8432 - DNA, 20 bp, Artificial Sequence
  Description of Artificial Sequence:  Hypothetical Probe Sequence
gtgcggacgacctcgtttga

SEQ ID NO: 8433 - DNA, 20 bp, Artificial Sequence
  Description of Artificial Sequence:  Hypothetical Probe Sequence
gtgcacggaatcgctttgcg

SEQ ID NO: 8434 - DNA, 20 bp, Artificial Sequence
  Description of Artificial Sequence:  Hypothetical Probe Sequence
acggtctgtccccacgccat

SEQ ID NO: 8435 - DNA, 20 bp, Artificial Sequence
  Description of Artificial Sequence:  Hypothetical Probe Sequence
acggctcaaccttctgcagc

SEQ ID NO: 8436 - DNA, 20 bp, Artificial Sequence
  Description of Artificial Sequence:  Hypothetical Probe Sequence
gtgcacggccatcttgacct

SEQ ID NO: 8437 - DNA, 20 bp, Artificial Sequence
  Description of Artificial Sequence:  Hypothetical Probe Sequence
gtgcacgggtcttgcgatcg

SEQ ID NO: 8438 - DNA, 20 bp, Artificial Sequence
  Description of Artificial Sequence:  Hypothetical Probe Sequence
gtgcacgggagtccatcgaa

SEQ ID NO: 8439 - DNA, 20 bp, Artificial Sequence
  Description of Artificial Sequence:  Hypothetical Probe Sequence
acggagtggaccagccggac

SEQ ID NO: 8440 - DNA, 20 bp, Artificial Sequence
  Description of Artificial Sequence:  Hypothetical Probe Sequence
gtgcacggatcggatgagcc

SEQ ID NO: 8441 - DNA, 20 bp, Artificial Sequence
  Description of Artificial Sequence:  Hypothetical Probe Sequence
gtgcacggaggatccctgtc

SEQ ID NO: 8442 - DNA, 20 bp, Artificial Sequence
  Description of Artificial Sequence:  Hypothetical Probe Sequence
gtgcacgggtgcgagtgtgc

SEQ ID NO: 8443 - DNA, 20 bp, Artificial Sequence
  Description of Artificial Sequence:  Hypothetical Probe Sequence
gtgcacggggacccattctg

SEQ ID NO: 8444 - DNA, 20 bp, Artificial Sequence
  Description of Artificial Sequence:  Hypothetical Probe Sequence
gtgcacggacggagtggtgc

SEQ ID NO: 8445 - DNA, 20 bp, Artificial Sequence
  Description of Artificial Sequence:  Hypothetical Probe Sequence
gtgcagccaaagcagccgtt

SEQ ID NO: 8446 - DNA, 20 bp, Artificial Sequence
  Description of Artificial Sequence:  Hypothetical Probe Sequence
gtgcagcctcgttacaacgg

SEQ ID NO: 8447 - DNA, 20 bp, Artificial Sequence
  Description of Artificial Sequence:  Hypothetical Probe Sequence
gtgcagccatcgaatcgcaa

SEQ ID NO: 8448 - DNA, 20 bp, Artificial Sequence
  Description of Artificial Sequence:  Hypothetical Probe Sequence
gtgcagcctcccgaccacct

SEQ ID NO: 8449 - DNA, 20 bp, Artificial Sequence
  Description of Artificial Sequence:  Hypothetical Probe Sequence
gtgcagcctgcgccatcttg

SEQ ID NO: 8450 - DNA, 20 bp, Artificial Sequence
  Description of Artificial Sequence:  Hypothetical Probe Sequence
gtgcagccgaccccatgtgc

SEQ ID NO: 8451 - DNA, 20 bp, Artificial Sequence
  Description of Artificial Sequence:  Hypothetical Probe Sequence
gtgcagccgtgcagtgcgaa

SEQ ID NO: 8452 - DNA, 20 bp, Artificial Sequence
  Description of Artificial Sequence:  Hypothetical Probe Sequence
gtgcagccacgggatgctgt

SEQ ID NO: 8453 - DNA, 20 bp, Artificial Sequence
  Description of Artificial Sequence:  Hypothetical Probe Sequence
ttgaagccaatcccattgcg

SEQ ID NO: 8454 - DNA, 20 bp, Artificial Sequence
  Description of Artificial Sequence:  Hypothetical Probe Sequence
ttagcagccacgcacgtgcg

SEQ ID NO: 8455 - DNA, 20 bp, Artificial Sequence
  Description of Artificial Sequence:  Hypothetical Probe Sequence
aatccttgacggccatcagc

SEQ ID NO: 8456 - DNA, 20 bp, Artificial Sequence
  Description of Artificial Sequence:  Hypothetical Probe Sequence
aatctgcgtacaagcccgtt

SEQ ID NO: 8457 - DNA, 20 bp, Artificial Sequence
  Description of Artificial Sequence:  Hypothetical Probe Sequence
aaaggatgacgggcaatgcg

SEQ ID NO: 8458 - DNA, 20 bp, Artificial Sequence
  Description of Artificial Sequence:  Hypothetical Probe Sequence
ggacaaagcacgagccttga

SEQ ID NO: 8459 - DNA, 20 bp, Artificial Sequence
  Description of Artificial Sequence:  Hypothetical Probe Sequence
tctgcgtttcgttcgtgtgc

SEQ ID NO: 8460 - DNA, 20 bp, Artificial Sequence
  Description of Artificial Sequence:  Hypothetical Probe Sequence
tctgcctaacgggctttgcg

SEQ ID NO: 8461 - DNA, 20 bp, Artificial Sequence
  Description of Artificial Sequence:  Hypothetical Probe Sequence
tctgcacggcaaacctgctt

SEQ ID NO: 8462 - DNA, 20 bp, Artificial Sequence
  Description of Artificial Sequence:  Hypothetical Probe Sequence
tcgtcgttatcgcagcagga

SEQ ID NO: 8463 - DNA, 20 bp, Artificial Sequence
  Description of Artificial Sequence:  Hypothetical Probe Sequence
tcgtccatgatgggactgcg

SEQ ID NO: 8464 - DNA, 20 bp, Artificial Sequence
  Description of Artificial Sequence:  Hypothetical Probe Sequence
tcgtacggcttggtcttgcg

SEQ ID NO: 8465 - DNA, 20 bp, Artificial Sequence
  Description of Artificial Sequence:  Hypothetical Probe Sequence
cttgcttgtgcgttagcacg

SEQ ID NO: 8466 - DNA, 20 bp, Artificial Sequence
  Description of Artificial Sequence:  Hypothetical Probe Sequence
ggaccttgcgttacggccta

SEQ ID NO: 8467 - DNA, 20 bp, Artificial Sequence
  Description of Artificial Sequence:  Hypothetical Probe Sequence
cttgctcaaaagcagcagcc

SEQ ID NO: 8468 - DNA, 20 bp, Artificial Sequence
  Description of Artificial Sequence:  Hypothetical Probe Sequence
ggaccttggagtcacgagcc

SEQ ID NO: 8469 - DNA, 20 bp, Artificial Sequence
  Description of Artificial Sequence:  Hypothetical Probe Sequence
ggaccttggcaaggacgcaa

SEQ ID NO: 8470 - DNA, 20 bp, Artificial Sequence
  Description of Artificial Sequence:  Hypothetical Probe Sequence
ggaccttgcagcgcttgcaa

SEQ ID NO: 8471 - DNA, 20 bp, Artificial Sequence
  Description of Artificial Sequence:  Hypothetical Probe Sequence
ggaccttggtgccgaatcgt

SEQ ID NO: 8472 - DNA, 20 bp, Artificial Sequence
  Description of Artificial Sequence:  Hypothetical Probe Sequence
ggaccttgggacgcaacgaa

SEQ ID NO: 8473 - DNA, 20 bp, Artificial Sequence
  Description of Artificial Sequence:  Hypothetical Probe Sequence
cgttcgttatacacgggcaa

SEQ ID NO: 8474 - DNA, 20 bp, Artificial Sequence
  Description of Artificial Sequence:  Hypothetical Probe Sequence
ggaccgttacctgagttgcg

SEQ ID NO: 8475 - DNA, 20 bp, Artificial Sequence
  Description of Artificial Sequence:  Hypothetical Probe Sequence
ggaccgtttgcggagtatcg

SEQ ID NO: 8476 - DNA, 20 bp, Artificial Sequence
  Description of Artificial Sequence:  Hypothetical Probe Sequence
ggacctgtttgatgcggagt

SEQ ID NO: 8477 - DNA, 20 bp, Artificial Sequence
  Description of Artificial Sequence:  Hypothetical Probe Sequence
ggacctgtccatccattccc

SEQ ID NO: 8478 - DNA, 20 bp, Artificial Sequence
  Description of Artificial Sequence:  Hypothetical Probe Sequence
ccattgatcagcgaccccat

SEQ ID NO: 8479 - DNA, 20 bp, Artificial Sequence
  Description of Artificial Sequence:  Hypothetical Probe Sequence
ccataaagctgttcccgtgc

SEQ ID NO: 8480 - DNA, 20 bp, Artificial Sequence
  Description of Artificial Sequence:  Hypothetical Probe Sequence
ggacccatcttgcttgtccc

SEQ ID NO: 8481 - DNA, 20 bp, Artificial Sequence
  Description of Artificial Sequence:  Hypothetical Probe Sequence
ggacccatggtatgcggtgc

SEQ ID NO: 8482 - DNA, 20 bp, Artificial Sequence
  Description of Artificial Sequence:  Hypothetical Probe Sequence
ggacccatcacgcttgcgaa

SEQ ID NO: 8483 - DNA, 20 bp, Artificial Sequence
  Description of Artificial Sequence:  Hypothetical Probe Sequence
ggacccatgtgcatacgcaa

SEQ ID NO: 8484 - DNA, 20 bp, Artificial Sequence
  Description of Artificial Sequence:  Hypothetical Probe Sequence
cgaattgacttgcacgcacg

SEQ ID NO: 8485 - DNA, 20 bp, Artificial Sequence
  Description of Artificial Sequence:  Hypothetical Probe Sequence
ggaccgaaatacacgggtgc

SEQ ID NO: 8486 - DNA, 20 bp, Artificial Sequence
  Description of Artificial Sequence:  Hypothetical Probe Sequence
cgaaaaagtctgcttggcaa

SEQ ID NO: 8487 - DNA, 20 bp, Artificial Sequence
  Description of Artificial Sequence:  Hypothetical Probe Sequence
ggaccgaacttgacggtccc

SEQ ID NO: 8488 - DNA, 20 bp, Artificial Sequence
  Description of Artificial Sequence:  Hypothetical Probe Sequence
ggaccgaagctttcgtagga

SEQ ID NO: 8489 - DNA, 20 bp, Artificial Sequence
  Description of Artificial Sequence:  Hypothetical Probe Sequence
ggaccgaaacctgcttgctt

SEQ ID NO: 8490 - DNA, 20 bp, Artificial Sequence
  Description of Artificial Sequence:  Hypothetical Probe Sequence
cgaaaggaataccagccacg

SEQ ID NO: 8491 - DNA, 20 bp, Artificial Sequence
  Description of Artificial Sequence:  Hypothetical Probe Sequence
ggaccgaagacccagcgcaa

SEQ ID NO: 8492 - DNA, 20 bp, Artificial Sequence
  Description of Artificial Sequence:  Hypothetical Probe Sequence
ggacgcttttagggaccgaa

SEQ ID NO: 8493 - DNA, 20 bp, Artificial Sequence
  Description of Artificial Sequence:  Hypothetical Probe Sequence
ggacgcttaaaggtgcgtgc

SEQ ID NO: 8494 - DNA, 20 bp, Artificial Sequence
  Description of Artificial Sequence:  Hypothetical Probe Sequence
gctttgtcaccttccctgcg

SEQ ID NO: 8495 - DNA, 20 bp, Artificial Sequence
  Description of Artificial Sequence:  Hypothetical Probe Sequence
ggacgcttggtaaatcgctt

SEQ ID NO: 8496 - DNA, 20 bp, Artificial Sequence
  Description of Artificial Sequence:  Hypothetical Probe Sequence
ggacgcttacctgcaacgaa

SEQ ID NO: 8497 - DNA, 20 bp, Artificial Sequence
  Description of Artificial Sequence:  Hypothetical Probe Sequence
gcttcctatgtcatcggcaa

SEQ ID NO: 8498 - DNA, 20 bp, Artificial Sequence
  Description of Artificial Sequence:  Hypothetical Probe Sequence
ggacgctttgcgttgaatcg

SEQ ID NO: 8499 - DNA, 20 bp, Artificial Sequence
  Description of Artificial Sequence:  Hypothetical Probe Sequence
ggacggtacgtttcgttgcg

SEQ ID NO: 8500 - DNA, 20 bp, Artificial Sequence
  Description of Artificial Sequence:  Hypothetical Probe Sequence3> Abramites sp.
ggacggtaccattgtcgcaa

SEQ ID NO: 8501 - DNA, 20 bp, Artificial Sequence
  Description of Artificial Sequence:  Hypothetical Probe Sequence
ggacggtagtgcagtgcagc

SEQ ID NO: 8502 - DNA, 20 bp, Artificial Sequence
  Description of Artificial Sequence:  Hypothetical Probe Sequence
ggacggtaggacgcaatccc

SEQ ID NO: 8503 - DNA, 20 bp, Artificial Sequence
  Description of Artificial Sequence:  Hypothetical Probe Sequence
ggacggtaagccgtgcacct

SEQ ID NO: 8504 - DNA, 20 bp, Artificial Sequence
  Description of Artificial Sequence:  Hypothetical Probe Sequence
gtctttgatccccacgcgaa

SEQ ID NO: 8505 - DNA, 20 bp, Artificial Sequence
  Description of Artificial Sequence:  Hypothetical Probe Sequence
ggacgtcttcgtgcaagcaa

SEQ ID NO: 8506 - DNA, 20 bp, Artificial Sequence
  Description of Artificial Sequence:  Hypothetical Probe Sequence
ggacgtctccatggaccagc

SEQ ID NO: 8507 - DNA, 20 bp, Artificial Sequence
  Description of Artificial Sequence:  Hypothetical Probe Sequence
gtctgcaagacctctgtgcg

SEQ ID NO: 8508 - DNA, 20 bp, Artificial Sequence
  Description of Artificial Sequence:  Hypothetical Probe Sequence
gtctcacgcacgaaagcagc

SEQ ID NO: 8509 - DNA, 20 bp, Artificial Sequence
  Description of Artificial Sequence:  Hypothetical Probe Sequence
gagtatcgggaccctatgcg

SEQ ID NO: 8510 - DNA, 20 bp, Artificial Sequence
  Description of Artificial Sequence:  Hypothetical Probe Sequence
ggacgagtcagcgtgcgtgc

SEQ ID NO: 8511 - DNA, 20 bp, Artificial Sequence
  Description of Artificial Sequence:  Hypothetical Probe Sequence
ggacgagtacggttgaatcg

SEQ ID NO: 8512 - DNA, 20 bp, Artificial Sequence
  Description of Artificial Sequence:  Hypothetical Probe Sequence
gcaattgaacggagtgcagc

SEQ ID NO: 8513 - DNA, 20 bp, Artificial Sequence
  Description of Artificial Sequence:  Hypothetical Probe Sequence
ggacgcaaatacgtgcccat

SEQ ID NO: 8514 - DNA, 20 bp, Artificial Sequence
  Description of Artificial Sequence:  Hypothetical Probe Sequence
ggacgcaatgtcccatggta

SEQ ID NO: 8515 - DNA, 20 bp, Artificial Sequence
  Description of Artificial Sequence:  Hypothetical Probe Sequence
ggacgcaatcgttctggtgc

SEQ ID NO: 8516 - DNA, 20 bp, Artificial Sequence
  Description of Artificial Sequence:  Hypothetical Probe Sequence
gcaacctaatactgcgtgcg

SEQ ID NO: 8517 - DNA, 20 bp, Artificial Sequence
  Description of Artificial Sequence:  Hypothetical Probe Sequence
ggacgcaatgcgttgaagga

SEQ ID NO: 8518 - DNA, 20 bp, Artificial Sequence
  Description of Artificial Sequence:  Hypothetical Probe Sequence
ggacgcaagtgcagtggtct

SEQ ID NO: 8519 - DNA, 20 bp, Artificial Sequence
  Description of Artificial Sequence:  Hypothetical Probe Sequence
ggacgcaaggactcccggta

SEQ ID NO: 8520 - DNA, 20 bp, Artificial Sequence
  Description of Artificial Sequence:  Hypothetical Probe Sequence
ggacgcaaacggtgatcagc

SEQ ID NO: 8521 - DNA, 20 bp, Artificial Sequence
  Description of Artificial Sequence:  Hypothetical Probe Sequence
agtgtgcgacggacctgtgc

SEQ ID NO: 8522 - DNA, 20 bp, Artificial Sequence
  Description of Artificial Sequence:  Hypothetical Probe Sequence
acctcacgggactgattgcg

SEQ ID NO: 8523 - DNA, 20 bp, Artificial Sequence
  Description of Artificial Sequence:  Hypothetical Probe Sequence
ggacacctgaccgtgcacgg

SEQ ID NO: 8524 - DNA, 20 bp, Artificial Sequence
  Description of Artificial Sequence:  Hypothetical Probe Sequence
acctagccttagcgtttgcg

SEQ ID NO: 8525 - DNA, 20 bp, Artificial Sequence
  Description of Artificial Sequence:  Hypothetical Probe Sequence
atcgaaagacgggtgccacg

SEQ ID NO: 8526 - DNA, 20 bp, Artificial Sequence
  Description of Artificial Sequence:  Hypothetical Probe Sequence
atcggcttcttgcttgacgg

SEQ ID NO: 8527 - DNA, 20 bp, Artificial Sequence
  Description of Artificial Sequence:  Hypothetical Probe Sequence
atcgcacggtctagccatcg

SEQ ID NO: 8528 - DNA, 20 bp, Artificial Sequence
  Description of Artificial Sequence:  Hypothetical Probe Sequence
ggacatcgacggggacctgt

SEQ ID NO: 8529 - DNA, 20 bp, Artificial Sequence
  Description of Artificial Sequence:  Hypothetical Probe Sequence
aggacgaaatcgtcccggac

SEQ ID NO: 8530 - DNA, 20 bp, Artificial Sequence
  Description of Artificial Sequence:  Hypothetical Probe Sequence
ggacaggaatcgacggccta

SEQ ID NO: 8531 - DNA, 20 bp, Artificial Sequence
  Description of Artificial Sequence:  Hypothetical Probe Sequence
aggaaggattgaggacgtgc

SEQ ID NO: 8532 - DNA, 20 bp, Artificial Sequence
  Description of Artificial Sequence:  Hypothetical Probe Sequence
cctacgaaaggatcgttgcg

SEQ ID NO: 8533 - DNA, 20 bp, Artificial Sequence
  Description of Artificial Sequence:  Hypothetical Probe Sequence
ggaccctagcttgcaagtgc

SEQ ID NO: 8534 - DNA, 20 bp, Artificial Sequence
  Description of Artificial Sequence:  Hypothetical Probe Sequence
cctagcaacagcgatgcgaa

SEQ ID NO: 8535 - DNA, 20 bp, Artificial Sequence
  Description of Artificial Sequence:  Hypothetical Probe Sequence
cctacctagaccagccacgg

SEQ ID NO: 8536 - DNA, 20 bp, Artificial Sequence
  Description of Artificial Sequence:  Hypothetical Probe Sequence
ggacgatgctcactgttgcg

SEQ ID NO: 8537 - DNA, 20 bp, Artificial Sequence
  Description of Artificial Sequence:  Hypothetical Probe Sequence
ggacgatgggtaacggggta

SEQ ID NO: 8538 - DNA, 20 bp, Artificial Sequence
  Description of Artificial Sequence:  Hypothetical Probe Sequence
ggacgatggtctagcccgaa

SEQ ID NO: 8539 - DNA, 20 bp, Artificial Sequence
  Description of Artificial Sequence:  Hypothetical Probe Sequence
ggacgatgatcgcgaaagcc

SEQ ID NO: 8540 - DNA, 20 bp, Artificial Sequence
  Description of Artificial Sequence:  Hypothetical Probe Sequence
tccctgtccgttgcttgcaa

SEQ ID NO: 8541 - DNA, 20 bp, Artificial Sequence
  Description of Artificial Sequence:  Hypothetical Probe Sequence
tcccctgttacagacctgcg

SEQ ID NO: 8542 - DNA, 20 bp, Artificial Sequence
  Description of Artificial Sequence:  Hypothetical Probe Sequence
tcccccatttagcacggatg

SEQ ID NO: 8543 - DNA, 20 bp, Artificial Sequence
  Description of Artificial Sequence:  Hypothetical Probe Sequence
ggactcccacctagcccagc

SEQ ID NO: 8544 - DNA, 20 bp, Artificial Sequence
  Description of Artificial Sequence:  Hypothetical Probe Sequence
ggactcccatcgcgaaagga

SEQ ID NO: 8545 - DNA, 20 bp, Artificial Sequence
  Description of Artificial Sequence:  Hypothetical Probe Sequence
ggactccccacgcttgcgtt

SEQ ID NO: 8546 - DNA, 20 bp, Artificial Sequence
  Description of Artificial Sequence:  Hypothetical Probe Sequence
ggactcccggacgcttcacg

SEQ ID NO: 8547 - DNA, 20 bp, Artificial Sequence
  Description of Artificial Sequence:  Hypothetical Probe Sequence
tgcgttagccatcacgacgg

SEQ ID NO: 8548 - DNA, 20 bp, Artificial Sequence
  Description of Artificial Sequence:  Hypothetical Probe Sequence
ggactgcgtcgtcgttcagc

SEQ ID NO: 8549 - DNA, 20 bp, Artificial Sequence
  Description of Artificial Sequence:  Hypothetical Probe Sequence
ggactgcgcttgacctcacg

SEQ ID NO: 8550 - DNA, 20 bp, Artificial Sequence
  Description of Artificial Sequence:  Hypothetical Probe Sequence
tgcgctcatcgtcgttttga

SEQ ID NO: 8551 - DNA, 20 bp, Artificial Sequence
  Description of Artificial Sequence:  Hypothetical Probe Sequence
tgcggcttaggagcttcacg

SEQ ID NO: 8552 - DNA, 20 bp, Artificial Sequence
  Description of Artificial Sequence:  Hypothetical Probe Sequence
tgcgacctttgagcaacgaa

SEQ ID NO: 8553 - DNA, 20 bp, Artificial Sequence
  Description of Artificial Sequence:  Hypothetical Probe Sequence
tgcgatcgacctccatggac

SEQ ID NO: 8554 - DNA, 20 bp, Artificial Sequence
  Description of Artificial Sequence:  Hypothetical Probe Sequence
tgcggatggagtatcgccat

SEQ ID NO: 8555 - DNA, 20 bp, Artificial Sequence
  Description of Artificial Sequence:  Hypothetical Probe Sequence
tgcgcacgataccagcagga

SEQ ID NO: 8556 - DNA, 20 bp, Artificial Sequence
  Description of Artificial Sequence:  Hypothetical Probe Sequence
ggactgcgggacccatccat

SEQ ID NO: 8557 - DNA, 20 bp, Artificial Sequence
  Description of Artificial Sequence:  Hypothetical Probe Sequence
cacgtgatgacctccccgaa

SEQ ID NO: 8558 - DNA, 20 bp, Artificial Sequence
  Description of Artificial Sequence:  Hypothetical Probe Sequence
ggaccacgctcattgatccc

SEQ ID NO: 8559 - DNA, 20 bp, Artificial Sequence
  Description of Artificial Sequence:  Hypothetical Probe Sequence
ggaccacggctttctgcacg

SEQ ID NO: 8560 - DNA, 20 bp, Artificial Sequence
  Description of Artificial Sequence:  Hypothetical Probe Sequence
ggaccacggagtatcgctca

SEQ ID NO: 8561 - DNA, 20 bp, Artificial Sequence
  Description of Artificial Sequence:  Hypothetical Probe Sequence
ggaccacgcacgctcagtgc

SEQ ID NO: 8562 - DNA, 20 bp, Artificial Sequence
  Description of Artificial Sequence:  Hypothetical Probe Sequence
ggaccacgacggtctgtgcg

SEQ ID NO: 8563 - DNA, 20 bp, Artificial Sequence
  Description of Artificial Sequence:  Hypothetical Probe Sequence
ggaccacgagcccgaacgtt

SEQ ID NO: 8564 - DNA, 20 bp, Artificial Sequence
  Description of Artificial Sequence:  Hypothetical Probe Sequence
cagcttgatcgtcgaaacgg

SEQ ID NO: 8565 - DNA, 20 bp, Artificial Sequence
  Description of Artificial Sequence:  Hypothetical Probe Sequence
ggaccagctgtccagcagga

SEQ ID NO: 8566 - DNA, 20 bp, Artificial Sequence
  Description of Artificial Sequence:  Hypothetical Probe Sequence
ggaccagccttgtgcgacgg

SEQ ID NO: 8567 - DNA, 20 bp, Artificial Sequence
  Description of Artificial Sequence:  Hypothetical Probe Sequence
cagcctgtggactgtccacg

SEQ ID NO: 8568 - DNA, 20 bp, Artificial Sequence
  Description of Artificial Sequence:  Hypothetical Probe Sequence
cagcggtatgatgaccagcc

SEQ ID NO: 8569 - DNA, 20 bp, Artificial Sequence
  Description of Artificial Sequence:  Hypothetical Probe Sequence
cagcagtgacctgtgcgctt

SEQ ID NO: 8570 - DNA, 20 bp, Artificial Sequence
  Description of Artificial Sequence:  Hypothetical Probe Sequence
ggaccagctgcggaccctca

SEQ ID NO: 8571 - DNA, 20 bp, Artificial Sequence
  Description of Artificial Sequence:  Hypothetical Probe Sequence
ggacgaccttgagtgcgcaa

SEQ ID NO: 8572 - DNA, 20 bp, Artificial Sequence
  Description of Artificial Sequence:  Hypothetical Probe Sequence
ggacgaccctgtagtgcgtt

SEQ ID NO: 8573 - DNA, 20 bp, Artificial Sequence
  Description of Artificial Sequence:  Hypothetical Probe Sequence
ggacgaccggtagtgcagcc

SEQ ID NO: 8574 - DNA, 20 bp, Artificial Sequence
  Description of Artificial Sequence:  Hypothetical Probe Sequence
ggacgaccgtctgtgcacct

SEQ ID NO: 8575 - DNA, 20 bp, Artificial Sequence
  Description of Artificial Sequence:  Hypothetical Probe Sequence
ggacgaccgagtcttgggac

SEQ ID NO: 8576 - DNA, 20 bp, Artificial Sequence
  Description of Artificial Sequence:  Hypothetical Probe Sequence
gaccagtgaaaggtgcagcc

SEQ ID NO: 8577 - DNA, 20 bp, Artificial Sequence
  Description of Artificial Sequence:  Hypothetical Probe Sequence
ggacgaccgaccccatctca

SEQ ID NO: 8578 - DNA, 20 bp, Artificial Sequence
  Description of Artificial Sequence:  Hypothetical Probe Sequence
ggacgtgctgattgattccc

SEQ ID NO: 8579 - DNA, 20 bp, Artificial Sequence
  Description of Artificial Sequence:  Hypothetical Probe Sequence
ggacgtgcaatcggaccgtt

SEQ ID NO: 8580 - DNA, 20 bp, Artificial Sequence
  Description of Artificial Sequence:  Hypothetical Probe Sequence
ggacgtgctctgtcgtccat

SEQ ID NO: 8581 - DNA, 20 bp, Artificial Sequence
  Description of Artificial Sequence:  Hypothetical Probe Sequence
ggacgtgctgtccagcacgg

SEQ ID NO: 8582 - DNA, 20 bp, Artificial Sequence
  Description of Artificial Sequence:  Hypothetical Probe Sequence
ggacgtgctcgtcgaagcaa

SEQ ID NO: 8583 - DNA, 20 bp, Artificial Sequence
  Description of Artificial Sequence:  Hypothetical Probe Sequence
ggacgtgccgttgcttcgaa

SEQ ID NO: 8584 - DNA, 20 bp, Artificial Sequence
  Description of Artificial Sequence:  Hypothetical Probe Sequence
gtgccgaaatactcccgtgc

SEQ ID NO: 8585 - DNA, 20 bp, Artificial Sequence
  Description of Artificial Sequence:  Hypothetical Probe Sequence
ggacgtgcggtatgtcggac

SEQ ID NO: 8586 - DNA, 20 bp, Artificial Sequence
  Description of Artificial Sequence:  Hypothetical Probe Sequence
ggacgtgcagtggtgctgcg

SEQ ID NO: 8587 - DNA, 20 bp, Artificial Sequence
  Description of Artificial Sequence:  Hypothetical Probe Sequence
ggacgtgccctacctatcgt

SEQ ID NO: 8588 - DNA, 20 bp, Artificial Sequence
  Description of Artificial Sequence:  Hypothetical Probe Sequence
ggacgtgctgcgtgtccttg

SEQ ID NO: 8589 - DNA, 20 bp, Artificial Sequence
  Description of Artificial Sequence:  Hypothetical Probe Sequence
ggacgtgccacgggacagtg

SEQ ID NO: 8590 - DNA, 20 bp, Artificial Sequence
  Description of Artificial Sequence:  Hypothetical Probe Sequence
ggacgtgcacggtgattgtc

SEQ ID NO: 8591 - DNA, 20 bp, Artificial Sequence
  Description of Artificial Sequence:  Hypothetical Probe Sequence
ggacggactcgtctgtcacg

SEQ ID NO: 8592 - DNA, 20 bp, Artificial Sequence
  Description of Artificial Sequence:  Hypothetical Probe Sequence
ggacggaccgttttaggacc

SEQ ID NO: 8593 - DNA, 20 bp, Artificial Sequence
  Description of Artificial Sequence:  Hypothetical Probe Sequence
ggacctgttacatccccacg

SEQ ID NO: 8594 - DNA, 20 bp, Artificial Sequence
  Description of Artificial Sequence:  Hypothetical Probe Sequence
ggacggaccgaagatgcagc

SEQ ID NO: 8595 - DNA, 20 bp, Artificial Sequence
  Description of Artificial Sequence:  Hypothetical Probe Sequence
ggacggacgagttacatgcg

SEQ ID NO: 8596 - DNA, 20 bp, Artificial Sequence
  Description of Artificial Sequence:  Hypothetical Probe Sequence
ggacacctgcaacttggcaa

SEQ ID NO: 8597 - DNA, 20 bp, Artificial Sequence
  Description of Artificial Sequence:  Hypothetical Probe Sequence
ggacggacgatgttagacgg

SEQ ID NO: 8598 - DNA, 20 bp, Artificial Sequence
  Description of Artificial Sequence:  Hypothetical Probe Sequence
ggacggactcccagtgacgg

SEQ ID NO: 8599 - DNA, 20 bp, Artificial Sequence
  Description of Artificial Sequence:  Hypothetical Probe Sequence
ggacggactgcgaggatctg

SEQ ID NO: 8600 - DNA, 20 bp, Artificial Sequence
  Description of Artificial Sequence:  Hypothetical Probe Sequence
ggacggaccagcccatgctt

SEQ ID NO: 8601 - DNA, 20 bp, Artificial Sequence
  Description of Artificial Sequence:  Hypothetical Probe Sequence
acggttaggacctgcgagcc

SEQ ID NO: 8602 - DNA, 20 bp, Artificial Sequence
  Description of Artificial Sequence:  Hypothetical Probe Sequence
acggtctgagcctcgtgtgc

SEQ ID NO: 8603 - DNA, 20 bp, Artificial Sequence
  Description of Artificial Sequence:  Hypothetical Probe Sequence
ggacacggcgttaatctgcg

SEQ ID NO: 8604 - DNA, 20 bp, Artificial Sequence
  Description of Artificial Sequence:  Hypothetical Probe Sequence
acggctgttacagctttccc

SEQ ID NO: 8605 - DNA, 20 bp, Artificial Sequence
  Description of Artificial Sequence:  Hypothetical Probe Sequence
acgggagtcgaaggacatcg

SEQ ID NO: 8606 - DNA, 20 bp, Artificial Sequence
  Description of Artificial Sequence:  Hypothetical Probe Sequence
acggagtgcgttcctaagcc

SEQ ID NO: 8607 - DNA, 20 bp, Artificial Sequence
  Description of Artificial Sequence:  Hypothetical Probe Sequence
agcccgttcttgaatccagc

SEQ ID NO: 8608 - DNA, 20 bp, Artificial Sequence
  Description of Artificial Sequence:  Hypothetical Probe Sequence
agccctgtaaagagccgacc

SEQ ID NO: 8609 - DNA, 20 bp, Artificial Sequence
  Description of Artificial Sequence:  Hypothetical Probe Sequence
ggacagcctgcggcaactca

SEQ ID NO: 8610 - DNA, 20 bp, Artificial Sequence
  Description of Artificial Sequence:  Hypothetical Probe Sequence
agcccacgcacgtgatgcaa

SEQ ID NO: 8611 - DNA, 20 bp, Artificial Sequence
  Description of Artificial Sequence:  Hypothetical Probe Sequence
agccgacccgttctgtcacg

SEQ ID NO: 8612 - DNA, 20 bp, Artificial Sequence
  Description of Artificial Sequence:  Hypothetical Probe Sequence
agccggaccctactcaacgg

SEQ ID NO: 8613 - DNA, 20 bp, Artificial Sequence
  Description of Artificial Sequence:  Hypothetical Probe Sequence
acggttgaccattgattgcg

SEQ ID NO: 8614 - DNA, 20 bp, Artificial Sequence
  Description of Artificial Sequence:  Hypothetical Probe Sequence
acggttgacagccacgatcg

SEQ ID NO: 8615 - DNA, 20 bp, Artificial Sequence
  Description of Artificial Sequence:  Hypothetical Probe Sequence
ttgagaccggacgatgacgg

SEQ ID NO: 8616 - DNA, 20 bp, Artificial Sequence
  Description of Artificial Sequence:  Hypothetical Probe Sequence
acggttgagtgctgcgttga

SEQ ID NO: 8617 - DNA, 20 bp, Artificial Sequence
  Description of Artificial Sequence:  Hypothetical Probe Sequence
tgatcgaagcaaatcgcagc

SEQ ID NO: 8618 - DNA, 20 bp, Artificial Sequence
  Description of Artificial Sequence:  Hypothetical Probe Sequence
acggtgatgcaaaccttccc

SEQ ID NO: 8619 - DNA, 20 bp, Artificial Sequence
  Description of Artificial Sequence:  Hypothetical Probe Sequence
acggtgatggactccctgcg

SEQ ID NO: 8620 - DNA, 20 bp, Artificial Sequence
  Description of Artificial Sequence:  Hypothetical Probe Sequence
acggttaggcaacacggatg

SEQ ID NO: 8621 - DNA, 20 bp, Artificial Sequence
  Description of Artificial Sequence:  Hypothetical Probe Sequence
acggttagtcccaaagggac

SEQ ID NO: 8622 - DNA, 20 bp, Artificial Sequence
  Description of Artificial Sequence:  Hypothetical Probe Sequence
acggttagcacgcagcttga

SEQ ID NO: 8623 - DNA, 20 bp, Artificial Sequence
  Description of Artificial Sequence:  Hypothetical Probe Sequence
acggaatcccattcgtagcc

SEQ ID NO: 8624 - DNA, 20 bp, Artificial Sequence
  Description of Artificial Sequence:  Hypothetical Probe Sequence
acggaatccgaaacctggac

SEQ ID NO: 8625 - DNA, 20 bp, Artificial Sequence
  Description of Artificial Sequence:  Hypothetical Probe Sequence
acggaatcatcgagcccagc

SEQ ID NO: 8626 - DNA, 20 bp, Artificial Sequence
  Description of Artificial Sequence:  Hypothetical Probe Sequence
aatccctacacgagccacgg

SEQ ID NO: 8627 - DNA, 20 bp, Artificial Sequence
  Description of Artificial Sequence:  Hypothetical Probe Sequence
acggaatcgatgtctggacc

SEQ ID NO: 8628 - DNA, 20 bp, Artificial Sequence
  Description of Artificial Sequence:  Hypothetical Probe Sequence
acggaatctcccggtagcaa

SEQ ID NO: 8629 - DNA, 20 bp, Artificial Sequence
  Description of Artificial Sequence:  Hypothetical Probe Sequence
acggaatcggactgatacgg

SEQ ID NO: 8630 - DNA, 20 bp, Artificial Sequence
  Description of Artificial Sequence:  Hypothetical Probe Sequence
acggataccgaacgttcgaa

SEQ ID NO: 8631 - DNA, 20 bp, Artificial Sequence
  Description of Artificial Sequence:  Hypothetical Probe Sequence
acggatacgcttgacccgtt

SEQ ID NO: 8632 - DNA, 20 bp, Artificial Sequence
  Description of Artificial Sequence:  Hypothetical Probe Sequence
atacggacttgacacgcgaa

SEQ ID NO: 8633 - DNA, 20 bp, Artificial Sequence
  Description of Artificial Sequence:  Hypothetical Probe Sequence
acggaaagctcagcaacagc

SEQ ID NO: 8634 - DNA, 20 bp, Artificial Sequence
  Description of Artificial Sequence:  Hypothetical Probe Sequence
acggaaagctgtatcgcttg

SEQ ID NO: 8635 - DNA, 20 bp, Artificial Sequence
  Description of Artificial Sequence:  Hypothetical Probe Sequence
acggaaagcgaattagacgg

SEQ ID NO: 8636 - DNA, 20 bp, Artificial Sequence
  Description of Artificial Sequence:  Hypothetical Probe Sequence
acggaaaggagtatcgtccc

SEQ ID NO: 8637 - DNA, 20 bp, Artificial Sequence
  Description of Artificial Sequence:  Hypothetical Probe Sequence
aaagaggacacgtccccagc

SEQ ID NO: 8638 - DNA, 20 bp, Artificial Sequence
  Description of Artificial Sequence:  Hypothetical Probe Sequence
acggaaagcagctcgtgtgc

SEQ ID NO: 8639 - DNA, 20 bp, Artificial Sequence
  Description of Artificial Sequence:  Hypothetical Probe Sequence
acggaaaggtgcgaccccat

SEQ ID NO: 8640 - DNA, 20 bp, Artificial Sequence
  Description of Artificial Sequence:  Hypothetical Probe Sequence
acggaaagagccggtagcaa

SEQ ID NO: 8641 - DNA, 20 bp, Artificial Sequence
  Description of Artificial Sequence:  Hypothetical Probe Sequence
tacagcttgatggctttgcg

SEQ ID NO: 8642 - DNA, 20 bp, Artificial Sequence
  Description of Artificial Sequence:  Hypothetical Probe Sequence
acggtacatgcgtccctgat

SEQ ID NO: 8643 - DNA, 20 bp, Artificial Sequence
  Description of Artificial Sequence:  Hypothetical Probe Sequence
tctgaaagcacgcacgcgaa

SEQ ID NO: 8644 - DNA, 20 bp, Artificial Sequence
  Description of Artificial Sequence:  Hypothetical Probe Sequence
acggtctgcgttgaccagtg

SEQ ID NO: 8645 - DNA, 20 bp, Artificial Sequence
  Description of Artificial Sequence:  Hypothetical Probe Sequence
acggtctgctcacgttcagc

SEQ ID NO: 8646 - DNA, 20 bp, Artificial Sequence
  Description of Artificial Sequence:  Hypothetical Probe Sequence
acggtctgctgtcgaaatcg

SEQ ID NO: 8647 - DNA, 20 bp, Artificial Sequence
  Description of Artificial Sequence:  Hypothetical Probe Sequence
acggtctgccatgtgccacg

SEQ ID NO: 8648 - DNA, 20 bp, Artificial Sequence
  Description of Artificial Sequence:  Hypothetical Probe Sequence
tctgggtattgaatcgtgcg

SEQ ID NO: 8649 - DNA, 20 bp, Artificial Sequence
  Description of Artificial Sequence:  Hypothetical Probe Sequence
tctgaggaacctagccgcaa

SEQ ID NO: 8650 - DNA, 20 bp, Artificial Sequence
  Description of Artificial Sequence:  Hypothetical Probe Sequence
acggtctgggacccatacgg

SEQ ID NO: 8651 - DNA, 20 bp, Artificial Sequence
  Description of Artificial Sequence:  Hypothetical Probe Sequence
acggtgtcctcaggacgtgc

SEQ ID NO: 8652 - DNA, 20 bp, Artificial Sequence
  Description of Artificial Sequence:  Hypothetical Probe Sequence
tgtcccatatcgaatcgctt

SEQ ID NO: 8653 - DNA, 20 bp, Artificial Sequence
  Description of Artificial Sequence:  Hypothetical Probe Sequence
tgtcggtaagtggtcttgcg

SEQ ID NO: 8654 - DNA, 20 bp, Artificial Sequence
  Description of Artificial Sequence:  Hypothetical Probe Sequence
acggtgtccacgacctgacc

SEQ ID NO: 8655 - DNA, 20 bp, Artificial Sequence
  Description of Artificial Sequence:  Hypothetical Probe Sequence
tcgttgatttgaacggcacg

SEQ ID NO: 8656 - DNA, 20 bp, Artificial Sequence
  Description of Artificial Sequence:  Hypothetical Probe Sequence
tcgtcgttttagacggcagc

SEQ ID NO: 8657 - DNA, 20 bp, Artificial Sequence
  Description of Artificial Sequence:  Hypothetical Probe Sequence
tcgtctcattagcagctgcg

SEQ ID NO: 8658 - DNA, 20 bp, Artificial Sequence
  Description of Artificial Sequence:  Hypothetical Probe Sequence
acggtcgtgcttaggacgtt

SEQ ID NO: 8659 - DNA, 20 bp, Artificial Sequence
  Description of Artificial Sequence:  Hypothetical Probe Sequence
acggtcgtaccttcgttgcg

SEQ ID NO: 8660 - DNA, 20 bp, Artificial Sequence
  Description of Artificial Sequence:  Hypothetical Probe Sequence
tcgtgatgaaagggactgcg

SEQ ID NO: 8661 - DNA, 20 bp, Artificial Sequence
  Description of Artificial Sequence:  Hypothetical Probe Sequence
acggtcgttgcgcttgtcgt

SEQ ID NO: 8662 - DNA, 20 bp, Artificial Sequence
  Description of Artificial Sequence:  Hypothetical Probe Sequence
acggtcgtgtgcccatgatg

SEQ ID NO: 8663 - DNA, 20 bp, Artificial Sequence
  Description of Artificial Sequence:  Hypothetical Probe Sequence
acggtcgtacggatactgcg

SEQ ID NO: 8664 - DNA, 20 bp, Artificial Sequence
  Description of Artificial Sequence:  Hypothetical Probe Sequence
acggcttgtctgaggagtgc

SEQ ID NO: 8665 - DNA, 20 bp, Artificial Sequence
  Description of Artificial Sequence:  Hypothetical Probe Sequence
acggcttgtcgtgcttaatc

SEQ ID NO: 8666 - DNA, 20 bp, Artificial Sequence
  Description of Artificial Sequence:  Hypothetical Probe Sequence
acggcttgggtactcacacg

SEQ ID NO: 8667 - DNA, 20 bp, Artificial Sequence
  Description of Artificial Sequence:  Hypothetical Probe Sequence
acggcttggagtcgttcagc

SEQ ID NO: 8668 - DNA, 20 bp, Artificial Sequence
  Description of Artificial Sequence:  Hypothetical Probe Sequence
acggcttgagtgtccctctg

SEQ ID NO: 8669 - DNA, 20 bp, Artificial Sequence
  Description of Artificial Sequence:  Hypothetical Probe Sequence
acggcttgacctgaccccat

SEQ ID NO: 8670 - DNA, 20 bp, Artificial Sequence
  Description of Artificial Sequence:  Hypothetical Probe Sequence
acggcttgaggaggactccc

SEQ ID NO: 8671 - DNA, 20 bp, Artificial Sequence
  Description of Artificial Sequence:  Hypothetical Probe Sequence
acggcttgcagccagctgat

SEQ ID NO: 8672 - DNA, 20 bp, Artificial Sequence
  Description of Artificial Sequence:  Hypothetical Probe Sequence
acggcttggtgcccattgat

SEQ ID NO: 8673 - DNA, 20 bp, Artificial Sequence
  Description of Artificial Sequence:  Hypothetical Probe Sequence
acggcttgggaccacgacct

SEQ ID NO: 8674 - DNA, 20 bp, Artificial Sequence
  Description of Artificial Sequence:  Hypothetical Probe Sequence
acggcttgacggataccgtt

SEQ ID NO: 8675 - DNA, 20 bp, Artificial Sequence
  Description of Artificial Sequence:  Hypothetical Probe Sequence
acggcgtttgatgatgatcg

SEQ ID NO: 8676 - DNA, 20 bp, Artificial Sequence
  Description of Artificial Sequence:  Hypothetical Probe Sequence
acggcgtttacagaccctgt

SEQ ID NO: 8677 - DNA, 20 bp, Artificial Sequence
  Description of Artificial Sequence:  Hypothetical Probe Sequence
acggcgtttctggtctcagc

SEQ ID NO: 8678 - DNA, 20 bp, Artificial Sequence
  Description of Artificial Sequence:  Hypothetical Probe Sequence
acggcgtttgtcttgaagga

SEQ ID NO: 8679 - DNA, 20 bp, Artificial Sequence
  Description of Artificial Sequence:  Hypothetical Probe Sequence
acggcgttctcattgaaaag

SEQ ID NO: 8680 - DNA, 20 bp, Artificial Sequence
  Description of Artificial Sequence:  Hypothetical Probe Sequence
acggcgttctgtacctcttg

SEQ ID NO: 8681 - DNA, 20 bp, Artificial Sequence
  Description of Artificial Sequence:  Hypothetical Probe Sequence
acggcgttgcttgcttagga

SEQ ID NO: 8682 - DNA, 20 bp, Artificial Sequence
  Description of Artificial Sequence:  Hypothetical Probe Sequence
acggcgttggtatcgtagga

SEQ ID NO: 8683 - DNA, 20 bp, Artificial Sequence
  Description of Artificial Sequence:  Hypothetical Probe Sequence
acggcgttacctagtgacgg

SEQ ID NO: 8684 - DNA, 20 bp, Artificial Sequence
  Description of Artificial Sequence:  Hypothetical Probe Sequence
acggcgttaggaatcggtct

SEQ ID NO: 8685 - DNA, 20 bp, Artificial Sequence
  Description of Artificial Sequence:  Hypothetical Probe Sequence
acggcgttcctaaatcgtgc

SEQ ID NO: 8686 - DNA, 20 bp, Artificial Sequence
  Description of Artificial Sequence:  Hypothetical Probe Sequence
acggcgtttgcgttgagatg

SEQ ID NO: 8687 - DNA, 20 bp, Artificial Sequence
  Description of Artificial Sequence:  Hypothetical Probe Sequence
acggcgttcacggtcttcgt

SEQ ID NO: 8688 - DNA, 20 bp, Artificial Sequence
  Description of Artificial Sequence:  Hypothetical Probe Sequence
acggcgttcagctgcgtgat

SEQ ID NO: 8689 - DNA, 20 bp, Artificial Sequence
  Description of Artificial Sequence:  Hypothetical Probe Sequence
acggcgttggacacctgctt

SEQ ID NO: 8690 - DNA, 20 bp, Artificial Sequence
  Description of Artificial Sequence:  Hypothetical Probe Sequence
acggcgttacggtacaatcg

SEQ ID NO: 8691 - DNA, 20 bp, Artificial Sequence
  Description of Artificial Sequence:  Hypothetical Probe Sequence
acggctcatgatcacgacgg

SEQ ID NO: 8692 - DNA, 20 bp, Artificial Sequence
  Description of Artificial Sequence:  Hypothetical Probe Sequence
acggctcattaggcaacgtt

SEQ ID NO: 8693 - DNA, 20 bp, Artificial Sequence
  Description of Artificial Sequence:  Hypothetical Probe Sequence
acggctcaaaaggtgcgcaa

SEQ ID NO: 8694 - DNA, 20 bp, Artificial Sequence
  Description of Artificial Sequence:  Hypothetical Probe Sequence
acggctcatcgtatcgagtg

SEQ ID NO: 8695 - DNA, 20 bp, Artificial Sequence
  Description of Artificial Sequence:  Hypothetical Probe Sequence
acggctcacgttctgtccat

SEQ ID NO: 8696 - DNA, 20 bp, Artificial Sequence
  Description of Artificial Sequence:  Hypothetical Probe Sequence
acggctcagcttgcaatgcg

SEQ ID NO: 8697 - DNA, 20 bp, Artificial Sequence
  Description of Artificial Sequence:  Hypothetical Probe Sequence
acggctcaggtaatacggac

SEQ ID NO: 8698 - DNA, 20 bp, Artificial Sequence
  Description of Artificial Sequence:  Hypothetical Probe Sequence
acggctcagcaaaggactgt

SEQ ID NO: 8699 - DNA, 20 bp, Artificial Sequence
  Description of Artificial Sequence:  Hypothetical Probe Sequence
acggctcacctacctaagcc

SEQ ID NO: 8700 - DNA, 20 bp, Artificial Sequence
  Description of Artificial Sequence:  Hypothetical Probe Sequence
acggctcatgcggatgagtg

SEQ ID NO: 8701 - DNA, 20 bp, Artificial Sequence
  Description of Artificial Sequence:  Hypothetical Probe Sequence
acggctcagacccttggtgc

SEQ ID NO: 8702 - DNA, 20 bp, Artificial Sequence
  Description of Artificial Sequence:  Hypothetical Probe Sequence
acggctgtaatctctgtccc

SEQ ID NO: 8703 - DNA, 20 bp, Artificial Sequence
  Description of Artificial Sequence:  Hypothetical Probe Sequence
acggctgttctgggacgacc

SEQ ID NO: 8704 - DNA, 20 bp, Artificial Sequence
  Description of Artificial Sequence:  Hypothetical Probe Sequence
acggctgtcgaaagtggacc

SEQ ID NO: 8705 - DNA, 20 bp, Artificial Sequence
  Description of Artificial Sequence:  Hypothetical Probe Sequence
acggctgtgcttctgtgcaa

SEQ ID NO: 8706 - DNA, 20 bp, Artificial Sequence
  Description of Artificial Sequence:  Hypothetical Probe Sequence
acggctgtgtcttgcggagt

SEQ ID NO: 8707 - DNA, 20 bp, Artificial Sequence
  Description of Artificial Sequence:  Hypothetical Probe Sequence
acggctgtgagtagtgagcc

SEQ ID NO: 8708 - DNA, 20 bp, Artificial Sequence
  Description of Artificial Sequence:  Hypothetical Probe Sequence
acggctgtaccttgtcagcc

SEQ ID NO: 8709 - DNA, 20 bp, Artificial Sequence
  Description of Artificial Sequence:  Hypothetical Probe Sequence
acggctgtacggtgattcgt

SEQ ID NO: 8710 - DNA, 20 bp, Artificial Sequence
  Description of Artificial Sequence:  Hypothetical Probe Sequence
acggccattgtccgtttctg

SEQ ID NO: 8711 - DNA, 20 bp, Artificial Sequence
  Description of Artificial Sequence:  Hypothetical Probe Sequence
acggccattcgtgtgcccta

SEQ ID NO: 8712 - DNA, 20 bp, Artificial Sequence
  Description of Artificial Sequence:  Hypothetical Probe Sequence
acggccatctcaacctcttg

SEQ ID NO: 8713 - DNA, 20 bp, Artificial Sequence
  Description of Artificial Sequence:  Hypothetical Probe Sequence
acggccatagtgccatagcc

SEQ ID NO: 8714 - DNA, 20 bp, Artificial Sequence
  Description of Artificial Sequence:  Hypothetical Probe Sequence
acggccatcctagctttgtc

SEQ ID NO: 8715 - DNA, 20 bp, Artificial Sequence
  Description of Artificial Sequence:  Hypothetical Probe Sequence
acggccattcccccatctgt

SEQ ID NO: 8716 - DNA, 20 bp, Artificial Sequence
  Description of Artificial Sequence:  Hypothetical Probe Sequence
acggccattgcgcgttgagt

SEQ ID NO: 8717 - DNA, 20 bp, Artificial Sequence
  Description of Artificial Sequence:  Hypothetical Probe Sequence
acggccatgaccctgtccat

SEQ ID NO: 8718 - DNA, 20 bp, Artificial Sequence
  Description of Artificial Sequence:  Hypothetical Probe Sequence
acggccatagcccctaaaag

SEQ ID NO: 8719 - DNA, 20 bp, Artificial Sequence
  Description of Artificial Sequence:  Hypothetical Probe Sequence
acggcgaattgaagtgatcg

SEQ ID NO: 8720 - DNA, 20 bp, Artificial Sequence
  Description of Artificial Sequence:  Hypothetical Probe Sequence
acggcgaatgataggacagc

SEQ ID NO: 8721 - DNA, 20 bp, Artificial Sequence
  Description of Artificial Sequence:  Hypothetical Probe Sequence
acggcgaattaggatgcttg

SEQ ID NO: 8722 - DNA, 20 bp, Artificial Sequence
  Description of Artificial Sequence:  Hypothetical Probe Sequence
acggcgaaaatctacaatcg

SEQ ID NO: 8723 - DNA, 20 bp, Artificial Sequence
  Description of Artificial Sequence:  Hypothetical Probe Sequence
acggcgaatctgtctgggta

SEQ ID NO: 8724 - DNA, 20 bp, Artificial Sequence
  Description of Artificial Sequence:  Hypothetical Probe Sequence
acggcgaatcgttgatcgtt

SEQ ID NO: 8725 - DNA, 20 bp, Artificial Sequence
  Description of Artificial Sequence:  Hypothetical Probe Sequence
acggcgaacttggagtgtgc

SEQ ID NO: 8726 - DNA, 20 bp, Artificial Sequence
  Description of Artificial Sequence:  Hypothetical Probe Sequence
acggcgaacgtttcgtctgt

SEQ ID NO: 8727 - DNA, 20 bp, Artificial Sequence
  Description of Artificial Sequence:  Hypothetical Probe Sequence
acggcgaactcattgaccat

SEQ ID NO: 8728 - DNA, 20 bp, Artificial Sequence
  Description of Artificial Sequence:  Hypothetical Probe Sequence
acggcgaaggtatctgagtg

SEQ ID NO: 8729 - DNA, 20 bp, Artificial Sequence
  Description of Artificial Sequence:  Hypothetical Probe Sequence
acggcgaagagtgatggatg

SEQ ID NO: 8730 - DNA, 20 bp, Artificial Sequence
  Description of Artificial Sequence:  Hypothetical Probe Sequence
acggcgaaatcgaggatgtc

SEQ ID NO: 8731 - DNA, 20 bp, Artificial Sequence
  Description of Artificial Sequence:  Hypothetical Probe Sequence
acggcgaatcccacctgctt

SEQ ID NO: 8732 - DNA, 20 bp, Artificial Sequence
  Description of Artificial Sequence:  Hypothetical Probe Sequence
acggcgaacacgcttggagt

SEQ ID NO: 8733 - DNA, 20 bp, Artificial Sequence
  Description of Artificial Sequence:  Hypothetical Probe Sequence
acggcgaagtgcacggtcgt

SEQ ID NO: 8734 - DNA, 20 bp, Artificial Sequence
  Description of Artificial Sequence:  Hypothetical Probe Sequence
acggcgaaggacctcacacg

SEQ ID NO: 8735 - DNA, 20 bp, Artificial Sequence
  Description of Artificial Sequence:  Hypothetical Probe Sequence
acggcgaaagccaatccgaa

SEQ ID NO: 8736 - DNA, 20 bp, Artificial Sequence
  Description of Artificial Sequence:  Hypothetical Probe Sequence
acgggcttttgacctaatcg

SEQ ID NO: 8737 - DNA, 20 bp, Artificial Sequence
  Description of Artificial Sequence:  Hypothetical Probe Sequence
acgggctttgattacatgcg

SEQ ID NO: 8738 - DNA, 20 bp, Artificial Sequence
  Description of Artificial Sequence:  Hypothetical Probe Sequence
acgggcttttaggtgccgtt

SEQ ID NO: 8739 - DNA, 20 bp, Artificial Sequence
  Description of Artificial Sequence:  Hypothetical Probe Sequence
acgggcttaaagcctatccc

SEQ ID NO: 8740 - DNA, 20 bp, Artificial Sequence
  Description of Artificial Sequence:  Hypothetical Probe Sequence
acgggctttacatcgtcagc

SEQ ID NO: 8741 - DNA, 20 bp, Artificial Sequence
  Description of Artificial Sequence:  Hypothetical Probe Sequence
acgggcttcgttctcacgtt

SEQ ID NO: 8742 - DNA, 20 bp, Artificial Sequence
  Description of Artificial Sequence:  Hypothetical Probe Sequence
acgggcttctcatcgtccta

SEQ ID NO: 8743 - DNA, 20 bp, Artificial Sequence
  Description of Artificial Sequence:  Hypothetical Probe Sequence
acgggcttctgtaggagctt

SEQ ID NO: 8744 - DNA, 20 bp, Artificial Sequence
  Description of Artificial Sequence:  Hypothetical Probe Sequence
acgggcttggtaaaagctgt

SEQ ID NO: 8745 - DNA, 20 bp, Artificial Sequence
  Description of Artificial Sequence:  Hypothetical Probe Sequence
acgggcttgagtggtagtgc

SEQ ID NO: 8746 - DNA, 20 bp, Artificial Sequence
  Description of Artificial Sequence:  Hypothetical Probe Sequence
acgggctttcccgcttccat

SEQ ID NO: 8747 - DNA, 20 bp, Artificial Sequence
  Description of Artificial Sequence:  Hypothetical Probe Sequence
acgggcttgaccttgattag

SEQ ID NO: 8748 - DNA, 20 bp, Artificial Sequence
  Description of Artificial Sequence:  Hypothetical Probe Sequence
acggggtatgatcacggatg

SEQ ID NO: 8749 - DNA, 20 bp, Artificial Sequence
  Description of Artificial Sequence:  Hypothetical Probe Sequence
acggggtatacaagccgtgc

SEQ ID NO: 8750 - DNA, 20 bp, Artificial Sequence
  Description of Artificial Sequence:  Hypothetical Probe Sequence
acggggtatctgacggagtg

SEQ ID NO: 8751 - DNA, 20 bp, Artificial Sequence
  Description of Artificial Sequence:  Hypothetical Probe Sequence
acggggtacgttcacgaatc

SEQ ID NO: 8752 - DNA, 20 bp, Artificial Sequence
  Description of Artificial Sequence:  Hypothetical Probe Sequence
acggggtactgtgagttccc

SEQ ID NO: 8753 - DNA, 20 bp, Artificial Sequence
  Description of Artificial Sequence:  Hypothetical Probe Sequence
acggggtagcttggtacagc

SEQ ID NO: 8754 - DNA, 20 bp, Artificial Sequence
  Description of Artificial Sequence:  Hypothetical Probe Sequence
acggggtagcaaaatccgaa

SEQ ID NO: 8755 - DNA, 20 bp, Artificial Sequence
  Description of Artificial Sequence:  Hypothetical Probe Sequence
acggggtaaggagtctcacg

SEQ ID NO: 8756 - DNA, 20 bp, Artificial Sequence
  Description of Artificial Sequence:  Hypothetical Probe Sequence
acggggtacctatccctcgt

SEQ ID NO: 8757 - DNA, 20 bp, Artificial Sequence
  Description of Artificial Sequence:  Hypothetical Probe Sequence
acggggtatgcgcgttagga

SEQ ID NO: 8758 - DNA, 20 bp, Artificial Sequence
  Description of Artificial Sequence:  Hypothetical Probe Sequence
acggggtagtgcatacgagt

SEQ ID NO: 8759 - DNA, 20 bp, Artificial Sequence
  Description of Artificial Sequence:  Hypothetical Probe Sequence
acggggtaggactctgcttg

SEQ ID NO: 8760 - DNA, 20 bp, Artificial Sequence
  Description of Artificial Sequence:  Hypothetical Probe Sequence
acggggtaacggcctaaatc

SEQ ID NO: 8761 - DNA, 20 bp, Artificial Sequence
  Description of Artificial Sequence:  Hypothetical Probe Sequence
acggggtaagcccgaactgt

SEQ ID NO: 8762 - DNA, 20 bp, Artificial Sequence
  Description of Artificial Sequence:  Hypothetical Probe Sequence
acgggtctaaagcgaatccc

SEQ ID NO: 8763 - DNA, 20 bp, Artificial Sequence
  Description of Artificial Sequence:  Hypothetical Probe Sequence
acgggtctcgttgcaagatg

SEQ ID NO: 8764 - DNA, 20 bp, Artificial Sequence
  Description of Artificial Sequence:  Hypothetical Probe Sequence
acgggtctctcaagccacct

SEQ ID NO: 8765 - DNA, 20 bp, Artificial Sequence
  Description of Artificial Sequence:  Hypothetical Probe Sequence
acgggtctcgaaggacgtct

SEQ ID NO: 8766 - DNA, 20 bp, Artificial Sequence
  Description of Artificial Sequence:  Hypothetical Probe Sequence
acgggtctatcgacgggctt

SEQ ID NO: 8767 - DNA, 20 bp, Artificial Sequence
  Description of Artificial Sequence:  Hypothetical Probe Sequence
acgggtctgacccttgggac

SEQ ID NO: 8768 - DNA, 20 bp, Artificial Sequence
  Description of Artificial Sequence:  Hypothetical Probe Sequence
acgggtctgtgcaaaggatg

SEQ ID NO: 8769 - DNA, 20 bp, Artificial Sequence
  Description of Artificial Sequence:  Hypothetical Probe Sequence
acgggtctacgggacctcgt

SEQ ID NO: 8770 - DNA, 20 bp, Artificial Sequence
  Description of Artificial Sequence:  Hypothetical Probe Sequence
acgggagttgatctgttccc

SEQ ID NO: 8771 - DNA, 20 bp, Artificial Sequence
  Description of Artificial Sequence:  Hypothetical Probe Sequence
acgggagtcttgcagcacct

SEQ ID NO: 8772 - DNA, 20 bp, Artificial Sequence
  Description of Artificial Sequence:  Hypothetical Probe Sequence
acgggagtctcaagccaaag

SEQ ID NO: 8773 - DNA, 20 bp, Artificial Sequence
  Description of Artificial Sequence:  Hypothetical Probe Sequence
acgggagtggtaagtggtgc

SEQ ID NO: 8774 - DNA, 20 bp, Artificial Sequence
  Description of Artificial Sequence:  Hypothetical Probe Sequence
acgggagtgatggtgctctg

SEQ ID NO: 8775 - DNA, 20 bp, Artificial Sequence
  Description of Artificial Sequence:  Hypothetical Probe Sequence
acgggagttcccctgtcacg

SEQ ID NO: 8776 - DNA, 20 bp, Artificial Sequence
  Description of Artificial Sequence:  Hypothetical Probe Sequence
acgggagtcagctgatgacc

SEQ ID NO: 8777 - DNA, 20 bp, Artificial Sequence
  Description of Artificial Sequence:  Hypothetical Probe Sequence
acgggcaaaatcagtgccat

SEQ ID NO: 8778 - DNA, 20 bp, Artificial Sequence
  Description of Artificial Sequence:  Hypothetical Probe Sequence
acgggcaaatacagtgatcg

SEQ ID NO: 8779 - DNA, 20 bp, Artificial Sequence
  Description of Artificial Sequence:  Hypothetical Probe Sequence
acgggcaatacacttgagcc

SEQ ID NO: 8780 - DNA, 20 bp, Artificial Sequence
  Description of Artificial Sequence:  Hypothetical Probe Sequence
acgggcaacgttttagccta

SEQ ID NO: 8781 - DNA, 20 bp, Artificial Sequence
  Description of Artificial Sequence:  Hypothetical Probe Sequence
acgggcaagcttcgaacagc

SEQ ID NO: 8782 - DNA, 20 bp, Artificial Sequence
  Description of Artificial Sequence:  Hypothetical Probe Sequence
acgggcaagagtctcagacc

SEQ ID NO: 8783 - DNA, 20 bp, Artificial Sequence
  Description of Artificial Sequence:  Hypothetical Probe Sequence
acgggcaagcaaatcgcgtt

SEQ ID NO: 8784 - DNA, 20 bp, Artificial Sequence
  Description of Artificial Sequence:  Hypothetical Probe Sequence
acgggcaacctacacgccta

SEQ ID NO: 8785 - DNA, 20 bp, Artificial Sequence
  Description of Artificial Sequence:  Hypothetical Probe Sequence
acgggcaaacggccatgtct

SEQ ID NO: 8786 - DNA, 20 bp, Artificial Sequence
  Description of Artificial Sequence:  Hypothetical Probe Sequence
acgggcaaagcctctgccta

SEQ ID NO: 8787 - DNA, 20 bp, Artificial Sequence
  Description of Artificial Sequence:  Hypothetical Probe Sequence
acggagtgcgaattgatcgt

SEQ ID NO: 8788 - DNA, 20 bp, Artificial Sequence
  Description of Artificial Sequence:  Hypothetical Probe Sequence
acggagtgggtacgaagtgc

SEQ ID NO: 8789 - DNA, 20 bp, Artificial Sequence
  Description of Artificial Sequence:  Hypothetical Probe Sequence
agtggagttgtctccccagc

SEQ ID NO: 8790 - DNA, 20 bp, Artificial Sequence
  Description of Artificial Sequence:  Hypothetical Probe Sequence
acggagtggcaacagccttg

SEQ ID NO: 8791 - DNA, 20 bp, Artificial Sequence
  Description of Artificial Sequence:  Hypothetical Probe Sequence
acggagtgatcgtcgtctca

SEQ ID NO: 8792 - DNA, 20 bp, Artificial Sequence
  Description of Artificial Sequence:  Hypothetical Probe Sequence
acggagtgcctacgtttgtc

SEQ ID NO: 8793 - DNA, 20 bp, Artificial Sequence
  Description of Artificial Sequence:  Hypothetical Probe Sequence
acggagtgtgcgtcgtgcaa

SEQ ID NO: 8794 - DNA, 20 bp, Artificial Sequence
  Description of Artificial Sequence:  Hypothetical Probe Sequence
acggagtgggacgcttgcaa

SEQ ID NO: 8795 - DNA, 20 bp, Artificial Sequence
  Description of Artificial Sequence:  Hypothetical Probe Sequence
accttgatgatgtcccacgg

SEQ ID NO: 8796 - DNA, 20 bp, Artificial Sequence
  Description of Artificial Sequence:  Hypothetical Probe Sequence
acggaccttgtccgttgacc

SEQ ID NO: 8797 - DNA, 20 bp, Artificial Sequence
  Description of Artificial Sequence:  Hypothetical Probe Sequence
acggacctcttgcacgccta

SEQ ID NO: 8798 - DNA, 20 bp, Artificial Sequence
  Description of Artificial Sequence:  Hypothetical Probe Sequence
acggacctgcttaaagccat

SEQ ID NO: 8799 - DNA, 20 bp, Artificial Sequence
  Description of Artificial Sequence:  Hypothetical Probe Sequence
acggacctgtctgaccccat

SEQ ID NO: 8800 - DNA, 20 bp, Artificial Sequence
  Description of Artificial Sequence:  Hypothetical Probe Sequence
acggaccttcccgagtttga

SEQ ID NO: 8801 - DNA, 20 bp, Artificial Sequence
  Description of Artificial Sequence:  Hypothetical Probe Sequence
acggacctgaccaaagacgg

SEQ ID NO: 8802 - DNA, 20 bp, Artificial Sequence
  Description of Artificial Sequence:  Hypothetical Probe Sequence
acggacctagccgctttctg

SEQ ID NO: 8803 - DNA, 20 bp, Artificial Sequence
  Description of Artificial Sequence:  Hypothetical Probe Sequence
acggatcgaaagtcccaaag

SEQ ID NO: 8804 - DNA, 20 bp, Artificial Sequence
  Description of Artificial Sequence:  Hypothetical Probe Sequence
acggatcgtgtccgaacacg

SEQ ID NO: 8805 - DNA, 20 bp, Artificial Sequence
  Description of Artificial Sequence:  Hypothetical Probe Sequence
acggatcgctcacgaatccc

SEQ ID NO: 8806 - DNA, 20 bp, Artificial Sequence
  Description of Artificial Sequence:  Hypothetical Probe Sequence
atcgctgtctgtgatgcgaa

SEQ ID NO: 8807 - DNA, 20 bp, Artificial Sequence
  Description of Artificial Sequence:  Hypothetical Probe Sequence
acggatcggagtcgaacgaa

SEQ ID NO: 8808 - DNA, 20 bp, Artificial Sequence
  Description of Artificial Sequence:  Hypothetical Probe Sequence
acggatcggcaacttggacc

SEQ ID NO: 8809 - DNA, 20 bp, Artificial Sequence
  Description of Artificial Sequence:  Hypothetical Probe Sequence
acggatcgagtgtctgccat

SEQ ID NO: 8810 - DNA, 20 bp, Artificial Sequence
  Description of Artificial Sequence:  Hypothetical Probe Sequence
acggatcgacctcttgacgg

SEQ ID NO: 8811 - DNA, 20 bp, Artificial Sequence
  Description of Artificial Sequence:  Hypothetical Probe Sequence
acggatcgcagctccctgat

SEQ ID NO: 8812 - DNA, 20 bp, Artificial Sequence
  Description of Artificial Sequence:  Hypothetical Probe Sequence
acggatcgggacggacttag

SEQ ID NO: 8813 - DNA, 20 bp, Artificial Sequence
  Description of Artificial Sequence:  Hypothetical Probe Sequence
atcgacggctcagagttgcg

SEQ ID NO: 8814 - DNA, 20 bp, Artificial Sequence
  Description of Artificial Sequence:  Hypothetical Probe Sequence
acggatcgagcccctaagga

SEQ ID NO: 8815 - DNA, 20 bp, Artificial Sequence
  Description of Artificial Sequence:  Hypothetical Probe Sequences sp.
acggaggatctggcaaacct

SEQ ID NO: 8816 - DNA, 20 bp, Artificial Sequence
  Description of Artificial Sequence:  Hypothetical Probe Sequence
acggaggaccataatcgatg

SEQ ID NO: 8817 - DNA, 20 bp, Artificial Sequence
  Description of Artificial Sequence:  Hypothetical Probe Sequence
acggaggagcttgtgccgtt

SEQ ID NO: 8818 - DNA, 20 bp, Artificial Sequence
  Description of Artificial Sequence:  Hypothetical Probe Sequence
aggaggtatcgtgtgctgcg

SEQ ID NO: 8819 - DNA, 20 bp, Artificial Sequence
  Description of Artificial Sequence:  Hypothetical Probe Sequence
aggagtctagcccacgtgcg

SEQ ID NO: 8820 - DNA, 20 bp, Artificial Sequence
  Description of Artificial Sequence:  Hypothetical Probe Sequence
acggaggagcaaagccaatc

SEQ ID NO: 8821 - DNA, 20 bp, Artificial Sequence
  Description of Artificial Sequence:  Hypothetical Probe Sequence
acggaggatgcgcctaacct

SEQ ID NO: 8822 - DNA, 20 bp, Artificial Sequence
  Description of Artificial Sequence:  Hypothetical Probe Sequence
acggcctatctggagtcagc

SEQ ID NO: 8823 - DNA, 20 bp, Artificial Sequence
  Description of Artificial Sequence:  Hypothetical Probe Sequence
acggcctactgtggacacgg

SEQ ID NO: 8824 - DNA, 20 bp, Artificial Sequence
  Description of Artificial Sequence:  Hypothetical Probe Sequence
acggcctagagttcgtggac

SEQ ID NO: 8825 - DNA, 20 bp, Artificial Sequence
  Description of Artificial Sequence:  Hypothetical Probe Sequence
acggcctacctatccctgtc

SEQ ID NO: 8826 - DNA, 20 bp, Artificial Sequence
  Description of Artificial Sequence:  Hypothetical Probe Sequence
acgggatgaatcccatagga

SEQ ID NO: 8827 - DNA, 20 bp, Artificial Sequence
  Description of Artificial Sequence:  Hypothetical Probe Sequence
acgggatgccatcgaattag

SEQ ID NO: 8828 - DNA, 20 bp, Artificial Sequence
  Description of Artificial Sequence:  Hypothetical Probe Sequence
acgggatgatcggagtcgtt

SEQ ID NO: 8829 - DNA, 20 bp, Artificial Sequence
  Description of Artificial Sequence:  Hypothetical Probe Sequence
acgggatgcctaagtgcttg

SEQ ID NO: 8830 - DNA, 20 bp, Artificial Sequence
  Description of Artificial Sequence:  Hypothetical Probe Sequence
acgggatgggaccacgatac

SEQ ID NO: 8831 - DNA, 20 bp, Artificial Sequence
  Description of Artificial Sequence:  Hypothetical Probe Sequence
acgggatgagccgtgcacgg

SEQ ID NO: 8832 - DNA, 20 bp, Artificial Sequence
  Description of Artificial Sequence:  Hypothetical Probe Sequence
acggtcccttgacgttgcaa

SEQ ID NO: 8833 - DNA, 20 bp, Artificial Sequence
  Description of Artificial Sequence:  Hypothetical Probe Sequence
acggtcccctcaaatcacgg

SEQ ID NO: 8834 - DNA, 20 bp, Artificial Sequence
  Description of Artificial Sequence:  Hypothetical Probe Sequence
acggtcccccatacctgacc

SEQ ID NO: 8835 - DNA, 20 bp, Artificial Sequence
  Description of Artificial Sequence:  Hypothetical Probe Sequence
acggtcccagtgtgtctgcg

SEQ ID NO: 8836 - DNA, 20 bp, Artificial Sequence
  Description of Artificial Sequence:  Hypothetical Probe Sequence
acggtcccatcggcttgtct

SEQ ID NO: 8837 - DNA, 20 bp, Artificial Sequence
  Description of Artificial Sequence:  Hypothetical Probe Sequence
acggtccccctatcgtgatg

SEQ ID NO: 8838 - DNA, 20 bp, Artificial Sequence
  Description of Artificial Sequence:  Hypothetical Probe Sequence
tcccgatgtgatttagcacg

SEQ ID NO: 8839 - DNA, 20 bp, Artificial Sequence
  Description of Artificial Sequence:  Hypothetical Probe Sequence
tgcgttgaatacagccgacc

SEQ ID NO: 8840 - DNA, 20 bp, Artificial Sequence
  Description of Artificial Sequence:  Hypothetical Probe Sequence
acggtgcgtgataggatctg

SEQ ID NO: 8841 - DNA, 20 bp, Artificial Sequence
  Description of Artificial Sequence:  Hypothetical Probe Sequence
acggtgcgttagggacgacc

SEQ ID NO: 8842 - DNA, 20 bp, Artificial Sequence
  Description of Artificial Sequence:  Hypothetical Probe Sequence
tgcgatacaatcatcgcgtt

SEQ ID NO: 8843 - DNA, 20 bp, Artificial Sequence
  Description of Artificial Sequence:  Hypothetical Probe Sequence
acggtgcgtacacgttggac

SEQ ID NO: 8844 - DNA, 20 bp, Artificial Sequence
  Description of Artificial Sequence:  Hypothetical Probe Sequence
acggtgcgcttgcctaagga

SEQ ID NO: 8845 - DNA, 20 bp, Artificial Sequence
  Description of Artificial Sequence:  Hypothetical Probe Sequence
acggtgcgccatatacgacc

SEQ ID NO: 8846 - DNA, 20 bp, Artificial Sequence
  Description of Artificial Sequence:  Hypothetical Probe Sequence
tgcgagtgctgtcagccagc

SEQ ID NO: 8847 - DNA, 20 bp, Artificial Sequence
  Description of Artificial Sequence:  Hypothetical Probe Sequence
tgcgaggactcagatgcagc

SEQ ID NO: 8848 - DNA, 20 bp, Artificial Sequence
  Description of Artificial Sequence:  Hypothetical Probe Sequence
acggtgcgtgcgcacgaatc

SEQ ID NO: 8849 - DNA, 20 bp, Artificial Sequence
  Description of Artificial Sequence:  Hypothetical Probe Sequence
acggtgcgcacggtgcctgt

SEQ ID NO: 8850 - DNA, 20 bp, Artificial Sequence
  Description of Artificial Sequence:  Hypothetical Probe Sequence
acggtgcgcagcacctccat

SEQ ID NO: 8851 - DNA, 20 bp, Artificial Sequence
  Description of Artificial Sequence:  Hypothetical Probe Sequence
acggtgcggtgcgagtgctt

SEQ ID NO: 8852 - DNA, 20 bp, Artificial Sequence
  Description of Artificial Sequence:  Hypothetical Probe Sequence
acggtgcgggaccagcacct

SEQ ID NO: 8853 - DNA, 20 bp, Artificial Sequence
  Description of Artificial Sequence:  Hypothetical Probe Sequence
acggtgcgagcccttggagt

SEQ ID NO: 8854 - DNA, 20 bp, Artificial Sequence
  Description of Artificial Sequence:  Hypothetical Probe Sequence
acggcacgttgaggactgat

SEQ ID NO: 8855 - DNA, 20 bp, Artificial Sequence
  Description of Artificial Sequence:  Hypothetical Probe Sequence
acggcacgtgatacggtgat

SEQ ID NO: 8856 - DNA, 20 bp, Artificial Sequence
  Description of Artificial Sequence:  Hypothetical Probe Sequence
acggcacgttagagtgatcg

SEQ ID NO: 8857 - DNA, 20 bp, Artificial Sequence
  Description of Artificial Sequence:  Hypothetical Probe Sequence
acggcacgaatccagctctg

SEQ ID NO: 8858 - DNA, 20 bp, Artificial Sequence
  Description of Artificial Sequence:  Hypothetical Probe Sequence
acggcacgtacatgattgcg

SEQ ID NO: 8859 - DNA, 20 bp, Artificial Sequence
  Description of Artificial Sequence:  Hypothetical Probe Sequence
acggcacgtctgctcaatcg

SEQ ID NO: 8860 - DNA, 20 bp, Artificial Sequence
  Description of Artificial Sequence:  Hypothetical Probe Sequence
acggcacgtcgtgcttcgaa

SEQ ID NO: 8861 - DNA, 20 bp, Artificial Sequence
  Description of Artificial Sequence:  Hypothetical Probe Sequence
acggcacggagtctcacagc

SEQ ID NO: 8862 - DNA, 20 bp, Artificial Sequence
  Description of Artificial Sequence:  Hypothetical Probe Sequence
acggcacgacctcgaatctg

SEQ ID NO: 8863 - DNA, 20 bp, Artificial Sequence
  Description of Artificial Sequence:  Hypothetical Probe Sequence
acggcacgcagctgatggac

SEQ ID NO: 8864 - DNA, 20 bp, Artificial Sequence
  Description of Artificial Sequence:  Hypothetical Probe Sequence
acggcacgggacggacggta

SEQ ID NO: 8865 - DNA, 20 bp, Artificial Sequence
  Description of Artificial Sequence:  Hypothetical Probe Sequence
acggcacgacggtcgtgagt

SEQ ID NO: 8866 - DNA, 20 bp, Artificial Sequence
  Description of Artificial Sequence:  Hypothetical Probe Sequence
acggcagcttagaaagccat

SEQ ID NO: 8867 - DNA, 20 bp, Artificial Sequence
  Description of Artificial Sequence:  Hypothetical Probe Sequence
acggcagctgtccgaaatac

SEQ ID NO: 8868 - DNA, 20 bp, Artificial Sequence
  Description of Artificial Sequence:  Hypothetical Probe Sequence
acggcagccttgctcagatg

SEQ ID NO: 8869 - DNA, 20 bp, Artificial Sequence
  Description of Artificial Sequence:  Hypothetical Probe Sequence
acggcagcctgtttagacgg

SEQ ID NO: 8870 - DNA, 20 bp, Artificial Sequence
  Description of Artificial Sequence:  Hypothetical Probe Sequence
acggcagcccataatccacg

SEQ ID NO: 8871 - DNA, 20 bp, Artificial Sequence
  Description of Artificial Sequence:  Hypothetical Probe Sequence
acggcagccgaactgttcgt

SEQ ID NO: 8872 - DNA, 20 bp, Artificial Sequence
  Description of Artificial Sequence:  Hypothetical Probe Sequence
acggcagcgcttgagtgagt

SEQ ID NO: 8873 - DNA, 20 bp, Artificial Sequence
  Description of Artificial Sequence:  Hypothetical Probe Sequence
acggcagcggtacacgttag

SEQ ID NO: 8874 - DNA, 20 bp, Artificial Sequence
  Description of Artificial Sequence:  Hypothetical Probe Sequence
acggcagcaggagtctacgg

SEQ ID NO: 8875 - DNA, 20 bp, Artificial Sequence
  Description of Artificial Sequence:  Hypothetical Probe Sequence
acggcagccacgaggagcaa

SEQ ID NO: 8876 - DNA, 20 bp, Artificial Sequence
  Description of Artificial Sequence:  Hypothetical Probe Sequence
acggcagccagcctgtcgaa

SEQ ID NO: 8877 - DNA, 20 bp, Artificial Sequence
  Description of Artificial Sequence:  Hypothetical Probe Sequence
acggcagcgtgccctatccc

SEQ ID NO: 8878 - DNA, 20 bp, Artificial Sequence
  Description of Artificial Sequence:  Hypothetical Probe Sequence
acggcagcacggtcgtgacc

SEQ ID NO: 8879 - DNA, 20 bp, Artificial Sequence
  Description of Artificial Sequence:  Hypothetical Probe Sequence
acgggaccttgattgacgtt

SEQ ID NO: 8880 - DNA, 20 bp, Artificial Sequence
  Description of Artificial Sequence:  Hypothetical Probe Sequence
acgggaccaatcacctgacc

SEQ ID NO: 8881 - DNA, 20 bp, Artificial Sequence
  Description of Artificial Sequence:  Hypothetical Probe Sequence
acgggaccaaagaatcgatg

SEQ ID NO: 8882 - DNA, 20 bp, Artificial Sequence
  Description of Artificial Sequence:  Hypothetical Probe Sequence
acgggacctacacagcgcaa

SEQ ID NO: 8883 - DNA, 20 bp, Artificial Sequence
  Description of Artificial Sequence:  Hypothetical Probe Sequence
acgggacccgttgtcttcgt

SEQ ID NO: 8884 - DNA, 20 bp, Artificial Sequence
  Description of Artificial Sequence:  Hypothetical Probe Sequence
acgggaccctcagtgcgatg

SEQ ID NO: 8885 - DNA, 20 bp, Artificial Sequence
  Description of Artificial Sequence:  Hypothetical Probe Sequence
acgggaccccatacctcgaa

SEQ ID NO: 8886 - DNA, 20 bp, Artificial Sequence
  Description of Artificial Sequence:  Hypothetical Probe Sequence
acgggacccgaactcatgtc

SEQ ID NO: 8887 - DNA, 20 bp, Artificial Sequence
  Description of Artificial Sequence:  Hypothetical Probe Sequence
acgggaccgcttaatcccta

SEQ ID NO: 8888 - DNA, 20 bp, Artificial Sequence
  Description of Artificial Sequence:  Hypothetical Probe Sequence
acgggaccatcgtcccacct

SEQ ID NO: 8889 - DNA, 20 bp, Artificial Sequence
  Description of Artificial Sequence:  Hypothetical Probe Sequence
acgggaccgatggatgcagc

SEQ ID NO: 8890 - DNA, 20 bp, Artificial Sequence
  Description of Artificial Sequence:  Hypothetical Probe Sequence
acgggacctcccatcgggta

SEQ ID NO: 8891 - DNA, 20 bp, Artificial Sequence
  Description of Artificial Sequence:  Hypothetical Probe Sequence
acgggacccagccgaaccta

SEQ ID NO: 8892 - DNA, 20 bp, Artificial Sequence
  Description of Artificial Sequence:  Hypothetical Probe Sequence
acgggaccgtgcggacttag

SEQ ID NO: 8893 - DNA, 20 bp, Artificial Sequence
  Description of Artificial Sequence:  Hypothetical Probe Sequence
acgggtgcttgagtctagcc

SEQ ID NO: 8894 - DNA, 20 bp, Artificial Sequence
  Description of Artificial Sequence:  Hypothetical Probe Sequence
acgggtgctgatttgaatcg

SEQ ID NO: 8895 - DNA, 20 bp, Artificial Sequence
  Description of Artificial Sequence:  Hypothetical Probe Sequence
acgggtgcttagtctggctt

SEQ ID NO: 8896 - DNA, 20 bp, Artificial Sequence
  Description of Artificial Sequence:  Hypothetical Probe Sequence
acgggtgcaatcgcttcttg

SEQ ID NO: 8897 - DNA, 20 bp, Artificial Sequence
  Description of Artificial Sequence:  Hypothetical Probe Sequence
acgggtgcatacacctgacc

SEQ ID NO: 8898 - DNA, 20 bp, Artificial Sequence
  Description of Artificial Sequence:  Hypothetical Probe Sequence
acgggtgctgtcggactctg

SEQ ID NO: 8899 - DNA, 20 bp, Artificial Sequence
  Description of Artificial Sequence:  Hypothetical Probe Sequence
acgggtgcctcactgttgtc

SEQ ID NO: 8900 - DNA, 20 bp, Artificial Sequence
  Description of Artificial Sequence:  Hypothetical Probe Sequence
acgggtgccgaagaccccta

SEQ ID NO: 8901 - DNA, 20 bp, Artificial Sequence
  Description of Artificial Sequence:  Hypothetical Probe Sequence
acgggtgcgcttgcttttga

SEQ ID NO: 8902 - DNA, 20 bp, Artificial Sequence
  Description of Artificial Sequence:  Hypothetical Probe Sequence
acgggtgcgtctcctaacgg

SEQ ID NO: 8903 - DNA, 20 bp, Artificial Sequence
  Description of Artificial Sequence:  Hypothetical Probe Sequence
acgggtgcgcaacagctgat

SEQ ID NO: 8904 - DNA, 20 bp, Artificial Sequence
  Description of Artificial Sequence:  Hypothetical Probe Sequence
acgggtgcagtggaccacgg

SEQ ID NO: 8905 - DNA, 20 bp, Artificial Sequence
  Description of Artificial Sequence:  Hypothetical Probe Sequence
acgggtgcacctgcaactca

SEQ ID NO: 8906 - DNA, 20 bp, Artificial Sequence
  Description of Artificial Sequence:  Hypothetical Probe Sequence
acgggtgctgcgaggaatac

SEQ ID NO: 8907 - DNA, 20 bp, Artificial Sequence
  Description of Artificial Sequence:  Hypothetical Probe Sequence
acgggtgcgaccatcgggta

SEQ ID NO: 8908 - DNA, 20 bp, Artificial Sequence
  Description of Artificial Sequence:  Hypothetical Probe Sequence
acgggtgcggaccacgggta

SEQ ID NO: 8909 - DNA, 20 bp, Artificial Sequence
  Description of Artificial Sequence:  Hypothetical Probe Sequence
acggggacttgaaaagttga

SEQ ID NO: 8910 - DNA, 20 bp, Artificial Sequence
  Description of Artificial Sequence:  Hypothetical Probe Sequence
acggggacttagtgcggcaa

SEQ ID NO: 8911 - DNA, 20 bp, Artificial Sequence
  Description of Artificial Sequence:  Hypothetical Probe Sequence
acggggactacaacggggac

SEQ ID NO: 8912 - DNA, 20 bp, Artificial Sequence
  Description of Artificial Sequence:  Hypothetical Probe Sequence
acggggaccttgacggttga

SEQ ID NO: 8913 - DNA, 20 bp, Artificial Sequence
  Description of Artificial Sequence:  Hypothetical Probe Sequence
acggggaccgttatcgcgaa

SEQ ID NO: 8914 - DNA, 20 bp, Artificial Sequence
  Description of Artificial Sequence:  Hypothetical Probe Sequence
acggggacggtaaggaaatc

SEQ ID NO: 8915 - DNA, 20 bp, Artificial Sequence
  Description of Artificial Sequence:  Hypothetical Probe Sequence
acggggacgcaaagtgccat

SEQ ID NO: 8916 - DNA, 20 bp, Artificial Sequence
  Description of Artificial Sequence:  Hypothetical Probe Sequence
acggggacacctgagttccc

SEQ ID NO: 8917 - DNA, 20 bp, Artificial Sequence
  Description of Artificial Sequence:  Hypothetical Probe Sequence
acggggacatcgtcccatcg

SEQ ID NO: 8918 - DNA, 20 bp, Artificial Sequence
  Description of Artificial Sequence:  Hypothetical Probe Sequence
acggggactcccgatgctca

SEQ ID NO: 8919 - DNA, 20 bp, Artificial Sequence
  Description of Artificial Sequence:  Hypothetical Probe Sequence
acggggactgcgctgtgctt

SEQ ID NO: 8920 - DNA, 20 bp, Artificial Sequence
  Description of Artificial Sequence:  Hypothetical Probe Sequence
acggggacgtgcgcaaccta

SEQ ID NO: 8921 - DNA, 20 bp, Artificial Sequence
  Description of Artificial Sequence:  Hypothetical Probe Sequence
acggacggttgaggtacacg

SEQ ID NO: 8922 - DNA, 20 bp, Artificial Sequence
  Description of Artificial Sequence:  Hypothetical Probe Sequence
acggacggtacacgaacagc

SEQ ID NO: 8923 - DNA, 20 bp, Artificial Sequence
  Description of Artificial Sequence:  Hypothetical Probe Sequence
acggtctgaatcaccttgcg

SEQ ID NO: 8924 - DNA, 20 bp, Artificial Sequence
  Description of Artificial Sequence:  Hypothetical Probe Sequence
acggacggtcgtggtagacc

SEQ ID NO: 8925 - DNA, 20 bp, Artificial Sequence
  Description of Artificial Sequence:  Hypothetical Probe Sequence
acggacggctcagtcttccc

SEQ ID NO: 8926 - DNA, 20 bp, Artificial Sequence
  Description of Artificial Sequence:  Hypothetical Probe Sequence
acgggagttcgtaatctgcg

SEQ ID NO: 8927 - DNA, 20 bp, Artificial Sequence
  Description of Artificial Sequence:  Hypothetical Probe Sequence
acggacgggcaatcgtcagc

SEQ ID NO: 8928 - DNA, 20 bp, Artificial Sequence
  Description of Artificial Sequence:  Hypothetical Probe Sequence
acggacggacctggtagtgc

SEQ ID NO: 8929 - DNA, 20 bp, Artificial Sequence
  Description of Artificial Sequence:  Hypothetical Probe Sequence
acggacgggatgtcccaaag

SEQ ID NO: 8930 - DNA, 20 bp, Artificial Sequence
  Description of Artificial Sequence:  Hypothetical Probe Sequence
acggacggtccctctgggta

SEQ ID NO: 8931 - DNA, 20 bp, Artificial Sequence
  Description of Artificial Sequence:  Hypothetical Probe Sequence
acggacggcagcttgacgaa

SEQ ID NO: 8932 - DNA, 20 bp, Artificial Sequence
  Description of Artificial Sequence:  Hypothetical Probe Sequence
acggacgggtgcctgtcgaa

SEQ ID NO: 8933 - DNA, 20 bp, Artificial Sequence
  Description of Artificial Sequence:  Hypothetical Probe Sequence
acggacggagccgcttgtct

SEQ ID NO: 8934 - DNA, 20 bp, Artificial Sequence
  Description of Artificial Sequence:  Hypothetical Probe Sequence
acggagccttagcttggacc

SEQ ID NO: 8935 - DNA, 20 bp, Artificial Sequence
  Description of Artificial Sequence:  Hypothetical Probe Sequence
agccaatcgtctatcggcaa

SEQ ID NO: 8936 - DNA, 20 bp, Artificial Sequence
  Description of Artificial Sequence:  Hypothetical Probe Sequence
acggagcctgtccgaagcaa

SEQ ID NO: 8937 - DNA, 20 bp, Artificial Sequence
  Description of Artificial Sequence:  Hypothetical Probe Sequence
acggagcctcgtggtatgat

SEQ ID NO: 8938 - DNA, 20 bp, Artificial Sequence
  Description of Artificial Sequence:  Hypothetical Probe Sequence
acggagccctgttcccaatc

SEQ ID NO: 8939 - DNA, 20 bp, Artificial Sequence
  Description of Artificial Sequence:  Hypothetical Probe Sequence
acggagcccgaagatgggta

SEQ ID NO: 8940 - DNA, 20 bp, Artificial Sequence
  Description of Artificial Sequence:  Hypothetical Probe Sequence
acggagccagtgggactgtc

SEQ ID NO: 8941 - DNA, 20 bp, Artificial Sequence
  Description of Artificial Sequence:  Hypothetical Probe Sequence
acggagcccctatacatccc

SEQ ID NO: 8942 - DNA, 20 bp, Artificial Sequence
  Description of Artificial Sequence:  Hypothetical Probe Sequence
acggagccgatgaatcagga

SEQ ID NO: 8943 - DNA, 20 bp, Artificial Sequence
  Description of Artificial Sequence:  Hypothetical Probe Sequence
acggagcctcccgcaaggta

SEQ ID NO: 8944 - DNA, 20 bp, Artificial Sequence
  Description of Artificial Sequence:  Hypothetical Probe Sequence
acggagcccagcgatgttga

SEQ ID NO: 8945 - DNA, 20 bp, Artificial Sequence
  Description of Artificial Sequence:  Hypothetical Probe Sequence
agccgacccctatgtccacg

SEQ ID NO: 8946 - DNA, 20 bp, Artificial Sequence
  Description of Artificial Sequence:  Hypothetical Probe Sequence
acggagccggacgatgctgt

SEQ ID NO: 8947 - DNA, 20 bp, Artificial Sequence
  Description of Artificial Sequence:  Hypothetical Probe Sequence
acggagccacggttgacgtt

SEQ ID NO: 8948 - DNA, 20 bp, Artificial Sequence
  Description of Artificial Sequence:  Hypothetical Probe Sequence
agccttgaaaagtgcgcgaa

SEQ ID NO: 8949 - DNA, 20 bp, Artificial Sequence
  Description of Artificial Sequence:  Hypothetical Probe Sequence
ttgatcgtgcttgcaaagcc

SEQ ID NO: 8950 - DNA, 20 bp, Artificial Sequence
  Description of Artificial Sequence:  Hypothetical Probe Sequence
ttgacgttctcaagcccacg

SEQ ID NO: 8951 - DNA, 20 bp, Artificial Sequence
  Description of Artificial Sequence:  Hypothetical Probe Sequence
ttgagcttgtgcacgggacc

SEQ ID NO: 8952 - DNA, 20 bp, Artificial Sequence
  Description of Artificial Sequence:  Hypothetical Probe Sequence
ttgagcaatgtcgatgcgaa

SEQ ID NO: 8953 - DNA, 20 bp, Artificial Sequence
  Description of Artificial Sequence:  Hypothetical Probe Sequence
ttgaaggaacctggaccgaa

SEQ ID NO: 8954 - DNA, 20 bp, Artificial Sequence
  Description of Artificial Sequence:  Hypothetical Probe Sequence
ttgagatgtgcgacggcgtt

SEQ ID NO: 8955 - DNA, 20 bp, Artificial Sequence
  Description of Artificial Sequence:  Hypothetical Probe Sequence
ttgaggacgcaacttgtgcg

SEQ ID NO: 8956 - DNA, 20 bp, Artificial Sequence
  Description of Artificial Sequence:  Hypothetical Probe Sequence
tgatgcttacggtgtctgcg

SEQ ID NO: 8957 - DNA, 20 bp, Artificial Sequence
  Description of Artificial Sequence:  Hypothetical Probe Sequence
agccttaggcttcagcgatg

SEQ ID NO: 8958 - DNA, 20 bp, Artificial Sequence
  Description of Artificial Sequence:  Hypothetical Probe Sequence
agccttagcagcatcgcttg

SEQ ID NO: 8959 - DNA, 20 bp, Artificial Sequence
  Description of Artificial Sequence:  Hypothetical Probe Sequence
agccaatccgtttgtcgtgc

SEQ ID NO: 8960 - DNA, 20 bp, Artificial Sequence
  Description of Artificial Sequence:  Hypothetical Probe Sequence
agccaatcgcaagagtacgg

SEQ ID NO: 8961 - DNA, 20 bp, Artificial Sequence
  Description of Artificial Sequence:  Hypothetical Probe Sequence
agccaatcagtgagccacgg

SEQ ID NO: 8962 - DNA, 20 bp, Artificial Sequence
  Description of Artificial Sequence:  Hypothetical Probe Sequence
agccaatcaggatgcggctt

SEQ ID NO: 8963 - DNA, 20 bp, Artificial Sequence
  Description of Artificial Sequence:  Hypothetical Probe Sequence
aatccctatgtctccccacg

SEQ ID NO: 8964 - DNA, 20 bp, Artificial Sequence
  Description of Artificial Sequence:  Hypothetical Probe Sequence
agccaatcgatgaaagtgcg

SEQ ID NO: 8965 - DNA, 20 bp, Artificial Sequence
  Description of Artificial Sequence:  Hypothetical Probe Sequence
agccaatcggactacacacg

SEQ ID NO: 8966 - DNA, 20 bp, Artificial Sequence
  Description of Artificial Sequence:  Hypothetical Probe Sequence
agccaatcagccctgtacgg

SEQ ID NO: 8967 - DNA, 20 bp, Artificial Sequence
  Description of Artificial Sequence:  Hypothetical Probe Sequence
agccataccgttacggtgtc

SEQ ID NO: 8968 - DNA, 20 bp, Artificial Sequence
  Description of Artificial Sequence:  Hypothetical Probe Sequence
agccatacgcttctcaatcg

SEQ ID NO: 8969 - DNA, 20 bp, Artificial Sequence
  Description of Artificial Sequence:  Hypothetical Probe Sequence
agccatacacctggacccat

SEQ ID NO: 8970 - DNA, 20 bp, Artificial Sequence
  Description of Artificial Sequence:  Hypothetical Probe Sequence
agccatacaggatcccgtgc

SEQ ID NO: 8971 - DNA, 20 bp, Artificial Sequence
  Description of Artificial Sequence:  Hypothetical Probe Sequence
agccataccagcgaccggac

SEQ ID NO: 8972 - DNA, 20 bp, Artificial Sequence
  Description of Artificial Sequence:  Hypothetical Probe Sequence
agccatacgtgcctcatgcg

SEQ ID NO: 8973 - DNA, 20 bp, Artificial Sequence
  Description of Artificial Sequence:  Hypothetical Probe Sequence
agccaaagtgattcccgacc

SEQ ID NO: 8974 - DNA, 20 bp, Artificial Sequence
  Description of Artificial Sequence:  Hypothetical Probe Sequence
aaagtctggcaagctttgcg

SEQ ID NO: 8975 - DNA, 20 bp, Artificial Sequence
  Description of Artificial Sequence:  Hypothetical Probe Sequence
agccaaaggcaaggacagtg

SEQ ID NO: 8976 - DNA, 20 bp, Artificial Sequence
  Description of Artificial Sequence:  Hypothetical Probe Sequence
aaagagtggtgcgtgcacgg

SEQ ID NO: 8977 - DNA, 20 bp, Artificial Sequence
  Description of Artificial Sequence:  Hypothetical Probe Sequence
agccaaagaggactcacgaa

SEQ ID NO: 8978 - DNA, 20 bp, Artificial Sequence
  Description of Artificial Sequence:  Hypothetical Probe Sequence
agccaaagcctatgattccc

SEQ ID NO: 8979 - DNA, 20 bp, Artificial Sequence
  Description of Artificial Sequence:  Hypothetical Probe Sequence
agccaaaggaccttgacacg

SEQ ID NO: 8980 - DNA, 20 bp, Artificial Sequence
  Description of Artificial Sequence:  Hypothetical Probe Sequence
tacatgcgatactgcgccat

SEQ ID NO: 8981 - DNA, 20 bp, Artificial Sequence
  Description of Artificial Sequence:  Hypothetical Probe Sequence
tctgcttgttgacacgcacg

SEQ ID NO: 8982 - DNA, 20 bp, Artificial Sequence
  Description of Artificial Sequence:  Hypothetical Probe Sequence
tctgctcagaccggacgctt

SEQ ID NO: 8983 - DNA, 20 bp, Artificial Sequence
  Description of Artificial Sequence:  Hypothetical Probe Sequence
agcctctgctgtatcgcgaa

SEQ ID NO: 8984 - DNA, 20 bp, Artificial Sequence
  Description of Artificial Sequence:  Hypothetical Probe Sequence
agcctctggagtcacgcgaa

SEQ ID NO: 8985 - DNA, 20 bp, Artificial Sequence
  Description of Artificial Sequence:  Hypothetical Probe Sequence
tctggatgaaaggatggcaa

SEQ ID NO: 8986 - DNA, 20 bp, Artificial Sequence
  Description of Artificial Sequence:  Hypothetical Probe Sequence
agcctctgggacatcgagcc

SEQ ID NO: 8987 - DNA, 20 bp, Artificial Sequence
  Description of Artificial Sequence:  Hypothetical Probe Sequence
agcctgtctgcgcgaataca

SEQ ID NO: 8988 - DNA, 20 bp, Artificial Sequence
  Description of Artificial Sequence:  Hypothetical Probe Sequence
agcctgtccagcaaagcagc

SEQ ID NO: 8989 - DNA, 20 bp, Artificial Sequence
  Description of Artificial Sequence:  Hypothetical Probe Sequence
agcctcgtttgatgtcgctt

SEQ ID NO: 8990 - DNA, 20 bp, Artificial Sequence
  Description of Artificial Sequence:  Hypothetical Probe Sequence
tcgttgtctacatgcggacc

SEQ ID NO: 8991 - DNA, 20 bp, Artificial Sequence
  Description of Artificial Sequence:  Hypothetical Probe Sequence
agcctcgtgagtggacagcc

SEQ ID NO: 8992 - DNA, 20 bp, Artificial Sequence
  Description of Artificial Sequence:  Hypothetical Probe Sequence
agcctcgtgcaacgaagcaa

SEQ ID NO: 8993 - DNA, 20 bp, Artificial Sequence
  Description of Artificial Sequence:  Hypothetical Probe Sequence
agcctcgtacctcgaaagcc

SEQ ID NO: 8994 - DNA, 20 bp, Artificial Sequence
  Description of Artificial Sequence:  Hypothetical Probe Sequence
agcctcgttcccgacccttg

SEQ ID NO: 8995 - DNA, 20 bp, Artificial Sequence
  Description of Artificial Sequence:  Hypothetical Probe Sequence
tcgttgcgatactcgttccc

SEQ ID NO: 8996 - DNA, 20 bp, Artificial Sequence
  Description of Artificial Sequence:  Hypothetical Probe Sequence
agcccttgttgagcttgcaa

SEQ ID NO: 8997 - DNA, 20 bp, Artificial Sequence
  Description of Artificial Sequence:  Hypothetical Probe Sequence
agcccttgctcaaggattga

SEQ ID NO: 8998 - DNA, 20 bp, Artificial Sequence
  Description of Artificial Sequence:  Hypothetical Probe Sequence
agcccttgctgtacctacgg

SEQ ID NO: 8999 - DNA, 20 bp, Artificial Sequence
  Description of Artificial Sequence:  Hypothetical Probe Sequence
agcccttggtctatcgcttg

SEQ ID NO: 9000 - DNA, 20 bp, Artificial Sequence
  Description of Artificial Sequence:  Hypothetical Probe Sequence
agcccttggcaaagcctgtc

SEQ ID NO: 9001 - DNA, 20 bp, Artificial Sequence
  Description of Artificial Sequence:  Hypothetical Probe Sequence
agcccttgagtgatcgcgtt

SEQ ID NO: 9002 - DNA, 20 bp, Artificial Sequence
  Description of Artificial Sequence:  Hypothetical Probe Sequence
agcccttgcctagtctagcc

SEQ ID NO: 9003 - DNA, 20 bp, Artificial Sequence
  Description of Artificial Sequence:  Hypothetical Probe Sequence
agcccttggaccgagttccc

SEQ ID NO: 9004 - DNA, 20 bp, Artificial Sequence
  Description of Artificial Sequence:  Hypothetical Probe Sequence
agcccttgggactgtccttg

SEQ ID NO: 9005 - DNA, 20 bp, Artificial Sequence
  Description of Artificial Sequence:  Hypothetical Probe Sequence
agcccttgagccaaaggatg

SEQ ID NO: 9006 - DNA, 20 bp, Artificial Sequence
  Description of Artificial Sequence:  Hypothetical Probe Sequence
agcccgttaatcgtgcggta

SEQ ID NO: 9007 - DNA, 20 bp, Artificial Sequence
  Description of Artificial Sequence:  Hypothetical Probe Sequence
agcccgtttacaaatccgtt

SEQ ID NO: 9008 - DNA, 20 bp, Artificial Sequence
  Description of Artificial Sequence:  Hypothetical Probe Sequence
agcccgttggtacgaataca

SEQ ID NO: 9009 - DNA, 20 bp, Artificial Sequence
  Description of Artificial Sequence:  Hypothetical Probe Sequence
agcccgttgagtaaagcgtt

SEQ ID NO: 9010 - DNA, 20 bp, Artificial Sequence
  Description of Artificial Sequence:  Hypothetical Probe Sequence
agcccgttagtgaaagacgg

SEQ ID NO: 9011 - DNA, 20 bp, Artificial Sequence
  Description of Artificial Sequence:  Hypothetical Probe Sequence
agcccgttatcgtgattgcg

SEQ ID NO: 9012 - DNA, 20 bp, Artificial Sequence
  Description of Artificial Sequence:  Hypothetical Probe Sequence
agcccgtttcccgatgccat

SEQ ID NO: 9013 - DNA, 20 bp, Artificial Sequence
  Description of Artificial Sequence:  Hypothetical Probe Sequence
agcccgtttgcgcgttctca

SEQ ID NO: 9014 - DNA, 20 bp, Artificial Sequence
  Description of Artificial Sequence:  Hypothetical Probe Sequence
agcccgttgaccatactgcg

SEQ ID NO: 9015 - DNA, 20 bp, Artificial Sequence
  Description of Artificial Sequence:  Hypothetical Probe Sequence
agcccgttgtgctacaatcg

SEQ ID NO: 9016 - DNA, 20 bp, Artificial Sequence
  Description of Artificial Sequence:  Hypothetical Probe Sequence
agccctcattgatgtctgcg

SEQ ID NO: 9017 - DNA, 20 bp, Artificial Sequence
  Description of Artificial Sequence:  Hypothetical Probe Sequence
agccctcatgatccattgcg

SEQ ID NO: 9018 - DNA, 20 bp, Artificial Sequence
  Description of Artificial Sequence:  Hypothetical Probe Sequence
agccctcaaaaggcaagcaa

SEQ ID NO: 9019 - DNA, 20 bp, Artificial Sequence
  Description of Artificial Sequence:  Hypothetical Probe Sequence
agccctcacttggagttgcg

SEQ ID NO: 9020 - DNA, 20 bp, Artificial Sequence
  Description of Artificial Sequence:  Hypothetical Probe Sequence
agccctcaccatggacgctt

SEQ ID NO: 9021 - DNA, 20 bp, Artificial Sequence
  Description of Artificial Sequence:  Hypothetical Probe Sequence
agccctgttgatatcggacc

SEQ ID NO: 9022 - DNA, 20 bp, Artificial Sequence
  Description of Artificial Sequence:  Hypothetical Probe Sequence
agccctgttgtcatacgtgc

SEQ ID NO: 9023 - DNA, 20 bp, Artificial Sequence
  Description of Artificial Sequence:  Hypothetical Probe Sequence
agccctgtccatgcaagtgc

SEQ ID NO: 9024 - DNA, 20 bp, Artificial Sequence
  Description of Artificial Sequence:  Hypothetical Probe Sequence
agccctgtgctttcgtcacg

SEQ ID NO: 9025 - DNA, 20 bp, Artificial Sequence
  Description of Artificial Sequence:  Hypothetical Probe Sequence
agccctgtggtagcaaagcc

SEQ ID NO: 9026 - DNA, 20 bp, Artificial Sequence
  Description of Artificial Sequence:  Hypothetical Probe Sequence
agccctgtacctcagcgcaa

SEQ ID NO: 9027 - DNA, 20 bp, Artificial Sequence
  Description of Artificial Sequence:  Hypothetical Probe Sequence
agccctgtatcgcctaacgg

SEQ ID NO: 9028 - DNA, 20 bp, Artificial Sequence
  Description of Artificial Sequence:  Hypothetical Probe Sequence
agccctgtcacggtgccgtt

SEQ ID NO: 9029 - DNA, 20 bp, Artificial Sequence
  Description of Artificial Sequence:  Hypothetical Probe Sequence
agccctgtagcccttgggta

SEQ ID NO: 9030 - DNA, 20 bp, Artificial Sequence
  Description of Artificial Sequence:  Hypothetical Probe Sequence
agccccatttgattagcgtt

SEQ ID NO: 9031 - DNA, 20 bp, Artificial Sequence
  Description of Artificial Sequence:  Hypothetical Probe Sequence
agccccataatccgaagtgc

SEQ ID NO: 9032 - DNA, 20 bp, Artificial Sequence
  Description of Artificial Sequence:  Hypothetical Probe Sequence
agccccataaagtcccgatg

SEQ ID NO: 9033 - DNA, 20 bp, Artificial Sequence
  Description of Artificial Sequence:  Hypothetical Probe Sequence
agccccattacatcgtgacc

SEQ ID NO: 9034 - DNA, 20 bp, Artificial Sequence
  Description of Artificial Sequence:  Hypothetical Probe Sequence
agccccattgtcgtctacgg

SEQ ID NO: 9035 - DNA, 20 bp, Artificial Sequence
  Description of Artificial Sequence:  Hypothetical Probe Sequence
agccccattcgtctcagatg

SEQ ID NO: 9036 - DNA, 20 bp, Artificial Sequence
  Description of Artificial Sequence:  Hypothetical Probe Sequence
agccccatctcagatgggac

SEQ ID NO: 9037 - DNA, 20 bp, Artificial Sequence
  Description of Artificial Sequence:  Hypothetical Probe Sequence
agccccatcgaacacggtct

SEQ ID NO: 9038 - DNA, 20 bp, Artificial Sequence
  Description of Artificial Sequence:  Hypothetical Probe Sequence
agccccatcagcccataaag

SEQ ID NO: 9039 - DNA, 20 bp, Artificial Sequence
  Description of Artificial Sequence:  Hypothetical Probe Sequence
agccccatacggcctacgaa

SEQ ID NO: 9040 - DNA, 20 bp, Artificial Sequence
  Description of Artificial Sequence:  Hypothetical Probe Sequence
agcccgaattgaacctcgtt

SEQ ID NO: 9041 - DNA, 20 bp, Artificial Sequence
  Description of Artificial Sequence:  Hypothetical Probe Sequence
agcccgaaataccgaacttg

SEQ ID NO: 9042 - DNA, 20 bp, Artificial Sequence
  Description of Artificial Sequence:  Hypothetical Probe Sequence
cgaaaaagatacgtcttgcg

SEQ ID NO: 9043 - DNA, 20 bp, Artificial Sequence
  Description of Artificial Sequence:  Hypothetical Probe Sequence
agcccgaatacacttgggac

SEQ ID NO: 9044 - DNA, 20 bp, Artificial Sequence
  Description of Artificial Sequence:  Hypothetical Probe Sequence
agcccgaatcgtgtgcatcg

SEQ ID NO: 9045 - DNA, 20 bp, Artificial Sequence
  Description of Artificial Sequence:  Hypothetical Probe Sequence
agcccgaacttgggtatgcg

SEQ ID NO: 9046 - DNA, 20 bp, Artificial Sequence
  Description of Artificial Sequence:  Hypothetical Probe Sequence
agcccgaactcagtctacgg

SEQ ID NO: 9047 - DNA, 20 bp, Artificial Sequence
  Description of Artificial Sequence:  Hypothetical Probe Sequence
agcccgaacgaactgttctg

SEQ ID NO: 9048 - DNA, 20 bp, Artificial Sequence
  Description of Artificial Sequence:  Hypothetical Probe Sequence
agcccgaagcttacggagtg

SEQ ID NO: 9049 - DNA, 20 bp, Artificial Sequence
  Description of Artificial Sequence:  Hypothetical Probe Sequence
agcccgaagagtgtctgcaa

SEQ ID NO: 9050 - DNA, 20 bp, Artificial Sequence
  Description of Artificial Sequence:  Hypothetical Probe Sequence
agcccgaaatcgctgtagcc

SEQ ID NO: 9051 - DNA, 20 bp, Artificial Sequence
  Description of Artificial Sequence:  Hypothetical Probe Sequence
agcccgaaaggatctgacgg

SEQ ID NO: 9052 - DNA, 20 bp, Artificial Sequence
  Description of Artificial Sequence:  Hypothetical Probe Sequence
agcccgaatgcgcgttacct

SEQ ID NO: 9053 - DNA, 20 bp, Artificial Sequence
  Description of Artificial Sequence:  Hypothetical Probe Sequence
agcccgaacacgtcccaaag

SEQ ID NO: 9054 - DNA, 20 bp, Artificial Sequence
  Description of Artificial Sequence:  Hypothetical Probe Sequence
agcccgaaggacggtatgtc

SEQ ID NO: 9055 - DNA, 20 bp, Artificial Sequence
  Description of Artificial Sequence:  Hypothetical Probe Sequence
agcccgaaacggggactctg

SEQ ID NO: 9056 - DNA, 20 bp, Artificial Sequence
  Description of Artificial Sequence:  Hypothetical Probe Sequence
agccgctttgataggaagtg

SEQ ID NO: 9057 - DNA, 20 bp, Artificial Sequence
  Description of Artificial Sequence:  Hypothetical Probe Sequence
agccgcttttagggtacgaa

SEQ ID NO: 9058 - DNA, 20 bp, Artificial Sequence
  Description of Artificial Sequence:  Hypothetical Probe Sequence
agccgcttatactgtcagcc

SEQ ID NO: 9059 - DNA, 20 bp, Artificial Sequence
  Description of Artificial Sequence:  Hypothetical Probe Sequence
agccgctttgtcgcttggta

SEQ ID NO: 9060 - DNA, 20 bp, Artificial Sequence
  Description of Artificial Sequence:  Hypothetical Probe Sequence
agccgcttcttgtgatgcaa

SEQ ID NO: 9061 - DNA, 20 bp, Artificial Sequence
  Description of Artificial Sequence:  Hypothetical Probe Sequence
agccgcttctgttcgtgatg

SEQ ID NO: 9062 - DNA, 20 bp, Artificial Sequence
  Description of Artificial Sequence:  Hypothetical Probe Sequence
agccgcttccatttgagacc

SEQ ID NO: 9063 - DNA, 20 bp, Artificial Sequence
  Description of Artificial Sequence:  Hypothetical Probe Sequence
agccgcttggtaggacgtct

SEQ ID NO: 9064 - DNA, 20 bp, Artificial Sequence
  Description of Artificial Sequence:  Hypothetical Probe Sequence
agccgctttgcgctcaacgg

SEQ ID NO: 9065 - DNA, 20 bp, Artificial Sequence
  Description of Artificial Sequence:  Hypothetical Probe Sequence
agccgcttcagcgagtacgg

SEQ ID NO: 9066 - DNA, 20 bp, Artificial Sequence
  Description of Artificial Sequence:  Hypothetical Probe Sequence
agccgcttgtgccacgtccc

SEQ ID NO: 9067 - DNA, 20 bp, Artificial Sequence
  Description of Artificial Sequence:  Hypothetical Probe Sequence
agccggtattgatcccctca

SEQ ID NO: 9068 - DNA, 20 bp, Artificial Sequence
  Description of Artificial Sequence:  Hypothetical Probe Sequence
agccggtaaatcacctgtgc

SEQ ID NO: 9069 - DNA, 20 bp, Artificial Sequence
  Description of Artificial Sequence:  Hypothetical Probe Sequence
agccggtaaaaggtcttgcg

SEQ ID NO: 9070 - DNA, 20 bp, Artificial Sequence
  Description of Artificial Sequence:  Hypothetical Probe Sequence
agccggtatctgccatcttg

SEQ ID NO: 9071 - DNA, 20 bp, Artificial Sequence
  Description of Artificial Sequence:  Hypothetical Probe Sequence
agccggtatcgtttgacgtt

SEQ ID NO: 9072 - DNA, 20 bp, Artificial Sequence
  Description of Artificial Sequence:  Hypothetical Probe Sequence
agccggtactgttcccagcc

SEQ ID NO: 9073 - DNA, 20 bp, Artificial Sequence
  Description of Artificial Sequence:  Hypothetical Probe Sequence
agccggtaggtaccatagga

SEQ ID NO: 9074 - DNA, 20 bp, Artificial Sequence
  Description of Artificial Sequence:  Hypothetical Probe Sequence
agccggtagagtcagcatcg

SEQ ID NO: 9075 - DNA, 20 bp, Artificial Sequence
  Description of Artificial Sequence:  Hypothetical Probe Sequence
agccggtatccccttgtcgt

SEQ ID NO: 9076 - DNA, 20 bp, Artificial Sequence
  Description of Artificial Sequence:  Hypothetical Probe Sequence
agccgtctaatcggacccat

SEQ ID NO: 9077 - DNA, 20 bp, Artificial Sequence
  Description of Artificial Sequence:  Hypothetical Probe Sequence
agccgtcttacaatcgatcg

SEQ ID NO: 9078 - DNA, 20 bp, Artificial Sequence
  Description of Artificial Sequence:  Hypothetical Probe Sequence
agccgtctaccttcgtagcc

SEQ ID NO: 9079 - DNA, 20 bp, Artificial Sequence
  Description of Artificial Sequence:  Hypothetical Probe Sequence
agccgtctgatgtcgtgctt

SEQ ID NO: 9080 - DNA, 20 bp, Artificial Sequence
  Description of Artificial Sequence:  Hypothetical Probe Sequence
agccgtctcacgatcgtgtc

SEQ ID NO: 9081 - DNA, 20 bp, Artificial Sequence
  Description of Artificial Sequence:  Hypothetical Probe Sequence
agccgtctcagcacggcttg

SEQ ID NO: 9082 - DNA, 20 bp, Artificial Sequence
  Description of Artificial Sequence:  Hypothetical Probe Sequence
agccgtctgaccgagtgacc

SEQ ID NO: 9083 - DNA, 20 bp, Artificial Sequence
  Description of Artificial Sequence:  Hypothetical Probe Sequence
agccgtctagccaatcgctt

SEQ ID NO: 9084 - DNA, 20 bp, Artificial Sequence
  Description of Artificial Sequence:  Hypothetical Probe Sequence
agccgagttgtccacgccat

SEQ ID NO: 9085 - DNA, 20 bp, Artificial Sequence
  Description of Artificial Sequence:  Hypothetical Probe Sequence
agccgagttcgtgagtagcc

SEQ ID NO: 9086 - DNA, 20 bp, Artificial Sequence
  Description of Artificial Sequence:  Hypothetical Probe Sequence
agccgagtgtcttacatgcg

SEQ ID NO: 9087 - DNA, 20 bp, Artificial Sequence
  Description of Artificial Sequence:  Hypothetical Probe Sequence
agccgagtatcgcagcctgt

SEQ ID NO: 9088 - DNA, 20 bp, Artificial Sequence
  Description of Artificial Sequence:  Hypothetical Probe Sequence
agccgagtcctattgatccc

SEQ ID NO: 9089 - DNA, 20 bp, Artificial Sequence
  Description of Artificial Sequence:  Hypothetical Probe Sequence
agccgagtgatgtcccgagt

SEQ ID NO: 9090 - DNA, 20 bp, Artificial Sequence
  Description of Artificial Sequence:  Hypothetical Probe Sequence
agccgagttgcgttgactgt

SEQ ID NO: 9091 - DNA, 20 bp, Artificial Sequence
  Description of Artificial Sequence:  Hypothetical Probe Sequence
agccgagtagcccagcctca

SEQ ID NO: 9092 - DNA, 20 bp, Artificial Sequence
  Description of Artificial Sequence:  Hypothetical Probe Sequence
agccgcaattgaaggagcaa

SEQ ID NO: 9093 - DNA, 20 bp, Artificial Sequence
  Description of Artificial Sequence:  Hypothetical Probe Sequence
agccgcaatgatagcctgat

SEQ ID NO: 9094 - DNA, 20 bp, Artificial Sequence
  Description of Artificial Sequence:  Hypothetical Probe Sequence
agccgcaattagcgaatgcg

SEQ ID NO: 9095 - DNA, 20 bp, Artificial Sequence
  Description of Artificial Sequence:  Hypothetical Probe Sequence
agccgcaatacaagtgtccc

SEQ ID NO: 9096 - DNA, 20 bp, Artificial Sequence
  Description of Artificial Sequence:  Hypothetical Probe Sequence
agccgcaatctgggtaggac

SEQ ID NO: 9097 - DNA, 20 bp, Artificial Sequence
  Description of Artificial Sequence:  Hypothetical Probe Sequence
agccgcaacgtttgcgtgat

SEQ ID NO: 9098 - DNA, 20 bp, Artificial Sequence
  Description of Artificial Sequence:  Hypothetical Probe Sequence
agccgcaactcaaggaagcc

SEQ ID NO: 9099 - DNA, 20 bp, Artificial Sequence
  Description of Artificial Sequence:  Hypothetical Probe Sequence
agccgcaacgaaggtaatcg

SEQ ID NO: 9100 - DNA, 20 bp, Artificial Sequence
  Description of Artificial Sequence:  Hypothetical Probe Sequence
agccgcaagcttgagtcacg

SEQ ID NO: 9101 - DNA, 20 bp, Artificial Sequence
  Description of Artificial Sequence:  Hypothetical Probe Sequence
agccgcaagcaatccccttg

SEQ ID NO: 9102 - DNA, 20 bp, Artificial Sequence
  Description of Artificial Sequence:  Hypothetical Probe Sequence
agccgcaaatcggcaaacct

SEQ ID NO: 9103 - DNA, 20 bp, Artificial Sequence
  Description of Artificial Sequence:  Hypothetical Probe Sequence
agccgcaaaggagcaacgtt

SEQ ID NO: 9104 - DNA, 20 bp, Artificial Sequence
  Description of Artificial Sequence:  Hypothetical Probe Sequence
agccgcaatcccggtaagtg

SEQ ID NO: 9105 - DNA, 20 bp, Artificial Sequence
  Description of Artificial Sequence:  Hypothetical Probe Sequence
agccgcaatgcgatcgctca

SEQ ID NO: 9106 - DNA, 20 bp, Artificial Sequence
  Description of Artificial Sequence:  Hypothetical Probe Sequence
agccgcaacacgctgtgtgc

SEQ ID NO: 9107 - DNA, 20 bp, Artificial Sequence
  Description of Artificial Sequence:  Hypothetical Probe Sequence
agccgcaagtgcatacacgg

SEQ ID NO: 9108 - DNA, 20 bp, Artificial Sequence
  Description of Artificial Sequence:  Hypothetical Probe Sequence
agccgcaaacggcctagctt

SEQ ID NO: 9109 - DNA, 20 bp, Artificial Sequence
  Description of Artificial Sequence:  Hypothetical Probe Sequence
agccgcaaagccctgtcttg

SEQ ID NO: 9110 - DNA, 20 bp, Artificial Sequence
  Description of Artificial Sequence:  Hypothetical Probe Sequence
agccagtgtcgtatcgcacg

SEQ ID NO: 9111 - DNA, 20 bp, Artificial Sequence
  Description of Artificial Sequence:  Hypothetical Probe Sequence
agccagtgcttgagtgggac

SEQ ID NO: 9112 - DNA, 20 bp, Artificial Sequence
  Description of Artificial Sequence:  Hypothetical Probe Sequence
agccagtgctgtgatgacgg

SEQ ID NO: 9113 - DNA, 20 bp, Artificial Sequence
  Description of Artificial Sequence:  Hypothetical Probe Sequence
agccagtgggtacagcagcc

SEQ ID NO: 9114 - DNA, 20 bp, Artificial Sequence
  Description of Artificial Sequence:  Hypothetical Probe Sequence
agccagtgacctgctttccc

SEQ ID NO: 9115 - DNA, 20 bp, Artificial Sequence
  Description of Artificial Sequence:  Hypothetical Probe Sequence
agtgatcggagtacggcagc

SEQ ID NO: 9116 - DNA, 20 bp, Artificial Sequence
  Description of Artificial Sequence:  Hypothetical Probe Sequence
agccagtgtgcgataccacg

SEQ ID NO: 9117 - DNA, 20 bp, Artificial Sequence
  Description of Artificial Sequence:  Hypothetical Probe Sequence
agccagtggaccaggagcaa

SEQ ID NO: 9118 - DNA, 20 bp, Artificial Sequence
  Description of Artificial Sequence:  Hypothetical Probe Sequence
accttgtcaggacacggcaa

SEQ ID NO: 9119 - DNA, 20 bp, Artificial Sequence
  Description of Artificial Sequence:  Hypothetical Probe Sequence
agccaccttcgtaaagccat

SEQ ID NO: 9120 - DNA, 20 bp, Artificial Sequence
  Description of Artificial Sequence:  Hypothetical Probe Sequence
acctcgaatgtccttgcgaa

SEQ ID NO: 9121 - DNA, 20 bp, Artificial Sequence
  Description of Artificial Sequence:  Hypothetical Probe Sequence
acctatcgacctgatggcaa

SEQ ID NO: 9122 - DNA, 20 bp, Artificial Sequence
  Description of Artificial Sequence:  Hypothetical Probe Sequence
acctaggaagtgctcatgcg

SEQ ID NO: 9123 - DNA, 20 bp, Artificial Sequence
  Description of Artificial Sequence:  Hypothetical Probe Sequence
agccacctcacgaatctccc

SEQ ID NO: 9124 - DNA, 20 bp, Artificial Sequence
  Description of Artificial Sequence:  Hypothetical Probe Sequence
agccatcgcgaattgaggac

SEQ ID NO: 9125 - DNA, 20 bp, Artificial Sequence
  Description of Artificial Sequence:  Hypothetical Probe Sequence
agccatcggcaaaatccagc

SEQ ID NO: 9126 - DNA, 20 bp, Artificial Sequence
  Description of Artificial Sequence:  Hypothetical Probe Sequence
agccatcgcctaatacccat

SEQ ID NO: 9127 - DNA, 20 bp, Artificial Sequence
  Description of Artificial Sequence:  Hypothetical Probe Sequence
aggaatacggtatccctgcg

SEQ ID NO: 9128 - DNA, 20 bp, Artificial Sequence
  Description of Artificial Sequence:  Hypothetical Probe Sequence
aggaaaagttgacacgtgcg

SEQ ID NO: 9129 - DNA, 20 bp, Artificial Sequence
  Description of Artificial Sequence:  Hypothetical Probe Sequence
agccaggatacatgcgctca

SEQ ID NO: 9130 - DNA, 20 bp, Artificial Sequence
  Description of Artificial Sequence:  Hypothetical Probe Sequence
agccaggatctgcacgctgt

SEQ ID NO: 9131 - DNA, 20 bp, Artificial Sequence
  Description of Artificial Sequence:  Hypothetical Probe Sequence
agccaggacgtttgtctccc

SEQ ID NO: 9132 - DNA, 20 bp, Artificial Sequence
  Description of Artificial Sequence:  Hypothetical Probe Sequence
agccaggactcaagccgagt

SEQ ID NO: 9133 - DNA, 20 bp, Artificial Sequence
  Description of Artificial Sequence:  Hypothetical Probe Sequence
agccaggaccatttgagtgc

SEQ ID NO: 9134 - DNA, 20 bp, Artificial Sequence
  Description of Artificial Sequence:  Hypothetical Probe Sequence
agccaggagcaaatacgatg

SEQ ID NO: 9135 - DNA, 20 bp, Artificial Sequence
  Description of Artificial Sequence:  Hypothetical Probe Sequence
agccaggatgcgcgaaggta

SEQ ID NO: 9136 - DNA, 20 bp, Artificial Sequence
  Description of Artificial Sequence:  Hypothetical Probe Sequence
aggacagccttgaatcacgg

SEQ ID NO: 9137 - DNA, 20 bp, Artificial Sequence
  Description of Artificial Sequence:  Hypothetical Probe Sequence
agccaggagacctcgtctca

SEQ ID NO: 9138 - DNA, 20 bp, Artificial Sequence
  Description of Artificial Sequence:  Hypothetical Probe Sequence
agccaggaggacaaaggtgc

SEQ ID NO: 9139 - DNA, 20 bp, Artificial Sequence
  Description of Artificial Sequence:  Hypothetical Probe Sequence
aggaacggccataatcgcaa

SEQ ID NO: 9140 - DNA, 20 bp, Artificial Sequence
  Description of Artificial Sequence:  Hypothetical Probe Sequence
agcccctatgatagccgatg

SEQ ID NO: 9141 - DNA, 20 bp, Artificial Sequence
  Description of Artificial Sequence:  Hypothetical Probe Sequence
agcccctatgtcagcccacg

SEQ ID NO: 9142 - DNA, 20 bp, Artificial Sequence
  Description of Artificial Sequence:  Hypothetical Probe Sequence
agcccctacttgaggacagc

SEQ ID NO: 9143 - DNA, 20 bp, Artificial Sequence
  Description of Artificial Sequence:  Hypothetical Probe Sequence
agcccctactcactcaatcg

SEQ ID NO: 9144 - DNA, 20 bp, Artificial Sequence
  Description of Artificial Sequence:  Hypothetical Probe Sequence
agcccctagagtgcaatgcg

SEQ ID NO: 9145 - DNA, 20 bp, Artificial Sequence
  Description of Artificial Sequence:  Hypothetical Probe Sequence
agcccctagcaaccatgtgc

SEQ ID NO: 9146 - DNA, 20 bp, Artificial Sequence
  Description of Artificial Sequence:  Hypothetical Probe Sequence
agcccctaaccttctggctt

SEQ ID NO: 9147 - DNA, 20 bp, Artificial Sequence
  Description of Artificial Sequence:  Hypothetical Probe Sequence
agcccctagatggcaatcgt

SEQ ID NO: 9148 - DNA, 20 bp, Artificial Sequence
  Description of Artificial Sequence:  Hypothetical Probe Sequence
agcccctacacgaatcaatc

SEQ ID NO: 9149 - DNA, 20 bp, Artificial Sequence
  Description of Artificial Sequence:  Hypothetical Probe Sequence
agcccctaacggcacgctgt

SEQ ID NO: 9150 - DNA, 20 bp, Artificial Sequence
  Description of Artificial Sequence:  Hypothetical Probe Sequence
agccgatgtgatcttgatcg

SEQ ID NO: 9151 - DNA, 20 bp, Artificial Sequence
  Description of Artificial Sequence:  Hypothetical Probe Sequence
agccgatgttagttgatgcg

SEQ ID NO: 9152 - DNA, 20 bp, Artificial Sequence
  Description of Artificial Sequence:  Hypothetical Probe Sequence
agccgatgtacatgtcgacc

SEQ ID NO: 9153 - DNA, 20 bp, Artificial Sequence
  Description of Artificial Sequence:  Hypothetical Probe Sequence
agccgatgtctgaatcgcaa

SEQ ID NO: 9154 - DNA, 20 bp, Artificial Sequence
  Description of Artificial Sequence:  Hypothetical Probe Sequence
agccgatgtgtcagcctgcg

SEQ ID NO: 9155 - DNA, 20 bp, Artificial Sequence
  Description of Artificial Sequence:  Hypothetical Probe Sequence
agccgatgctcaacctgctt

SEQ ID NO: 9156 - DNA, 20 bp, Artificial Sequence
  Description of Artificial Sequence:  Hypothetical Probe Sequence
agccgatggcttagccttag

SEQ ID NO: 9157 - DNA, 20 bp, Artificial Sequence
  Description of Artificial Sequence:  Hypothetical Probe Sequence
agccgatgacctcagcccta

SEQ ID NO: 9158 - DNA, 20 bp, Artificial Sequence
  Description of Artificial Sequence:  Hypothetical Probe Sequence
agccgatgcctaccatgtgc

SEQ ID NO: 9159 - DNA, 20 bp, Artificial Sequence
  Description of Artificial Sequence:  Hypothetical Probe Sequence
agcctcccttgaaccttccc

SEQ ID NO: 9160 - DNA, 20 bp, Artificial Sequence
  Description of Artificial Sequence:  Hypothetical Probe Sequence
agcctcccatactgcgctca

SEQ ID NO: 9161 - DNA, 20 bp, Artificial Sequence
  Description of Artificial Sequence:  Hypothetical Probe Sequence
agcctccctacaaccttgcg

SEQ ID NO: 9162 - DNA, 20 bp, Artificial Sequence
  Description of Artificial Sequence:  Hypothetical Probe Sequence
agcctccctgtcaaaggtgc

SEQ ID NO: 9163 - DNA, 20 bp, Artificial Sequence
  Description of Artificial Sequence:  Hypothetical Probe Sequence
agcctccctcgtacggggta

SEQ ID NO: 9164 - DNA, 20 bp, Artificial Sequence
  Description of Artificial Sequence:  Hypothetical Probe Sequence
tccccttgttgaagtgacgg

SEQ ID NO: 9165 - DNA, 20 bp, Artificial Sequence
  Description of Artificial Sequence:  Hypothetical Probe Sequence
agcctcccccatcctaggac

SEQ ID NO: 9166 - DNA, 20 bp, Artificial Sequence
  Description of Artificial Sequence:  Hypothetical Probe Sequence
agcctccccgaatctggtgc

SEQ ID NO: 9167 - DNA, 20 bp, Artificial Sequence
  Description of Artificial Sequence:  Hypothetical Probe Sequence
tcccgtctggtaggacgctt

SEQ ID NO: 9168 - DNA, 20 bp, Artificial Sequence
  Description of Artificial Sequence:  Hypothetical Probe Sequence
agcctcccgagtcctatccc

SEQ ID NO: 9169 - DNA, 20 bp, Artificial Sequence
  Description of Artificial Sequence:  Hypothetical Probe Sequence
tcccagtgcttgcttggacc

SEQ ID NO: 9170 - DNA, 20 bp, Artificial Sequence
  Description of Artificial Sequence:  Hypothetical Probe Sequence
tcccatcgttgaaatcggac

SEQ ID NO: 9171 - DNA, 20 bp, Artificial Sequence
  Description of Artificial Sequence:  Hypothetical Probe Sequence
tcccaggacctatcgtcgaa

SEQ ID NO: 9172 - DNA, 20 bp, Artificial Sequence
  Description of Artificial Sequence:  Hypothetical Probe Sequence
agcctccccctactgtctca

SEQ ID NO: 9173 - DNA, 20 bp, Artificial Sequence
  Description of Artificial Sequence:  Hypothetical Probe Sequence
agcctcccgatggatggcaa

SEQ ID NO: 9174 - DNA, 20 bp, Artificial Sequence
  Description of Artificial Sequence:  Hypothetical Probe Sequence
agcctccctcccgcaaacct

SEQ ID NO: 9175 - DNA, 20 bp, Artificial Sequence
  Description of Artificial Sequence:  Hypothetical Probe Sequence
agcctcccgtgcatcgttga

SEQ ID NO: 9176 - DNA, 20 bp, Artificial Sequence
  Description of Artificial Sequence:  Hypothetical Probe Sequence
tcccacggccatgagtcgaa

SEQ ID NO: 9177 - DNA, 20 bp, Artificial Sequence
  Description of Artificial Sequence:  Hypothetical Probe Sequence
agcctcccagccaaagtcgt

SEQ ID NO: 9178 - DNA, 20 bp, Artificial Sequence
  Description of Artificial Sequence:  Hypothetical Probe Sequence
tgcgaatcggtaagtgcgtt

SEQ ID NO: 9179 - DNA, 20 bp, Artificial Sequence
  Description of Artificial Sequence:  Hypothetical Probe Sequence
agcctgcgaaagtctgtccc

SEQ ID NO: 9180 - DNA, 20 bp, Artificial Sequence
  Description of Artificial Sequence:  Hypothetical Probe Sequence
agcctgcgctcacttggcaa

SEQ ID NO: 9181 - DNA, 20 bp, Artificial Sequence
  Description of Artificial Sequence:  Hypothetical Probe Sequence
tgcgctgtgtcttgtccgaa

SEQ ID NO: 9182 - DNA, 20 bp, Artificial Sequence
  Description of Artificial Sequence:  Hypothetical Probe Sequence
agcctgcggagtgatgctgt

SEQ ID NO: 9183 - DNA, 20 bp, Artificial Sequence
  Description of Artificial Sequence:  Hypothetical Probe Sequence
tgcgagtggagttcccatcg

SEQ ID NO: 9184 - DNA, 20 bp, Artificial Sequence
  Description of Artificial Sequence:  Hypothetical Probe Sequence
agcctgcgaggagcttccta

SEQ ID NO: 9185 - DNA, 20 bp, Artificial Sequence
  Description of Artificial Sequence:  Hypothetical Probe Sequence
agcctgcgtgcgaaagccta

SEQ ID NO: 9186 - DNA, 20 bp, Artificial Sequence
  Description of Artificial Sequence:  Hypothetical Probe Sequence
tgcgcacgctcatctgcagc

SEQ ID NO: 9187 - DNA, 20 bp, Artificial Sequence
  Description of Artificial Sequence:  Hypothetical Probe Sequence
agcctgcggtgcgatgagcc

SEQ ID NO: 9188 - DNA, 20 bp, Artificial Sequence
  Description of Artificial Sequence:  Hypothetical Probe Sequence
agcccacgaatcgaccggta

SEQ ID NO: 9189 - DNA, 20 bp, Artificial Sequence
  Description of Artificial Sequence:  Hypothetical Probe Sequence
agcccacgtacactcaatcg

SEQ ID NO: 9190 - DNA, 20 bp, Artificial Sequence
  Description of Artificial Sequence:  Hypothetical Probe Sequence
agcccacgcttggcaaggta

SEQ ID NO: 9191 - DNA, 20 bp, Artificial Sequence
  Description of Artificial Sequence:  Hypothetical Probe Sequence
agcccacggtctaggaggta

SEQ ID NO: 9192 - DNA, 20 bp, Artificial Sequence
  Description of Artificial Sequence:  Hypothetical Probe Sequence
agcccacgaccttcccctca

SEQ ID NO: 9193 - DNA, 20 bp, Artificial Sequence
  Description of Artificial Sequence:  Hypothetical Probe Sequence
agcccacgcctacgttgctt

SEQ ID NO: 9194 - DNA, 20 bp, Artificial Sequence
  Description of Artificial Sequence:  Hypothetical Probe Sequence
agcccacgcagcggacttga

SEQ ID NO: 9195 - DNA, 20 bp, Artificial Sequence
  Description of Artificial Sequence:  Hypothetical Probe Sequence
agcccacggaccgcttgcaa

SEQ ID NO: 9196 - DNA, 20 bp, Artificial Sequence
  Description of Artificial Sequence:  Hypothetical Probe Sequence
agcccacgacggctcaagga

SEQ ID NO: 9197 - DNA, 20 bp, Artificial Sequence
  Description of Artificial Sequence:  Hypothetical Probe Sequence
cagctgatcctagaccgcaa

SEQ ID NO: 9198 - DNA, 20 bp, Artificial Sequence
  Description of Artificial Sequence:  Hypothetical Probe Sequence
agcccagcttagagtgcagc

SEQ ID NO: 9199 - DNA, 20 bp, Artificial Sequence
  Description of Artificial Sequence:  Hypothetical Probe Sequence
agcccagcaaaggaccagtg

SEQ ID NO: 9200 - DNA, 20 bp, Artificial Sequence
  Description of Artificial Sequence:  Hypothetical Probe Sequence
agcccagctacagatgtccc

SEQ ID NO: 9201 - DNA, 20 bp, Artificial Sequence
  Description of Artificial Sequence:  Hypothetical Probe Sequence
agcccagctcgtgcttgctt

SEQ ID NO: 9202 - DNA, 20 bp, Artificial Sequence
  Description of Artificial Sequence:  Hypothetical Probe Sequence
agcccagcccatttgaagga

SEQ ID NO: 9203 - DNA, 20 bp, Artificial Sequence
  Description of Artificial Sequence:  Hypothetical Probe Sequence
agcccagcgcttacctatcg

SEQ ID NO: 9204 - DNA, 20 bp, Artificial Sequence
  Description of Artificial Sequence:  Hypothetical Probe Sequence
agcccagcgtctataccagc

SEQ ID NO: 9205 - DNA, 20 bp, Artificial Sequence
  Description of Artificial Sequence:  Hypothetical Probe Sequence
agcccagcaggactgttccc

SEQ ID NO: 9206 - DNA, 20 bp, Artificial Sequence
  Description of Artificial Sequence:  Hypothetical Probe Sequence
agcccagcgaccctcaacct

SEQ ID NO: 9207 - DNA, 20 bp, Artificial Sequence
  Description of Artificial Sequence:  Hypothetical Probe Sequence
agcccagcagccccatccta

SEQ ID NO: 9208 - DNA, 20 bp, Artificial Sequence
  Description of Artificial Sequence:  Hypothetical Probe Sequence
agccgaccttgaggtacgaa

SEQ ID NO: 9209 - DNA, 20 bp, Artificial Sequence
  Description of Artificial Sequence:  Hypothetical Probe Sequence
agccgacctgatggacgcaa

SEQ ID NO: 9210 - DNA, 20 bp, Artificial Sequence
  Description of Artificial Sequence:  Hypothetical Probe Sequence
agccgaccaaagcagctccc

SEQ ID NO: 9211 - DNA, 20 bp, Artificial Sequence
  Description of Artificial Sequence:  Hypothetical Probe Sequence
agccgacccttgaaagctgt

SEQ ID NO: 9212 - DNA, 20 bp, Artificial Sequence
  Description of Artificial Sequence:  Hypothetical Probe Sequence
agccgaccctcacctaggac

SEQ ID NO: 9213 - DNA, 20 bp, Artificial Sequence
  Description of Artificial Sequence:  Hypothetical Probe Sequence
agccgaccgtctgatgtccc

SEQ ID NO: 9214 - DNA, 20 bp, Artificial Sequence
  Description of Artificial Sequence:  Hypothetical Probe Sequence
agccgaccgcaactcaaatc

SEQ ID NO: 9215 - DNA, 20 bp, Artificial Sequence
  Description of Artificial Sequence:  Hypothetical Probe Sequence
agccgaccagtgttaggtgc

SEQ ID NO: 9216 - DNA, 20 bp, Artificial Sequence
  Description of Artificial Sequence:  Hypothetical Probe Sequence
agccgaccatcgtctggcaa

SEQ ID NO: 9217 - DNA, 20 bp, Artificial Sequence
  Description of Artificial Sequence:  Hypothetical Probe Sequence
agccgaccaggaagtgcgtt

SEQ ID NO: 9218 - DNA, 20 bp, Artificial Sequence
  Description of Artificial Sequence:  Hypothetical Probe Sequence
agccgacccacgagtgctgt

SEQ ID NO: 9219 - DNA, 20 bp, Artificial Sequence
  Description of Artificial Sequence:  Hypothetical Probe Sequence
agccgaccgtgcatcgaaag

SEQ ID NO: 9220 - DNA, 20 bp, Artificial Sequence
  Description of Artificial Sequence:  Hypothetical Probe Sequence
agccgtgcaatctcgttccc

SEQ ID NO: 9221 - DNA, 20 bp, Artificial Sequence
  Description of Artificial Sequence:  Hypothetical Probe Sequence
agccgtgcataccctacagc

SEQ ID NO: 9222 - DNA, 20 bp, Artificial Sequence
  Description of Artificial Sequence:  Hypothetical Probe Sequence
agccgtgctctgagtgccat

SEQ ID NO: 9223 - DNA, 20 bp, Artificial Sequence
  Description of Artificial Sequence:  Hypothetical Probe Sequence
agccgtgctcgttcgtgtct

SEQ ID NO: 9224 - DNA, 20 bp, Artificial Sequence
  Description of Artificial Sequence:  Hypothetical Probe Sequence
agccgtgccttggagtgcaa

SEQ ID NO: 9225 - DNA, 20 bp, Artificial Sequence
  Description of Artificial Sequence:  Hypothetical Probe Sequence
agccgtgccgaagcaatgtc

SEQ ID NO: 9226 - DNA, 20 bp, Artificial Sequence
  Description of Artificial Sequence:  Hypothetical Probe Sequence
agccgtgcgcttgtgctcgt

SEQ ID NO: 9227 - DNA, 20 bp, Artificial Sequence
  Description of Artificial Sequence:  Hypothetical Probe Sequence
agccgtgcgtctgctttccc

SEQ ID NO: 9228 - DNA, 20 bp, Artificial Sequence
  Description of Artificial Sequence:  Hypothetical Probe Sequence
agccgtgcatcggcaactgt

SEQ ID NO: 9229 - DNA, 20 bp, Artificial Sequence
  Description of Artificial Sequence:  Hypothetical Probe Sequence
agccgtgcggaccttgtcgt

SEQ ID NO: 9230 - DNA, 20 bp, Artificial Sequence
  Description of Artificial Sequence:  Hypothetical Probe Sequence
agccggacttagtacaagcc

SEQ ID NO: 9231 - DNA, 20 bp, Artificial Sequence
  Description of Artificial Sequence:  Hypothetical Probe Sequence
agccggactgtctcgtggta

SEQ ID NO: 9232 - DNA, 20 bp, Artificial Sequence
  Description of Artificial Sequence:  Hypothetical Probe Sequence
agccggaccgtttgtcgacc

SEQ ID NO: 9233 - DNA, 20 bp, Artificial Sequence
  Description of Artificial Sequence:  Hypothetical Probe Sequence
agccggacccatcagcgagt

SEQ ID NO: 9234 - DNA, 20 bp, Artificial Sequence
  Description of Artificial Sequence:  Hypothetical Probe Sequence
agccggacgcttcttgctca

SEQ ID NO: 9235 - DNA, 20 bp, Artificial Sequence
  Description of Artificial Sequence:  Hypothetical Probe Sequence
agccggacacctcttgacct

SEQ ID NO: 9236 - DNA, 20 bp, Artificial Sequence
  Description of Artificial Sequence:  Hypothetical Probe Sequence
agccggacatcgcgtttctg

SEQ ID NO: 9237 - DNA, 20 bp, Artificial Sequence
  Description of Artificial Sequence:  Hypothetical Probe Sequence
agccggacaggacctacagc

SEQ ID NO: 9238 - DNA, 20 bp, Artificial Sequence
  Description of Artificial Sequence:  Hypothetical Probe Sequence
agccggactccctacacacg

SEQ ID NO: 9239 - DNA, 20 bp, Artificial Sequence
  Description of Artificial Sequence:  Hypothetical Probe Sequence
agccggacgtgcgagtgacc

SEQ ID NO: 9240 - DNA, 20 bp, Artificial Sequence
  Description of Artificial Sequence:  Hypothetical Probe Sequence
agccggacggacgacccagc

SEQ ID NO: 9241 - DNA, 20 bp, Artificial Sequence
  Description of Artificial Sequence:  Hypothetical Probe Sequence
agccacggaatctgatgctt

SEQ ID NO: 9242 - DNA, 20 bp, Artificial Sequence
  Description of Artificial Sequence:  Hypothetical Probe Sequence
agccacggataccagctcgt

SEQ ID NO: 9243 - DNA, 20 bp, Artificial Sequence
  Description of Artificial Sequence:  Hypothetical Probe Sequence
agccacggaaagaaaggatg

SEQ ID NO: 9244 - DNA, 20 bp, Artificial Sequence
  Description of Artificial Sequence:  Hypothetical Probe Sequence
agccacggtacacctatccc

SEQ ID NO: 9245 - DNA, 20 bp, Artificial Sequence
  Description of Artificial Sequence:  Hypothetical Probe Sequence
agccacggtctggatgcgtt

SEQ ID NO: 9246 - DNA, 20 bp, Artificial Sequence
  Description of Artificial Sequence:  Hypothetical Probe Sequence
agccacggtgtcggacatcg

SEQ ID NO: 9247 - DNA, 20 bp, Artificial Sequence
  Description of Artificial Sequence:  Hypothetical Probe Sequence
agccacgggcttgcttcacg

SEQ ID NO: 9248 - DNA, 20 bp, Artificial Sequence
  Description of Artificial Sequence:  Hypothetical Probe Sequence
acgggtctgtctgtgccacg

SEQ ID NO: 9249 - DNA, 20 bp, Artificial Sequence
  Description of Artificial Sequence:  Hypothetical Probe Sequence
agccacggatcggctttcgt

SEQ ID NO: 9250 - DNA, 20 bp, Artificial Sequence
  Description of Artificial Sequence:  Hypothetical Probe Sequence
agccacgggaccagtggacc

SEQ ID NO: 9251 - DNA, 20 bp, Artificial Sequence
  Description of Artificial Sequence:  Hypothetical Probe Sequence
acgggtgctacaggacgtgc

SEQ ID NO: 9252 - DNA, 20 bp, Artificial Sequence
  Description of Artificial Sequence:  Hypothetical Probe Sequence
agccacggacggcctaagtg

SEQ ID NO: 9253 - DNA, 20 bp, Artificial Sequence
  Description of Artificial Sequence:  Hypothetical Probe Sequence
agccagcctgatacctagcc

SEQ ID NO: 9254 - DNA, 20 bp, Artificial Sequence
  Description of Artificial Sequence:  Hypothetical Probe Sequence
agccagccaaagacctacgg

SEQ ID NO: 9255 - DNA, 20 bp, Artificial Sequence
  Description of Artificial Sequence:  Hypothetical Probe Sequence
agccagcctctggaccagga

SEQ ID NO: 9256 - DNA, 20 bp, Artificial Sequence
  Description of Artificial Sequence:  Hypothetical Probe Sequence
agccagcctcgtagtgggta

SEQ ID NO: 9257 - DNA, 20 bp, Artificial Sequence
  Description of Artificial Sequence:  Hypothetical Probe Sequence
agccagcccttgtgtccgaa

SEQ ID NO: 9258 - DNA, 20 bp, Artificial Sequence
  Description of Artificial Sequence:  Hypothetical Probe Sequence
agccagcccgttcgtttcgt

SEQ ID NO: 9259 - DNA, 20 bp, Artificial Sequence
  Description of Artificial Sequence:  Hypothetical Probe Sequence
agccagccctcagcttcttg

SEQ ID NO: 9260 - DNA, 20 bp, Artificial Sequence
  Description of Artificial Sequence:  Hypothetical Probe Sequence
agccagccgcttagtgcagc

SEQ ID NO: 9261 - DNA, 20 bp, Artificial Sequence
  Description of Artificial Sequence:  Hypothetical Probe Sequence
agccagccgtctttgaggac

SEQ ID NO: 9262 - DNA, 20 bp, Artificial Sequence
  Description of Artificial Sequence:  Hypothetical Probe Sequence
agccagccatcgtgatgatg

SEQ ID NO: 9263 - DNA, 20 bp, Artificial Sequence
  Description of Artificial Sequence:  Hypothetical Probe Sequence
agccagcctccccagcgatg

SEQ ID NO: 9264 - DNA, 20 bp, Artificial Sequence
  Description of Artificial Sequence:  Hypothetical Probe Sequence
agccagcccacgccatgcaa

SEQ ID NO: 9265 - DNA, 20 bp, Artificial Sequence
  Description of Artificial Sequence:  Hypothetical Probe Sequence
agccagccgacccagcagga

SEQ ID NO: 9266 - DNA, 20 bp, Artificial Sequence
  Description of Artificial Sequence:  Hypothetical Probe Sequence
agccagccggacggtaatcg

SEQ ID NO: 9267 - DNA, 10 bp, Artificial Sequence
  Description of Artificial Sequence:  Hypothetical Probe Sequence
cacacacaca

SEQ ID NO: 9268 - DNA, 24 bp, Artificial Sequence
  Description of Artificial Sequence:  Hypothetical Probe Sequence
tgcgggtacagcacctaccttgcg

SEQ ID NO: 9269 - DNA, 24 bp, Artificial Sequence
  Description of Artificial Sequence:  Hypothetical Probe Sequence
atcgggtaggtaaccttgcgtgcg

SEQ ID NO: 9270 - DNA, 24 bp, Artificial Sequence
  Description of Artificial Sequence:  Hypothetical Probe Sequence
cagcggtagaccacctatcgtgcg

SEQ ID NO: 9271 - DNA, 24 bp, Artificial Sequence
  Description of Artificial Sequence:  Hypothetical Probe Sequence
ggtaggtaacctacctcagctgcg

SEQ ID NO: 9272 - DNA, 24 bp, Artificial Sequence
  Description of Artificial Sequence:  Hypothetical Probe Sequence
gaccggtatgcgacctggtatgcg

SEQ ID NO: 9273 - DNA, 33 bp, Artificial Sequence
  Description of Artificial Sequence:  Consensus Primer Sequence
aaccttatgtgtgacatgttctaatatagtcac

SEQ ID NO: 9274 - DNA, 30 bp, Artificial Sequence
  Description of Artificial Sequence:  Consensus Primer Sequence
aaaatggtcagagaaacctttatctgtatc

SEQ ID NO: 9275 - DNA, 53 bp, Artificial Sequence
  Description of Artificial Sequence:  Consensus Primer Sequence
tatgatccaacaatagaggtaaatcttgtcgcagattttgcgctggatttcaa

SEQ ID NO: 9276 - DNA, 24 bp, Artificial Sequence
  Description of Artificial Sequence:  Consensus Primer Sequence
attcagaatcattttgtggacgaa

SEQ ID NO: 9277 - DNA, 44 bp, Artificial Sequence
  Description of Artificial Sequence:  Consensus Primer Sequence
tggcgtaggcaagagtgcctttcgccgtcgtgtaggcttttcaa

SEQ ID NO: 9278 - DNA, 23 bp, Artificial Sequence
  Description of Artificial Sequence:  Consensus Primer Sequence
aaacttgtggtagttggagctga

SEQ ID NO: 9279 - DNA, 23 bp, Artificial Sequence
  Description of Artificial Sequence:  Consensus Primer Sequence
aaacttgtggtagttggagctgc

SEQ ID NO: 9280 - DNA, 23 bp, Artificial Sequence
  Description of Artificial Sequence:  Consensus Primer Sequence
aaacttgtggtagttggagctgt

SEQ ID NO: 9281 - DNA, 44 bp, Artificial Sequence
  Description of Artificial Sequence:  Consensus Primer Sequence
gtggcgtaggcaagagtgccccgtaagcccgtatggcagatcaa

SEQ ID NO: 9282 - DNA, 26 bp, Artificial Sequence
  Description of Artificial Sequence:  Consensus Primer Sequence
atataaacttgtggtagttggagcta

SEQ ID NO: 9283 - DNA, 26 bp, Artificial Sequence
  Description of Artificial Sequence:  Consensus Primer Sequence
atataaacttgtggtagttggagctc

SEQ ID NO: 9284 - DNA, 26 bp, Artificial Sequence
  Description of Artificial Sequence:  Consensus Primer Sequence
atataaacttgtggtagttggagctt

SEQ ID NO: 9285 - DNA, 45 bp, Artificial Sequence
  Description of Artificial Sequence:  Consensus Primer Sequence
cgtaggcaagagtgccttgacatggccgtgctggggacaagtcaa

SEQ ID NO: 9286 - DNA, 21 bp, Artificial Sequence
  Description of Artificial Sequence:  Consensus Primer Sequence
tgtggtagttggagctggtga

SEQ ID NO: 9287 - DNA, 22 bp, Artificial Sequence
  Description of Artificial Sequence:  Consensus Primer Sequence
ggagcacgctatcccgttagac

SEQ ID NO: 9288 - DNA, 21 bp, Artificial Sequence
  Description of Artificial Sequence:  Consensus Primer Sequence
cgctgccaactaccgcacatg

SEQ ID NO: 9289 - DNA, 29 bp, Artificial Sequence
  Description of Artificial Sequence:  Consensus Primer Sequence
tcattggaacagaaagaaatggatttatc

SEQ ID NO: 9290 - DNA, 31 bp, Artificial Sequence
  Description of Artificial Sequence:  Consensus Primer Sequence
tcttccctagtatgtaaggtcaattctgttc

SEQ ID NO: 9291 - DNA, 27 bp, Artificial Sequence
  Description of Artificial Sequence:  Consensus Primer Sequence
acttccattgaaggaagcttctctttc

SEQ ID NO: 9292 - DNA, 25 bp, Artificial Sequence
  Description of Artificial Sequence:  Consensus Primer Sequence
atctctgcaaaggggagtggaatac

SEQ ID NO: 9293 - DNA, 29 bp, Artificial Sequence
  Description of Artificial Sequence:  Consensus Primer Sequence
caaaatatgtctggattggagaaagtttc

SEQ ID NO: 9294 - DNA, 29 bp, Artificial Sequence
  Description of Artificial Sequence:  Consensus Primer Sequence
ttggaaaagacttgcttggtactatcttc

SEQ ID NO: 9295 - DNA, 30 bp, Artificial Sequence
  Description of Artificial Sequence:  Hypothetical Probe Sequence
aacattaatgctatgcagaaaatcttagag

SEQ ID NO: 9296 - DNA, 28 bp, Artificial Sequence
  Description of Artificial Sequence:  Hypothetical Probe Sequence
gtcattaatgctatgcagaaaatcttag

SEQ ID NO: 9297 - DNA, 21 bp, Artificial Sequence
  Description of Artificial Sequence:  Hypothetical Probe Sequence
ccaaagcgagcaagagaatcc

SEQ ID NO: 9298 - DNA, 23 bp, Artificial Sequence
  Description of Artificial Sequence:  Hypothetical Probe Sequence
aacaaagcgagcaagagaatccc

SEQ ID NO: 9299 - DNA, 16 bp, Artificial Sequence
  Description of Artificial Sequence:  Hypothetical Probe Sequence
ttttagcacagcaagt

SEQ ID NO: 9300 - DNA, 27 bp, Artificial Sequence
  Description of Artificial Sequence:  Hypothetical Probe Sequence
tacttgtgggatttttagcacagcaag

SEQ ID NO: 9301 - DNA, 27 bp, Artificial Sequence
  Description of Artificial Sequence:  Hypothetical Probe Sequence
tgtcccatctggtaagtcagcacaaac

SEQ ID NO: 9302 - DNA, 25 bp, Artificial Sequence
  Description of Artificial Sequence:  Hypothetical Probe Sequence
caggacagaaaggtaaagctccctc

SEQ ID NO: 9303 - DNA, 24 bp, Artificial Sequence
  Description of Artificial Sequence:  Hypothetical Probe Sequence
ggaaaatctgtccaggtatcagat

SEQ ID NO: 9304 - DNA, 26 bp, Artificial Sequence
  Description of Artificial Sequence:  Hypothetical Probe Sequence
tgcataggagataatcataggaatcc

SEQ ID NO: 9305 - DNA, 28 bp, Artificial Sequence
  Description of Artificial Sequence:  Hypothetical Probe Sequence
gtcattaatgctatgcagaaaatcttag

SEQ ID NO: 9306 - DNA, 23 bp, Artificial Sequence
  Description of Artificial Sequence:  Hypothetical Probe Sequence
cctctgacttcaaaatcatgctg

SEQ ID NO: 9307 - DNA, 21 bp, Artificial Sequence
  Description of Artificial Sequence:  Hypothetical Probe Sequence
caaagcgagcaagagaatccc

SEQ ID NO: 9308 - DNA, 32 bp, Artificial Sequence
  Description of Artificial Sequence:  Hypothetical Probe Sequence
cttccctatactacatttacatatatctgaag

SEQ ID NO: 9309 - DNA, 27 bp, Artificial Sequence
  Description of Artificial Sequence:  Hypothetical Probe Sequence
tacttgtgggatttttagcacagcaag

SEQ ID NO: 9310 - DNA, 55 bp, Artificial Sequence
  Description of Artificial Sequence:  Hypothetical Probe Sequence
caaattaatacactcttgtgctgacttaccacgcagattttgcgctggatttcaa

SEQ ID NO: 9311 - DNA, 49 bp, Artificial Sequence
  Description of Artificial Sequence:  Hypothetical Probe Sequence
aaagaaaccaaacacaacccatcagttcgccgtcgtgtaggcttttcaa

SEQ ID NO: 9312 - DNA, 54 bp, Artificial Sequence
  Description of Artificial Sequence:  Hypothetical Probe Sequence
tttccaaactaacatcacaaggtgatatttccgtaagcccgtatggcagatcaa

SEQ ID NO: 9313 - DNA, 51 bp, Artificial Sequence
  Description of Artificial Sequence:  Hypothetical Probe Sequence
tgtcccatctggtaagtcagcacaaaccatcgtccctttcgatgggatcaa

SEQ ID NO: 9314 - DNA, 49 bp, Artificial Sequence
  Description of Artificial Sequence:  Hypothetical Probe Sequence
caggacagaaaggtaaagctccctccaaggcacgtcccagacgcatcaa

SEQ ID NO: 9315 - DNA, 48 bp, Artificial Sequence
  Description of Artificial Sequence:  Hypothetical Probe Sequence
ggaaaatctgtccaggtatcagatgcacgggagctgacgacgtgtcaa

SEQ ID NO: 9316 - DNA, 22 bp, Artificial Sequence
  Description of Artificial Sequence:  Consensus Primer Sequence
ggagcacgctatcccgttagac

SEQ ID NO: 9317 - DNA, 21 bp, Artificial Sequence
  Description of Artificial Sequence:  Consensus Primer Sequence
cgctgccaactaccgcacatc

SEQ ID NO: 9318 - DNA, 46 bp, Artificial Sequence
  Description of Artificial Sequence:  Hypothetical Probe Sequence
ggagcacgctatcccgttagacctgttcacttgtgccctgactttc

SEQ ID NO: 9319 - DNA, 43 bp, Artificial Sequence
  Description of Artificial Sequence:  Hypothetical Probe Sequence
cgctgccaactaccgcacatcccagctgctcaccatcgctatc

SEQ ID NO: 9320 - DNA, 22 bp, Artificial Sequence
  Description of Artificial Sequence:  Hypothetical Probe Sequence
aaagccagttggcaaaacatcc

SEQ ID NO: 9321 - DNA, 19 bp, Artificial Sequence
  Description of Artificial Sequence:  Hypothetical Probe Sequence
gccagttggcaaaacatcc

SEQ ID NO: 9322 - DNA, 27 bp, Artificial Sequence
  Description of Artificial Sequence:  Hypothetical Probe Sequence
tgttgagggcaggggagtactgtaaaa

SEQ ID NO: 9323 - DNA, 48 bp, Artificial Sequence
  Description of Artificial Sequence:  Hypothetical Probe Sequence
tgttgagggcaggggagtactgtacatcgtccctttcgatgggatcaa

SEQ ID NO: 9324 - DNA, 22 bp, Artificial Sequence
  Description of Artificial Sequence:  Hypothetical Probe Sequence
ctgccctcaacaagatgtttta

SEQ ID NO: 9325 - DNA, 22 bp, Artificial Sequence
  Description of Artificial Sequence:  Hypothetical Probe Sequence
ctgccctcaacaagatgtttta

SEQ ID NO: 9326 - DNA, 24 bp, Artificial Sequence
  Description of Artificial Sequence:  Hypothetical Probe Sequence
ccaactggccaagacctgccaaaa

SEQ ID NO: 9327 - DNA, 22 bp, Artificial Sequence
  Description of Artificial Sequence:  Hypothetical Probe Sequence
ctgccctcaacaagatgttttt

SEQ ID NO: 9328 - DNA, 22 bp, Artificial Sequence
  Description of Artificial Sequence:  Hypothetical Probe Sequence
ctgccctcaacaagatgttttt

SEQ ID NO: 9329 - DNA, 44 bp, Artificial Sequence
  Description of Artificial Sequence:  Hypothetical Probe Sequence
ccaactggccaagacctgcccaaggcacgtcccagacgcatcaa

SEQ ID NO: 9330 - DNA, 19 bp, Artificial Sequence
  Description of Artificial Sequence:  Hypothetical Probe Sequence
gccaactggccaagaccta

SEQ ID NO: 9331 - DNA, 19 bp, Artificial Sequence
  Description of Artificial Sequence:  Hypothetical Probe Sequence
gccaactggccaagaccta

SEQ ID NO: 9332 - DNA, 26 bp, Artificial Sequence
  Description of Artificial Sequence:  Hypothetical Probe Sequence
ccctgtgcagctgtgggttgaaaaaa

SEQ ID NO: 9333 - DNA, 45 bp, Artificial Sequence
  Description of Artificial Sequence:  Hypothetical Probe Sequence
ccctgtgcagctgtgggttgagcacgggagctgacgacgtgtcaa

SEQ ID NO: 9334 - DNA, 18 bp, Artificial Sequence
  Description of Artificial Sequence:  Hypothetical Probe Sequence
tggccaagacctgcccta

SEQ ID NO: 9335 - DNA, 18 bp, Artificial Sequence
  Description of Artificial Sequence:  Hypothetical Probe Sequence
tggccaagacctgcccta

SEQ ID NO: 9336 - DNA, 24 bp, Artificial Sequence
  Description of Artificial Sequence:  Hypothetical Probe Sequence
tgcagctgtgggttgattccaaaa

SEQ ID NO: 9337 - DNA, 45 bp, Artificial Sequence
  Description of Artificial Sequence:  Hypothetical Probe Sequence
tgcagctgtgggttgattccaagacgcaccgcaacaggctgtcaa

SEQ ID NO: 9338 - DNA, 16 bp, Artificial Sequence
  Description of Artificial Sequence:  Hypothetical Probe Sequence
ccaagacctgccctgc

SEQ ID NO: 9339 - DNA, 16 bp, Artificial Sequence
  Description of Artificial Sequence:  Hypothetical Probe Sequence
ccaagacctgccctgc

SEQ ID NO: 9340 - DNA, 26 bp, Artificial Sequence
  Description of Artificial Sequence:  Hypothetical Probe Sequence
gcagctgtgggttgattccacaaaaa

SEQ ID NO: 9341 - DNA, 46 bp, Artificial Sequence
  Description of Artificial Sequence:  Hypothetical Probe Sequence
gcagctgtgggttgattccacacatcgctgcaagtaccgcactcaa

SEQ ID NO: 9342 - DNA, 18 bp, Artificial Sequence
  Description of Artificial Sequence:  Hypothetical Probe Sequence
tgccctgtgcagctgtga

SEQ ID NO: 9343 - DNA, 44 bp, Artificial Sequence
  Description of Artificial Sequence:  Hypothetical Probe Sequence
gttgattccacacccccgcccgatggcttccttacccagattcg

SEQ ID NO: 9344 - DNA, 13 bp, Artificial Sequence
  Description of Artificial Sequence:  Hypothetical Probe Sequence
cgggtgccgggca

SEQ ID NO: 9345 - DNA, 27 bp, Artificial Sequence
  Description of Artificial Sequence:  Hypothetical Probe Sequence
ggggtgtggaatcaacccacaaaaaaa

SEQ ID NO: 9346 - DNA, 45 bp, Artificial Sequence
  Description of Artificial Sequence:  Hypothetical Probe Sequence
ggggtgtggaatcaacccacaggctgggacgtgcagaccgttcaa

SEQ ID NO: 9347 - DNA, 20 bp, Artificial Sequence
  Description of Artificial Sequence:  Hypothetical Probe Sequence
atataacacacccccgccca

SEQ ID NO: 9348 - DNA, 14 bp, Artificial Sequence
  Description of Artificial Sequence:  Hypothetical Probe Sequence
cacacccccgccca

SEQ ID NO: 9349 - DNA, 21 bp, Artificial Sequence
  Description of Artificial Sequence:  Hypothetical Probe Sequence
gcacccgcgtccgcgatataa

SEQ ID NO: 9350 - DNA, 39 bp, Artificial Sequence
  Description of Artificial Sequence:  Hypothetical Probe Sequence
gcacccgcgtccgcggctggctggcacgcaccagaatca

SEQ ID NO: 9351 - DNA, 14 bp, Artificial Sequence
  Description of Artificial Sequence:  Hypothetical Probe Sequence
gccatggcgcggag

SEQ ID NO: 9352 - DNA, 17 bp, Artificial Sequence
  Description of Artificial Sequence:  Hypothetical Probe Sequence
gcgggtgccgggcgaaa

SEQ ID NO: 9353 - DNA, 14 bp, Artificial Sequence
  Description of Artificial Sequence:  Hypothetical Probe Sequence
gccatggcgcggaa

SEQ ID NO: 9354 - DNA, 38 bp, Artificial Sequence
  Description of Artificial Sequence:  Hypothetical Probe Sequence
gcgggtgccgggcgggctccgtcagaaagcgacaatca

SEQ ID NO: 9355 - DNA, 15 bp, Artificial Sequence
  Description of Artificial Sequence:  Hypothetical Probe Sequence
gatggccatggcgct

SEQ ID NO: 9356 - DNA, 39 bp, Artificial Sequence
  Description of Artificial Sequence:  Hypothetical Probe Sequence
gacgcgggtgccgggacgagggatacccgcaaacgatca

SEQ ID NO: 9357 - DNA, 15 bp, Artificial Sequence
  Description of Artificial Sequence:  Hypothetical Probe Sequence
cggcacccgcgtcca

SEQ ID NO: 9358 - DNA, 20 bp, Artificial Sequence
  Description of Artificial Sequence:  Hypothetical Probe Sequence
cgccatggccatctacaagc

SEQ ID NO: 9359 - DNA, 44 bp, Artificial Sequence
  Description of Artificial Sequence:  Hypothetical Probe Sequence
cgccatggccatctacaagcacgagggatacccgcaaacgatca

SEQ ID NO: 9360 - DNA, 23 bp, Artificial Sequence
  Description of Artificial Sequence:  Hypothetical Probe Sequence
gtgctgtgactgcttgtagatga

SEQ ID NO: 9361 - DNA, 39 bp, Artificial Sequence
  Description of Artificial Sequence:  Hypothetical Probe Sequence
ccatggcgcggacgcgggaggctgctgtcctttcgatca

SEQ ID NO: 9362 - DNA, 23 bp, Artificial Sequence
  Description of Artificial Sequence:  Hypothetical Probe Sequence
aaaaaaaagcgtccgcgccatga

SEQ ID NO: 9363 - DNA, 15 bp, Artificial Sequence
  Description of Artificial Sequence:  Hypothetical Probe Sequence
gcgtccgcgccatga

SEQ ID NO: 9364 - DNA, 32 bp, Artificial Sequence
  Description of Artificial Sequence:  Hypothetical Probe Sequence
ccatctacaagcagtcacagcacaaaaaaaaa

SEQ ID NO: 9365 - DNA, 48 bp, Artificial Sequence
  Description of Artificial Sequence:  Hypothetical Probe Sequence
ccatctacaagcagtcacagcacagggaggctgctgtcctttcgatca

SEQ ID NO: 9366 - DNA, 21 bp, Artificial Sequence
  Description of Artificial Sequence:  Hypothetical Probe Sequence
cacagcacatgacggaggtta

SEQ ID NO: 9367 - DNA, 21 bp, Artificial Sequence
  Description of Artificial Sequence:  Hypothetical Probe Sequence
tgaggcgctgcccccaaaaaa

SEQ ID NO: 9368 - DNA, 21 bp, Artificial Sequence
  Description of Artificial Sequence:  Hypothetical Probe Sequence
cacagcacatgacggaggttt

SEQ ID NO: 9369 - DNA, 40 bp, Artificial Sequence
  Description of Artificial Sequence:  Hypothetical Probe Sequence
tgaggcgctgcccccaacagcgtgttcgttgcttgcatca

SEQ ID NO: 9370 - DNA, 23 bp, Artificial Sequence
  Description of Artificial Sequence:  Hypothetical Probe Sequence
cctcacaacctccgtcatgtgct

SEQ ID NO: 9371 - DNA, 16 bp, Artificial Sequence
  Description of Artificial Sequence:  Hypothetical Probe Sequence
catggtgggggcagca

SEQ ID NO: 9372 - DNA, 47 bp, Artificial Sequence
  Description of Artificial Sequence:  Hypothetical Probe Sequence
cctcacaacctccgtcatgtgctatggcgatggtccactcgcaatca

SEQ ID NO: 9373 - DNA, 17 bp, Artificial Sequence
  Description of Artificial Sequence:  Hypothetical Probe Sequence
ctcatggtgggggcagt

SEQ ID NO: 9374 - DNA, 22 bp, Artificial Sequence
  Description of Artificial Sequence:  Hypothetical Probe Sequence
gcctcacaacctccgtcatgtg

SEQ ID NO: 9375 - DNA, 46 bp, Artificial Sequence
  Description of Artificial Sequence:  Hypothetical Probe Sequence
gcctcacaacctccgtcatgtggtccgtccatggcaagcgtgatca

SEQ ID NO: 9376 - DNA, 19 bp, Artificial Sequence
  Description of Artificial Sequence:  Hypothetical Probe Sequence
tgacggaggttgtgaggca

SEQ ID NO: 9377 - DNA, 24 bp, Artificial Sequence
  Description of Artificial Sequence:  Hypothetical Probe Sequence
ctgcccccaccatgagcgaaaaaa

SEQ ID NO: 9378 - DNA, 42 bp, Artificial Sequence
  Description of Artificial Sequence:  Hypothetical Probe Sequence
ctgcccccaccatgagcggtccgtccatggcaagcgtgatca

SEQ ID NO: 9379 - DNA, 19 bp, Artificial Sequence
  Description of Artificial Sequence:  Hypothetical Probe Sequence
cggaggttgtgaggcgcta

SEQ ID NO: 9380 - DNA, 25 bp, Artificial Sequence
  Description of Artificial Sequence:  Hypothetical Probe Sequence
cccccaccatgagcgctgaaaaaaa

SEQ ID NO: 9381 - DNA, 19 bp, Artificial Sequence
  Description of Artificial Sequence:  Hypothetical Probe Sequence
cggaggttgtgaggcgctt

SEQ ID NO: 9382 - DNA, 42 bp, Artificial Sequence
  Description of Artificial Sequence:  Hypothetical Probe Sequence
cccccaccatgagcgctgggctgcacccgttgaggcacatca

SEQ ID NO: 9383 - DNA, 15 bp, Artificial Sequence
  Description of Artificial Sequence:  Hypothetical Probe Sequence
ggtgggggcagcgcc

SEQ ID NO: 9384 - DNA, 20 bp, Artificial Sequence
  Description of Artificial Sequence:  Hypothetical Probe Sequence
gctatctgagcagcgctcac

SEQ ID NO: 9385 - DNA, 20 bp, Artificial Sequence
  Description of Artificial Sequence:  Hypothetical Probe Sequence
gctatctgagcagcgctcaa

SEQ ID NO: 9386 - DNA, 39 bp, Artificial Sequence
  Description of Artificial Sequence:  Hypothetical Probe Sequence
ggtgggggcagcgcctcaacatcggctaacggtccatca

SEQ ID NO: 9387 - DNA, 21 bp, Artificial Sequence
  Description of Artificial Sequence:  Hypothetical Probe Sequence
gctatctgagcagcgctcata

SEQ ID NO: 9388 - DNA, 18 bp, Artificial Sequence
  Description of Artificial Sequence:  Hypothetical Probe Sequence
gtgggggcagcgcctcac

SEQ ID NO: 9389 - DNA, 42 bp, Artificial Sequence
  Description of Artificial Sequence:  Hypothetical Probe Sequence
gtgggggcagcgcctcaccgcacgcagtcctcctccgtatca

SEQ ID NO: 9390 - DNA, 20 bp, Artificial Sequence
  Description of Artificial Sequence:  Hypothetical Probe Sequence
cgggggtgtggaatcaaccc

SEQ ID NO: 9391 - DNA, 13 bp, Artificial Sequence
  Description of Artificial Sequence:  Hypothetical Probe Sequence
cgcgggtgccggg

SEQ ID NO: 9392 - DNA, 44 bp, Artificial Sequence
  Description of Artificial Sequence:  Hypothetical Probe Sequence
cgggggtgtggaatcaaccccgcagattttgcgctggatttcaa

SEQ ID NO: 9393 - DNA, 49 bp, Artificial Sequence
  Description of Artificial Sequence:  Hypothetical Probe Sequence
ggagcacgctatcccgttagaccctctgattcctcactgattgctctta

SEQ ID NO: 9394 - DNA, 44 bp, Artificial Sequence
  Description of Artificial Sequence:  Hypothetical Probe Sequence
cgctgccaactaccgcacatcggccactgacaaccacccttaac

SEQ ID NO: 9395 - DNA, 25 bp, Artificial Sequence
  Description of Artificial Sequence:  Hypothetical Probe Sequence
aaaatcggataagatgctgaggaga

SEQ ID NO: 9396 - DNA, 21 bp, Artificial Sequence
  Description of Artificial Sequence:  Hypothetical Probe Sequence
tcggataagatgctgaggaga

SEQ ID NO: 9397 - DNA, 27 bp, Artificial Sequence
  Description of Artificial Sequence:  Hypothetical Probe Sequence
ggccagaccctaagagcaatcagaaaa

SEQ ID NO: 9398 - DNA, 47 bp, Artificial Sequence
  Description of Artificial Sequence:  Hypothetical Probe Sequence
ggccagaccctaagagcaatcagggctcgcaggctggctcatcctaa

SEQ ID NO: 9399 - DNA, 22 bp, Artificial Sequence
  Description of Artificial Sequence:  Hypothetical Probe Sequence
cactcggataagatgctgaggt

SEQ ID NO: 9400 - DNA, 45 bp, Artificial Sequence
  Description of Artificial Sequence:  Hypothetical Probe Sequence
ggggccagaccctaagagcaaggctcgcaggctggctcatcctaa

SEQ ID NO: 9401 - DNA, 24 bp, Artificial Sequence
  Description of Artificial Sequence:  Hypothetical Probe Sequence
aatttccttccactcggataagac

SEQ ID NO: 9402 - DNA, 43 bp, Artificial Sequence
  Description of Artificial Sequence:  Hypothetical Probe Sequence
gctgaggaggggccagacccgcattcgatggacaggacattcg

SEQ ID NO: 9403 - DNA, 23 bp, Artificial Sequence
  Description of Artificial Sequence:  Hypothetical Probe Sequence
aatttccttccactcggataagt

SEQ ID NO: 9404 - DNA, 43 bp, Artificial Sequence
  Description of Artificial Sequence:  Hypothetical Probe Sequence
tgctgaggaggggccagaccgcattcgatggacaggacattcg

SEQ ID NO: 9405 - DNA, 23 bp, Artificial Sequence
  Description of Artificial Sequence:  Hypothetical Probe Sequence
gataagatgctgaggaggggcca

SEQ ID NO: 9406 - DNA, 20 bp, Artificial Sequence
  Description of Artificial Sequence:  Hypothetical Probe Sequence
cgcaaatttccttccactca

SEQ ID NO: 9407 - DNA, 47 bp, Artificial Sequence
  Description of Artificial Sequence:  Hypothetical Probe Sequence
gataagatgctgaggaggggccacgcatgaggggaaacgacgagatt

SEQ ID NO: 9408 - DNA, 23 bp, Artificial Sequence
  Description of Artificial Sequence:  Hypothetical Probe Sequence
aaaagtgtttctgtcatccaaag

SEQ ID NO: 9409 - DNA, 30 bp, Artificial Sequence
  Description of Artificial Sequence:  Hypothetical Probe Sequence
actccacacgcaaatttccttccaaaaaaa

SEQ ID NO: 9410 - DNA, 23 bp, Artificial Sequence
  Description of Artificial Sequence:  Hypothetical Probe Sequence
aaaagtgtttctgtcatccaaac

SEQ ID NO: 9411 - DNA, 48 bp, Artificial Sequence
  Description of Artificial Sequence:  Hypothetical Probe Sequence
actccacacgcaaatttccttccagcaccgtgaacgacagttgcgatt

SEQ ID NO: 9412 - DNA, 22 bp, Artificial Sequence
  Description of Artificial Sequence:  Hypothetical Probe Sequence
ccaccacactatgtcgaaaagc

SEQ ID NO: 9413 - DNA, 30 bp, Artificial Sequence
  Description of Artificial Sequence:  Hypothetical Probe Sequence
gtttctgtcatccaaatactccacacgaaa

SEQ ID NO: 9414 - DNA, 51 bp, Artificial Sequence
  Description of Artificial Sequence:  Hypothetical Probe Sequence
gtttctgtcatccaaatactccacacgcgcaggtcgctgcgtgtcctgatt

SEQ ID NO: 9415 - DNA, 22 bp, Artificial Sequence
  Description of Artificial Sequence:  Hypothetical Probe Sequence
accaccacactatgtcgaaaaa

SEQ ID NO: 9416 - DNA, 30 bp, Artificial Sequence
  Description of Artificial Sequence:  Hypothetical Probe Sequence
tgtttctgtcatccaaatactccacacaaa

SEQ ID NO: 9417 - DNA, 51 bp, Artificial Sequence
  Description of Artificial Sequence:  Hypothetical Probe Sequence
tgtttctgtcatccaaatactccacaccgcaaagcagacacagggtcgatt

SEQ ID NO: 9418 - DNA, 29 bp, Artificial Sequence
  Description of Artificial Sequence:  Hypothetical Probe Sequence
aaaagtgtttctgtcatccaaatactcca

SEQ ID NO: 9419 - DNA, 21 bp, Artificial Sequence
  Description of Artificial Sequence:  Hypothetical Probe Sequence
gggcaccaccacactatgtca

SEQ ID NO: 9420 - DNA, 52 bp, Artificial Sequence
  Description of Artificial Sequence:  Hypothetical Probe Sequence
aaaagtgtttctgtcatccaaatactcccatcgcacttcgctttggctgatt

SEQ ID NO: 9421 - DNA, 23 bp, Artificial Sequence
  Description of Artificial Sequence:  Hypothetical Probe Sequence
agggcaccaccacactatgtcga

SEQ ID NO: 9422 - DNA, 19 bp, Artificial Sequence
  Description of Artificial Sequence:  Hypothetical Probe Sequence
cagacctcaggcggctcac

SEQ ID NO: 9423 - DNA, 47 bp, Artificial Sequence
  Description of Artificial Sequence:  Hypothetical Probe Sequence
agggcaccaccacactatgtcgattgcgggaactcacgaggtcgtat

SEQ ID NO: 9424 - DNA, 25 bp, Artificial Sequence
  Description of Artificial Sequence:  Hypothetical Probe Sequence
cctatgagccgcctgaggtctaaaa

SEQ ID NO: 9425 - DNA, 24 bp, Artificial Sequence
  Description of Artificial Sequence:  Hypothetical Probe Sequence
aaattcgacatagtgtggtggtgc

SEQ ID NO: 9426 - DNA, 45 bp, Artificial Sequence
  Description of Artificial Sequence:  Hypothetical Probe Sequence
cctatgagccgcctgaggtctttcgccgtcgtgtaggcttttcaa

SEQ ID NO: 9427 - DNA, 46 bp, Artificial Sequence
  Description of Artificial Sequence:  Hypothetical Probe Sequence
ggagcacgctatcccgttagacgcctcatcttgggcctgtgttatc

SEQ ID NO: 9428 - DNA, 49 bp, Artificial Sequence
  Description of Artificial Sequence:  Hypothetical Probe Sequence
cgctgccaactaccgcacatcgtggatgggtagtagtatggaagaaatc

SEQ ID NO: 9429 - DNA, 23 bp, Artificial Sequence
  Description of Artificial Sequence:  Hypothetical Probe Sequence
ctctgactgtaccaccatccaca

SEQ ID NO: 9430 - DNA, 52 bp, Artificial Sequence
  Description of Artificial Sequence:  Hypothetical Probe Sequence
acaactacatgtgtaacagttcctgcatggctacgacgcatgtaaacgttcg

SEQ ID NO: 9431 - DNA, 34 bp, Artificial Sequence
  Description of Artificial Sequence:  Hypothetical Probe Sequence
aaaaataagtaccaccatccactacaactacata

SEQ ID NO: 9432 - DNA, 30 bp, Artificial Sequence
  Description of Artificial Sequence:  Hypothetical Probe Sequence
ataagtaccaccatccactacaactacata

SEQ ID NO: 9433 - DNA, 26 bp, Artificial Sequence
  Description of Artificial Sequence:  Hypothetical Probe Sequence
tgtaacagttcctgcatgggcgaaaa

SEQ ID NO: 9434 - DNA, 34 bp, Artificial Sequence
  Description of Artificial Sequence:  Hypothetical Probe Sequence
aaaaataagtaccaccatccactacaactacatt

SEQ ID NO: 9435 - DNA, 30 bp, Artificial Sequence
  Description of Artificial Sequence:  Hypothetical Probe Sequence
ataagtaccaccatccactacaactacatt

SEQ ID NO: 9436 - DNA, 46 bp, Artificial Sequence
  Description of Artificial Sequence:  Hypothetical Probe Sequence
tgtaacagttcctgcatgggcggcacggctcgataggtcaagcttt

SEQ ID NO: 9437 - DNA, 25 bp, Artificial Sequence
  Description of Artificial Sequence:  Hypothetical Probe Sequence
ccaccatccactacaactacatgta

SEQ ID NO: 9438 - DNA, 26 bp, Artificial Sequence
  Description of Artificial Sequence:  Hypothetical Probe Sequence
taacagttcctgcatgggcggaaaaa

SEQ ID NO: 9439 - DNA, 45 bp, Artificial Sequence
  Description of Artificial Sequence:  Hypothetical Probe Sequence
taacagttcctgcatgggcggcgatttcgactcaagcggctcttt

SEQ ID NO: 9440 - DNA, 16 bp, Artificial Sequence
  Description of Artificial Sequence:  Hypothetical Probe Sequence
atgccgcccatgcagt

SEQ ID NO: 9441 - DNA, 55 bp, Artificial Sequence
  Description of Artificial Sequence:  Hypothetical Probe Sequence
aactgttacacatgtagttgtagtggatggtcgcaatggtaggtgagcaagcaga

SEQ ID NO: 9442 - DNA, 34 bp, Artificial Sequence
  Description of Artificial Sequence:  Hypothetical Probe Sequence
aactgttacacatgtagttgtagtggatggtaaa

SEQ ID NO: 9443 - DNA, 15 bp, Artificial Sequence
  Description of Artificial Sequence:  Hypothetical Probe Sequence
tgccgcccatgcagc

SEQ ID NO: 9444 - DNA, 15 bp, Artificial Sequence
  Description of Artificial Sequence:  Hypothetical Probe Sequence
tgccgcccatgcaga

SEQ ID NO: 9445 - DNA, 55 bp, Artificial Sequence; identical to SEQ ID NO: 9441
  Description of Artificial Sequence:  Hypothetical Probe Sequence

SEQ ID NO: 9446 - DNA, 28 bp, Artificial Sequence
  Description of Artificial Sequence:  Hypothetical Probe Sequence
aaaaacatgtgtaacagttcctgcatgt

SEQ ID NO: 9447 - DNA, 23 bp, Artificial Sequence
  Description of Artificial Sequence:  Hypothetical Probe Sequence
catgtgtaacagttcctgcatgt

SEQ ID NO: 9448 - DNA, 24 bp, Artificial Sequence
  Description of Artificial Sequence:  Hypothetical Probe Sequence
gcggcatgaaccggaggcaaaaaa

SEQ ID NO: 9449 - DNA, 42 bp, Artificial Sequence
  Description of Artificial Sequence:  Hypothetical Probe Sequence
gcggcatgaaccggaggcgtccccgttacctaggcgatcaga

SEQ ID NO: 9450 - DNA, 28 bp, Artificial Sequence
  Description of Artificial Sequence:  Hypothetical Probe Sequence
aaaaaatgtgtaacagttcctgcatgga

SEQ ID NO: 9451 - DNA, 22 bp, Artificial Sequence
  Description of Artificial Sequence:  Hypothetical Probe Sequence
tgtgtaacagttcctgcatgga

SEQ ID NO: 9452 - DNA, 24 bp, Artificial Sequence
  Description of Artificial Sequence:  Hypothetical Probe Sequence
cggcatgaaccggaggccaaaaaa

SEQ ID NO: 9453 - DNA, 28 bp, Artificial Sequence
  Description of Artificial Sequence:  Hypothetical Probe Sequence
aaaaaatgtgtaacagttcctgcatggt

SEQ ID NO: 9454 - DNA, 22 bp, Artificial Sequence
  Description of Artificial Sequence:  Hypothetical Probe Sequence
tgtgtaacagttcctgcatggt

SEQ ID NO: 9455 - DNA, 42 bp, Artificial Sequence
  Description of Artificial Sequence:  Hypothetical Probe Sequence
cggcatgaaccggaggccatgggtccacagtaccgctgcaga

SEQ ID NO: 9456 - DNA, 19 bp, Artificial Sequence
  Description of Artificial Sequence:  Hypothetical Probe Sequence
aacagttcctgcatgggca

SEQ ID NO: 9457 - DNA, 22 bp, Artificial Sequence
  Description of Artificial Sequence:  Hypothetical Probe Sequence
gcatgaaccggaggcccaaaaa

SEQ ID NO: 9458 - DNA, 42 bp, Artificial Sequence
  Description of Artificial Sequence:  Hypothetical Probe Sequence
gcatgaaccggaggcccaccgtgggagattaggtggctcaga

SEQ ID NO: 9459 - DNA, 18 bp, Artificial Sequence
  Description of Artificial Sequence:  Hypothetical Probe Sequence
cagttcctgcatgggcga

SEQ ID NO: 9460 - DNA, 22 bp, Artificial Sequence
  Description of Artificial Sequence:  Hypothetical Probe Sequence
catgaaccggaggcccatcaaa

SEQ ID NO: 9461 - DNA, 43 bp, Artificial Sequence
  Description of Artificial Sequence:  Hypothetical Probe Sequence
catgaaccggaggcccatcgggaatggaggtgggaacgagaca

SEQ ID NO: 9462 - DNA, 25 bp, Artificial Sequence
  Description of Artificial Sequence:  Hypothetical Probe Sequence
aaaaaaaaagttcctgcatgggcga

SEQ ID NO: 9463 - DNA, 18 bp, Artificial Sequence
  Description of Artificial Sequence:  Hypothetical Probe Sequence
cagttcctgcatgggcgt

SEQ ID NO: 9464 - DNA, 28 bp, Artificial Sequence
  Description of Artificial Sequence:  Hypothetical Probe Sequence
catgaaccggaggcccatcaaaaaaaaa

SEQ ID NO: 9465 - DNA, 20 bp, Artificial Sequence
  Description of Artificial Sequence:  Hypothetical Probe Sequence
gttcatgccgcccatgcaaa

SEQ ID NO: 9466 - DNA, 18 bp, Artificial Sequence
  Description of Artificial Sequence:  Hypothetical Probe Sequence
ggtgaggatgggcctcca

SEQ ID NO: 9467 - DNA, 42 bp, Artificial Sequence
  Description of Artificial Sequence:  Hypothetical Probe Sequence
gttcatgccgcccatgcacgtggctgactcgctgcgatgaca

SEQ ID NO: 9468 - DNA, 16 bp, Artificial Sequence
  Description of Artificial Sequence:  Hypothetical Probe Sequence
tgggcggcatgaacca

SEQ ID NO: 9469 - DNA, 23 bp, Artificial Sequence
  Description of Artificial Sequence:  Hypothetical Probe Sequence
gaggcccatcctcaccatcataa

SEQ ID NO: 9470 - DNA, 45 bp, Artificial Sequence
  Description of Artificial Sequence:  Hypothetical Probe Sequence
gaggcccatcctcaccatcatttgcgcaccatcaggttagggaca

SEQ ID NO: 9471 - DNA, 18 bp, Artificial Sequence
  Description of Artificial Sequence:  Hypothetical Probe Sequence
ccggttcatgccgcccaa

SEQ ID NO: 9472 - DNA, 19 bp, Artificial Sequence
  Description of Artificial Sequence:  Hypothetical Probe Sequence
tgatggtgaggatgggccc

SEQ ID NO: 9473 - DNA, 19 bp, Artificial Sequence
  Description of Artificial Sequence:  Hypothetical Probe Sequence
tgatggtgaggatgggcca

SEQ ID NO: 9474 - DNA, 41 bp, Artificial Sequence
  Description of Artificial Sequence:  Hypothetical Probe Sequence
ccggttcatgccgcccagcaccgatatggagaccgcagaca

SEQ ID NO: 9475 - DNA, 19 bp, Artificial Sequence
  Description of Artificial Sequence:  Hypothetical Probe Sequence
gatgatggtgaggatgggg

SEQ ID NO: 9476 - DNA, 17 bp, Artificial Sequence
  Description of Artificial Sequence:  Hypothetical Probe Sequence
ctccggttcatgccgcc

SEQ ID NO: 9477 - DNA, 41 bp, Artificial Sequence
  Description of Artificial Sequence:  Hypothetical Probe Sequence
ctccggttcatgccgcccatcgacaaggtaacgcgtggaca

SEQ ID NO: 9478 - DNA, 22 bp, Artificial Sequence
  Description of Artificial Sequence:  Hypothetical Probe Sequence
agtgtgatgatggtgaggatga

SEQ ID NO: 9479 - DNA, 41 bp, Artificial Sequence
  Description of Artificial Sequence:  Hypothetical Probe Sequence
gcctccggttcatgccggtcccaagttgcggctcactttcg

SEQ ID NO: 9480 - DNA, 23 bp, Artificial Sequence
  Description of Artificial Sequence:  Hypothetical Probe Sequence
ctggagtcttccagtgtgatgac

SEQ ID NO: 9481 - DNA, 18 bp, Artificial Sequence
  Description of Artificial Sequence:  Hypothetical Probe Sequence
ggtgaggatgggcctccg

SEQ ID NO: 9482 - DNA, 42 bp, Artificial Sequence
  Description of Artificial Sequence:  Hypothetical Probe Sequence
ggtgaggatgggcctccgtgagcgcaaggtcagagcacgaca

SEQ ID NO: 9483 - DNA, 31 bp, Artificial Sequence
  Description of Artificial Sequence:  Hypothetical Probe Sequence
catgcaggaactgttacacatgtagttgtaa

SEQ ID NO: 9484 - DNA, 16 bp, Artificial Sequence
  Description of Artificial Sequence:  Hypothetical Probe Sequence
tccggttcatgccgcc

SEQ ID NO: 9485 - DNA, 54 bp, Artificial Sequence
  Description of Artificial Sequence:  Hypothetical Probe Sequence
catgcaggaactgttacacatgtagttgtaccgtaagcccgtatggcagatcaa

SEQ ID NO: 9486 - DNA, 48 bp, Artificial Sequence
  Description of Artificial Sequence:  Hypothetical Probe Sequence
ggagcacgctatcccgttagacggacaggtaggacctgatttccttac

SEQ ID NO: 9487 - DNA, 44 bp, Artificial Sequence
  Description of Artificial Sequence:  Hypothetical Probe Sequence
cgctgccaactaccgcacatccgcttcttgtcctgcttgcttac

SEQ ID NO: 9488 - DNA, 26 bp, Artificial Sequence
  Description of Artificial Sequence:  Hypothetical Probe Sequence
aaaaaatctactgggacggaacagca

SEQ ID NO: 9489 - DNA, 21 bp, Artificial Sequence
  Description of Artificial Sequence:  Hypothetical Probe Sequence
atctactgggacggaacagca

SEQ ID NO: 9490 - DNA, 27 bp, Artificial Sequence
  Description of Artificial Sequence:  Hypothetical Probe Sequence
ttgaggtgcgtgtttgtgcctaaaaaa

SEQ ID NO: 9491 - DNA, 45 bp, Artificial Sequence
  Description of Artificial Sequence:  Hypothetical Probe Sequence
ttgaggtgcgtgtttgtgcctaagccgcagcacgattccgtgaca

SEQ ID NO: 9492 - DNA, 25 bp, Artificial Sequence
  Description of Artificial Sequence:  Hypothetical Probe Sequence
aaaaaaggacggaacagctttgaga

SEQ ID NO: 9493 - DNA, 19 bp, Artificial Sequence
  Description of Artificial Sequence:  Hypothetical Probe Sequence
ggacggaacagctttgaga

SEQ ID NO: 9494 - DNA, 29 bp, Artificial Sequence
  Description of Artificial Sequence:  Hypothetical Probe Sequence
tgcgtgtttgtgcctgtcctggaaaaaaa

SEQ ID NO: 9495 - DNA, 25 bp, Artificial Sequence
  Description of Artificial Sequence:  Hypothetical Probe Sequence
aaaaaaggacggaacagctttgagt

SEQ ID NO: 9496 - DNA, 19 bp, Artificial Sequence
  Description of Artificial Sequence:  Hypothetical Probe Sequence
ggacggaacagctttgagt

SEQ ID NO: 9497 - DNA, 46 bp, Artificial Sequence
  Description of Artificial Sequence:  Hypothetical Probe Sequence
tgcgtgtttgtgcctgtcctggtgagaagcgtccaagccagaacga

SEQ ID NO: 9498 - DNA, 24 bp, Artificial Sequence
  Description of Artificial Sequence:  Hypothetical Probe Sequence
cacctcaaagctgttccgtcccaa

SEQ ID NO: 9499 - DNA, 20 bp, Artificial Sequence
  Description of Artificial Sequence:  Hypothetical Probe Sequence
ccaggacaggcacaaacaca

SEQ ID NO: 9500 - DNA, 46 bp, Artificial Sequence
  Description of Artificial Sequence:  Hypothetical Probe Sequence
cacctcaaagctgttccgtccccatccaaggtccgacacgcaacga

SEQ ID NO: 9501 - DNA, 20 bp, Artificial Sequence
  Description of Artificial Sequence:  Hypothetical Probe Sequence
acggaacagctttgaggtga

SEQ ID NO: 9502 - DNA, 47 bp, Artificial Sequence
  Description of Artificial Sequence:  Hypothetical Probe Sequence
gtgtttgtgcctgtcctgggagacatccaaggtccgacacgcaacga

SEQ ID NO: 9503 - DNA, 20 bp, Artificial Sequence
  Description of Artificial Sequence:  Hypothetical Probe Sequence
cggaacagctttgaggtgca

SEQ ID NO: 9504 - DNA, 27 bp, Artificial Sequence
  Description of Artificial Sequence:  Hypothetical Probe Sequence
tgtttgtgcctgtcctgggagaaaaaa

SEQ ID NO: 9505 - DNA, 45 bp, Artificial Sequence
  Description of Artificial Sequence:  Hypothetical Probe Sequence
tgtttgtgcctgtcctgggagttcgacgattcgcatcaacgcaag

SEQ ID NO: 9506 - DNA, 27 bp, Artificial Sequence
  Description of Artificial Sequence:  Hypothetical Probe Sequence
aaaaaaaagctttgaggtgcgtgttta

SEQ ID NO: 9507 - DNA, 21 bp, Artificial Sequence
  Description of Artificial Sequence:  Hypothetical Probe Sequence
cagctttgaggtgcgtgttta

SEQ ID NO: 9508 - DNA, 27 bp, Artificial Sequence
  Description of Artificial Sequence:  Hypothetical Probe Sequence
tgcctgtcctgggagagaccaaaaaaa

SEQ ID NO: 9509 - DNA, 29 bp, Artificial Sequence
  Description of Artificial Sequence:  Hypothetical Probe Sequence
aaaaaaaacagctttgaggtgcgtgtttt

SEQ ID NO: 9510 - DNA, 21 bp, Artificial Sequence
  Description of Artificial Sequence:  Hypothetical Probe Sequence
cagctttgaggtgcgtgtttt

SEQ ID NO: 9511 - DNA, 44 bp, Artificial Sequence
  Description of Artificial Sequence:  Hypothetical Probe Sequence
tgcctgtcctgggagagaccaacggggaaggttgagcgtgacag

SEQ ID NO: 9512 - DNA, 19 bp, Artificial Sequence
  Description of Artificial Sequence:  Hypothetical Probe Sequence
tttgtgcctgtcctgggaa

SEQ ID NO: 9513 - DNA, 26 bp, Artificial Sequence
  Description of Artificial Sequence:  Hypothetical Probe Sequence
agaccggcgcacagaggaagaaaaaa

SEQ ID NO: 9514 - DNA, 19 bp, Artificial Sequence
  Description of Artificial Sequence:  Hypothetical Probe Sequence
tttgtgcctgtcctgggat

SEQ ID NO: 9515 - DNA, 44 bp, Artificial Sequence
  Description of Artificial Sequence:  Hypothetical Probe Sequence
agaccggcgcacagaggaagcactgcacacgaaacggcacacag

SEQ ID NO: 9516 - DNA, 20 bp, Artificial Sequence
  Description of Artificial Sequence:  Hypothetical Probe Sequence
gtgcctgtcctgggagagaa

SEQ ID NO: 9517 - DNA, 44 bp, Artificial Sequence
  Description of Artificial Sequence:  Hypothetical Probe Sequence
cggcgcacagaggaagagaaaagcaagccaaggtatggctttgc

SEQ ID NO: 9518 - DNA, 20 bp, Artificial Sequence
  Description of Artificial Sequence:  Hypothetical Probe Sequence
gtgcctgtcctgggagagag

SEQ ID NO: 9519 - DNA, 20 bp, Artificial Sequence
  Description of Artificial Sequence:  Hypothetical Probe Sequence
ttgtgcctgtcctgggagaa

SEQ ID NO: 9520 - DNA, 44 bp, Artificial Sequence
  Description of Artificial Sequence:  Hypothetical Probe Sequence
accggcgcacagaggaagagcgtgcgcacactcactgtccttcg

SEQ ID NO: 9521 - DNA, 20 bp, Artificial Sequence
  Description of Artificial Sequence:  Hypothetical Probe Sequence
ttgtgcctgtcctgggagac

SEQ ID NO: 9522 - DNA, 26 bp, Artificial Sequence
  Description of Artificial Sequence:  Hypothetical Probe Sequence
gtctctcccaggacaggcacaaaaaa

SEQ ID NO: 9523 - DNA, 19 bp, Artificial Sequence
  Description of Artificial Sequence:  Hypothetical Probe Sequence
tctcttcctctgtgcgcca

SEQ ID NO: 9524 - DNA, 47 bp, Artificial Sequence
  Description of Artificial Sequence:  Hypothetical Probe Sequence
gtctctcccaggacaggcacaaataccgacatcctgggattgcatgg

SEQ ID NO: 9525 - DNA, 19 bp, Artificial Sequence
  Description of Artificial Sequence:  Hypothetical Probe Sequence
cctgtcctgggagagacca

SEQ ID NO: 9526 - DNA, 47 bp, Artificial Sequence
  Description of Artificial Sequence:  Hypothetical Probe Sequence
gcgcacagaggaagagaatctcctaccgacatcctgggattgcatgg

SEQ ID NO: 9527 - DNA, 17 bp, Artificial Sequence
  Description of Artificial Sequence:  Hypothetical Probe Sequence
agaccggcgcacagaga

SEQ ID NO: 9528 - DNA, 47 bp, Artificial Sequence
  Description of Artificial Sequence:  Hypothetical Probe Sequence
aagagaatctccgcaagaaagggttcggctgttcgtaggcaagaggt

SEQ ID NO: 9529 - DNA, 21 bp, Artificial Sequence
  Description of Artificial Sequence:  Hypothetical Probe Sequence
ttgtcctgcttgcttacctca

SEQ ID NO: 9530 - DNA, 25 bp, Artificial Sequence
  Description of Artificial Sequence:  Hypothetical Probe Sequence
aaaattgtcctgcttgcttacctca

SEQ ID NO: 9531 - DNA, 26 bp, Artificial Sequence
  Description of Artificial Sequence:  Hypothetical Probe Sequence
cttagtgctccctgggggcagaaaaa

SEQ ID NO: 9532 - DNA, 45 bp, Artificial Sequence
  Description of Artificial Sequence:  Hypothetical Probe Sequence
cttagtgctccctgggggcagactccgcattgccagagctgatgg

SEQ ID NO: 9533 - DNA, 19 bp, Artificial Sequence
  Description of Artificial Sequence:  Hypothetical Probe Sequence
ctcaccacgagctgccccc

SEQ ID NO: 9534 - DNA, 18 bp, Artificial Sequence
  Description of Artificial Sequence:  Hypothetical Probe Sequence
tccgcaagaaaggggagc

SEQ ID NO: 9535 - DNA, 43 bp, Artificial Sequence
  Description of Artificial Sequence:  Hypothetical Probe Sequence
ctcaccacgagctgcccccatggccgtgctggggacaagtcaa

SEQ ID NO: 9536 - DNA, 62 bp, Artificial Sequence
  Description of Artificial Sequence:  Hypothetical Probe Sequence
tgcatgcagtcatgcatgcagtcatgcatgcagtcatgcatgcagtcatgcatgcagtcatg

SEQ ID NO: 9537 - DNA, 24 bp, Artificial Sequence
  Description of Artificial Sequence:  Hypothetical Probe Sequence
attcagaatcattttgtggacgaa

SEQ ID NO: 9538 - DNA, 24 bp, Artificial Sequence
  Description of Artificial Sequence:  Hypothetical Probe Sequence
cgcagattttgcgctggatttcaa

SEQ ID NO: 9539 - DNA, 24 bp, Artificial Sequence
  Description of Artificial Sequence:  Hypothetical Probe Sequence
attcagaatcattttgtggacgaa

SEQ ID NO: 9540 - DNA, 24 bp, Artificial Sequence
  Description of Artificial Sequence:  Hypothetical Probe Sequence
atggccgtgctggggacaagtcaa

SEQ ID NO: 9541 - DNA, 21 bp, Artificial Sequence
  Description of Artificial Sequence:  Hypothetical Probe Sequence
tgtggtagttggagctggtga

SEQ ID NO: 9542 - DNA, 24 bp, Artificial Sequence
  Description of Artificial Sequence:  Hypothetical Probe Sequence
ggctcgtgtgtagctgccgttcct

SEQ ID NO: 9543 - DNA, 21 bp, Artificial Sequence
  Description of Artificial Sequence:  Hypothetical Probe Sequence
tgtggtagttggagctggtga

SEQ ID NO: 9544 - DNA, 24 bp, Artificial Sequence
  Description of Artificial Sequence:  Hypothetical Probe Sequence
ggtcaagcgctgaggtggtccatc

SEQ ID NO: 9545 - DNA, 21 bp, Artificial Sequence
  Description of Artificial Sequence:  Hypothetical Probe Sequence
ttcgacatagtgtggtggtgc

What is claimed:

1. A method of designing a plurality of capture oligonucleotide probes for use on a support to which complementary oligonucleotide probes will hybridize with little mismatch, wherein the plurality of capture oligonucleotide probes have melting temperatures within a narrow range, said method comprising:
    providing a first set of a plurality of tetramers of four nucleotides linked together, wherein (1) each tetramer within the first set differs from all other tetramers in the first set by at least two nucleotide bases, (2) no two tetramers within the first set are complementary to one another, (3) no tetramers within the first set are palindromic or dinucleotide repeats, and (4) no tetramer within the first set has less than one or more than three G or C nucleotides;
    linking groups of 2 to 4 of the tetramers from the first set together to form a collection of multimer units;
    calculating the predicted melting temperatures of the linked groups of 2 to 4 of the tetramers in the collection of multimer units;
    removing from the collection of multimer units all multimer units formed from the same tetramer and all multimer units having a melting temperature in ° C. of less than 4 times the number of tetramers forming a multimer unit, to form a modified collection of multimer units;
    arranging the modified collection of multimer units into groups differing by 2° C. increments in melting temperature;
    randomizing the order of the groups of multimer units;
    dividing alternating groups of multimer units into first and second subcollections;
    arranging each of the first and the second subcollections in order of melting temperature;
    inverting the order of the second subcollection;
    linking the multimer units of the first subcollection to the multimer units of the inverted second subcollection to form a collection of double multimer units;
    calculating the melting temperature of the linked multimer units in the collection of double multimer units;
    removing from the collection of double multimer units all double multimer units (1) having a melting temperature in ° C. of less than 11 times the number of tetramers and more than 15 times the number of tetramers, (2) double multimer units with the same 3 tetramers linked together, and (3) double multimer units with the same 4 tetramers linked together with or without interruption, to form a modified collection of double multimer units; and
    producing the modified collection of double multimer units.

2. A method according to claim 1 further comprising:
    placing the modified collection of double multimer units at positions on a support.

3. A method according to claim 2, wherein the collection of double multimer units removed has a melting temperature in ° C. of less than 12.5 times the number of tetramers and more than 14 times the number of tetramers.

4. A method according to claim 1, wherein the collection of multimer units have 12 mers, the double multimer units have 24 mers, and the melting point of the double multimer units is 75-84° C.

5. A method according to claim 1 further comprising:
    reclaiming double multimer units having a melting temperature in ° C. of less than 11 times the number of tetramers and more than 15 times the number of tetramers;
    unlinking the reclaimed double multimers units to each form a pair of reclaimed multimer units;
    selecting reclaimed multimer units with a melting temperature in ° C. of more than 11 times the number of tetramers and less than 17 times the number of tetramers; and
    reintegrating the reclaimed selected multimer units into said method.

6. A method according to claim 5, wherein the method is repeated.

7. A method according to claim 1 further comprising:
    making additional different sets of a plurality of tetramers by producing, base by base, circular permutations of the tetramers within the first set and complements thereof.

8. A method according to claim 1, wherein the collection of double multimer units has a melting temperature in ° C of less than 12.5 times the number of tetramers and more than 14 times the number of tetramers.

* * * * *